United States Patent 7,365,185 (GENOMIC PLANT SEQUENCES AND USES THEREOF) - sequence listing, part 29

SEQ ID NO: 59197 - DNA, 3878 bp, Oryza sativa
aagatcccgtcggtcttgcgacatcatatatgaaactcaagatactataaaaagatatctagtaggttcagcattgttttggtttggtagaatcgcaatatcatagtcgtagcattttatgataatactacgatctggattaggatatttaatcattgtatactcacatggcaaaccctttcggttttctctcaattatattgctggatagctgtaacacttccccgaatggtaagagatcgaacccatccaattcaactggcatgatcaacaccgcggtgaattatcaaccagcgtggccagtgttgaactacaacgactcctactattattactgcatcagtttgaggaataaaaccgttataaatgtttactatccggcaggctagctacccagtgtccagaggagctcggctaacaggctaactgctcatatacatcaggtgtgtttaggcccacgccaaaattgaacattcgattgaaattgaaacgatgagacggaaaagttagaagtttatgtatgtagaaaagttttaatgtgatgaaaaaattaaaagtttgaagaaaaattttaaaactaaacttggccttgatcgaatttcttcgggcagctacagcaatgcctagtggtggcaactcttgtctttgacccccacagagcttggtcaagaaaggtgacagctagctaagggagatcaaaagggcaaaaaggagaagcgaagtgacaaggctaactaacccaaagggacatgagttacgcgcatgattgaaaaccagctagactggcaggctggcaagtgtatgttgccatgttgggttgcaaccccaatgtggcaaaaaaccagataacaagcatttatttcaagcctattacctagtagtaagcattatgggaagaggtagtagttactacctggtatttgtgctattgccggcaacaaccaaataaaatataagatggatggattttttcaggtggaccccagcttgtttaccactacactcatataagcattgtgagaagagttgcagcttactacctcctggtcatgggcccatcttatttactagttgggtaagatacattgcgcatgccagggcaaagaaaatccgaacatcttttccccaaagctctctctggccacttcaaccttctttacgaggtgtaataaaacacgcaggacggctctccagtttgcccggcgttttgcatgcgcgcggatgagatgcactgccatcatcatggtccagacgtcctcgcaggctcgcacacgaacggcgatcatacatgctccgcaatggaacgagtagtagtatagagaagctctgaacttgtccaagtacggcgatcatacctctgtccatgtatcagatgttcagatattagctcctctcacactggcgttcacgagcagacggaaaatctagcgcccggccgtagaggggagaaacaccatggaggaggagacaagtgtaggtactgtgctaaagctgtgcagctagctctggagtacgtcttctgctacgactgcatggtggcgagacatacatgcagaaacatcagcacagcaatgatactttacgactgcatgcattgttgagagacagtacacagacggagatcagttgtacgctgcaacttgtgtcccgacaggaagctccaccataccacttcaagaagagtatttgcttcttcgtcaattatactccatatatgacgacgaaccaacgatggggacctactgatttcagctcttctcttcaagattctcactcgagtgttcttcaaaacagactactccgaacatgtagcagtacctttgtactgatctacctcacctcacagcttttctcgtaatagtagaacagatgctgcatgcgctgtgactttagcaaccaagattcttcatcctctcctcctatccccaaggcatcatctgcctgcagccacccaaattgctcgacacctctcttgcccctttccttcgagctgtgcaataatactgttcatccactgctccgttcaacataaagatacaataattccggtatcgtggaaaaggggaaaaaaaaatctctcgagtgccagctcgacgatgatgctcgccgtggtgggctggcccgcatgacagtggaagcaggacgggtgggcccccacggggtcaccgtcaccggaacgaggccttgggaggcccacctgggccggcctttgccggacagcatgcgcacgtgacggcacgggggaggcatgctccctctccaggaccagtcgccgcccgtcgcctcggccggcggccagccggccggccaccggctgctgcacacgtcgacatccccgtcactgtttcctcctgaacagtgggcccgaggaggagagcatctcctcggtttttaccgtcctctctttcctgtgtcactgtattggcggtgatgacgattctctgctgctggttggctacttcggctccaatggtagagcactgtagggctaagctttgactgtagcaggtgtaagtttttttttttcttttgccatgtgtgaagcctgtagctgtttggtggtatgtaaaagtcgccaatgtctgtcactcagctggcagggagggagggagtgaggggagattgtgcagggagaaaagagaggtggtattgcaatgggccaaggtcagtagccgatcgatcacactggcatctgctcaactcaccaagttggcgaaactgtttttcacagacgtgtcggccggggtaaggagcaaagaagggatctttcggtagccggatcgtgaaatgtcggccggacggcaggaagagtgacaaatggtgctagactgcattgtccacaacaaggccgttctgttcaccactggctcggcacataccggatcgtgtgcatcagtgcatatggagatccgttgctacagctaaaacatcatcaacagtgaggccattccgctcacagctactattacctggacctatatagcctgctggttttgctgctttaccaggcggtataggtgcctctacgtcatacgtacgtccagtccagctcggcttctctcaagagtgttctgtaaggccattgacaatgcatctatagatggcattcagcccaagctgtcacgtacgtaggagattcctctccatgttcgtgcaagtcatggcctcctgaagttcctcgtcccccacaaagacctgcataggaccactcagcgtgggggcaccatcgctcgtgcaaccgtgttgtgaagatcgtgtccatcgctggccctaaaacccagctttggtgcctcaacgagggacatggagtagctcgccgattccaacggccatcgcactggtcaagcaaggccagtgagtgaagggcttcgatttgcgccggagaagagagggcacaagcgcacgagacgcctagagagctcgtcagttgcgccttggagggtgctcgttcctccgtctacttgttgtcgcaaagctcgtcgttgtgccgggcgccgatcactggtggagaaaccatctttggtcggtcggccaaattctacaatagtcccggttctaataaaaaccggaactaaaaagcatctttagtcccgatttaaaagttgaggggtactttttgatctttagtctcggttggtgttaccaaccgcgactaaagatcatttttaatcccggttcaataagtcgtggggttcaagacagaccccaattatttttactcccggttggtataaacagccgggactaaaaatagtcccagttgtttatcccaaccgggagtaaagagtaccccgaaccgcgcgccaaatattatccgcgtgccaccaaaataattgtttatatcaaatatttttactcccggttggtataaacaaccg

SEQ ID NO: 59198 - DNA, 1144 bp, Oryza sativa
tccctgatctccgcagcccacttgcccaacggtcgccgcctcaccccgcggtacttgcgcgctgtcgcgggcgcagccaccaccaccgccgccgccgcctcggccacgtttgccccgccggcgtgatctcccgctgtaaattaaacatcgcagtacacaacacaacataaacacacatcatcatcatccgttccgcgggtcgagcagcacaggatggagcaacaaacagaggtaccggagacgacgccgaccatctcctcctcccgcgcaacgtcgacgcgccgcccgccgcctgttcccgcccgcggcggcacgaccaacgacggcgcgggcggcggcacgcagacgccgccgccgcctccacgcccgccgtcggcaatgacgcgcgtcagcgcagccacgatggccgccgtctccgcggcctcgaagagcgccgccattgccggcggccgcatcgatcaagattatattcaagaacgctgtccgtccagtgggatttcgcgtggcgacgtcgagatcgaacgtgcacttgatcttgctgagggcatgatcgatacgtgggggagggaggcctatttataatggagtttgtgagtgaggcgtgtgtatgatatggccaacgcgataaggaaaagaagcgtatgggcagcgtttccagttccatgcaatggaagaagaagaacttccagaagttgctcgacttttcccagcttggaatgtatggcttcgtgacctcactgcaattggccgggagtgttttcgtgtgctttttcttattatttcactacacctacgacatatttttaagagtaaagttcatcaccgctccctaaacttatattgctgtgtcatcccggtccctaaactcgcaaatcgaccgttcagatccttaaacttgttcgactgtgtcatcccggtccccaaacttgcagatcactcgtttaggtcctccaacttgttcagttgtatcaccccggtccctaaacaggacggtttaaaaactttatattaaaaagtaattcataactttttcatgtgaactctaatgaagacaaattttatatcaaaatggtagccctcgacacgacctacaactttgtagttgataagtttttgaattaaaactgtttagggtcctaaaata

SEQ ID NO: 59199 - DNA, 6484 bp, Oryza sativa
attttgtgatgtgatgtattatgatctgtgatgcatttcttttcaatatgtgatgtatttctttccagatctatgatgcactttgatttggggatgatttgggaatatgatcggggatatttagggagcaaatcgattttaaaaaaaaattaaccgggattgctcctaccatctttagtcccggttggtaacaccaaccggggctaaagatggatttttagtcctggttatttcacccgggactaaagatacccatctttagtcccggattcgtagtctcggttgtataaccgggactacaggggtccccaaccggaagtaaagcctctttctccaccagtggatccctactcaaccaccttccttcctaacttctccaccaacgttgggtggctgggaggagatggagttgagggaggagggaggggggagggggtgcgcgaggggtggcgctgccatcatggtccatgtaccctaagatcggcgaccgacatggccacatgaggttggaggggctggatccggaagttgcagatccttgacctccagtgcgtcggacgaggagcggcttgccttggcctcctctccgccgttgtggtgttgccttgatttatttattttaaagcggagtaagtatcaatatagtggtgccaattatatgaattataaaatgtgtactagctcgatactaaaataagttaatctagtattgaatgcttcacatcttagtattatgaatctgttcaaatttatagtattaggatgtgttatatccgatactaaattaacttattatggaacggaggaggtataaggtacttaacaaatattcagtagctagtgacatactcatgctactactatacacatattataggatgaggatattgtggcgatgtgtcatgcaattgacatagccaagccaagagggctgtgtggccagcgtgtcagcaacaacaacatcgctttttggctgagtaaaggccgtgtgttttcgcacaacttgcagctgttccctgttcccatcccacaaactcgtagggcctctgcccactcattgatcagtcagcgagtcagataacgacatgtcaaccctgtaattaattaccctaccctgccggccgtgatcaagtagatggatcaccggtttctcggttagtagtgtaccccgtactctccctatctcgtaaaaaacgaatcttagtactatgacgtgttgtatctgatactagtttgattttttatgggacggagagagtaactcgttttaatggattacgtaccctgcccgggtcatgtcaacaacatgctcaagaatacggtaaaaggacaatacagtataggcaagtcgatttcgcagcagtacatgcgagttaggagtatgattaacaatgacgcacacacaaagcaatgagtagtcaacgcatatcaaaattcgcgtgaagctgtagtatacgtactcccgagtgaaaaaactgaaaatggacagtgagtgcaaaatactactactacgtatcctaggaaccaactaatcatacacgaatatcacacgcaaacaaccaaatccagttgcattaaactgccaatctgaagtggggtaacaccagagatcgtcgactagtcgtaagctgaaaccgccagaacgaatacaggtaggtaaccaatcggttgtcccatcaatcaaagtatcaaacagcttcatctatcgccatgggtgcagcgcaacgccatggcccatggggcaatgggtgcagcgcaaagtggccacttgaccagttctcatgtgcctggaaactcgccaattcgtcaatcgccatgggtgccgctggtagaatagaaagagagagaactaggtcatgcacatccatcaggtggggtgcacgtacgtgctgggcacgtacgtgctgggctgcccaaacctgaaactgccaatgtgtttgttaggcctaccgtactagttgggtctatttcgttcttttttcttctcagcgagcggttaggcctatttctgtaggaataagttcactttaggcccctctatatttaatttgtcgccaagtttaaaattcatccatgaaccgcatgtgacatgtcccttagcttctaaaatcagtgcaaataagatataagacggtttaaaacagtggtttcgcttgacgtgttgtcttcattgtgttgacgtgacacttaaaaaccgtgggacccaaatagcactgaatgtttggtttaaaataaaaaaaattacagtgggatccacatgttttggggtctgccacgatgacctggcgacgggctacctgctcaatgagttcaccgacgactgccatgcaaatgtgtggatacatagatgaaaagttttagcgtttcacatcggatatacagacacatatttaaagcaataaacatagactaatattaaaacaaattacagattccgcctgtaaattgcgagacaaatttattaagattaattaatccgtcattagcaaatggttactgtagcatcacatgtcaaatcatagagcaattaggtttaaaagattcgtctcacaatttacacgtaatatatgtaattagttttttttttgtctatatttaatacttcttgcctatgtccaaacattcgatgagacatgatgaaaagtttttacgtagtaactaaacagagccctaccaaacactccacaaggggttcaactgtaatgtggagaagaagacaagatagcaccattgtgagcatagatgccgtgccatattgcgacactcgagccaatcgaggtcacccaaatagtgctatacatctttttttttttggtaaaacacactacaaatgtagttgaccataacacgcgcacgcttatccttatgaatgcatacatgcactctctactattatgagcacctccggaaggtgaccataactcatgcacattcatccctataaacacacacaacacacactttatcactatgggcaactccagaaaattaggccggcatatcttgagaatgatgaagtcaccacgaatgccacactcgcctaccaataaaagaataattataaatgcgtattacatgtcaaatctaagatttgaatctgggtgggttgttttcatcataataaatctagctagttactcacttcttagataattatatacgtctgcatatgtacatgagtaggctggtatatacaacaagagaccactactccgaaagtatcaaaaggactaagagtgaaaattaattctgattagttcccgcaaccccagttaccccacctctaaacttgcaacaccctttctaaaagttacgaacacagaacactctataaggggttcggttgtaacctgaagaagacgagattgcgagcatagatgccgttccgtgttgcggcactcgcgccagtcaaggttactcggatggtgctatgtatctatctagctatacaatggagtagaatggtacacacccatactttgtatcgtcattttcacgttcccgcaaccgaactgatatgatggaggacctcaagcatacgacggcaggttgcagcgttaacgctcaccatcatgcccatgacatgaggccaggatcgactacaccagaatcacatcatgtcattagcagcggagtcttcacgtgctacggtgctaggatgctgctatctactggagtctggagtaggatggtaatatctccgccctaaaataattttacttttagctattaagatttaaattgacaattaaaaaacaatgtgatcaattttaataataagaaaatagtacgagaaggttcgtaaaaagtaccgaatgaataaaacttctcggtactagttaaagggatagaagtgaacttattttaagataactagcacaatatcaatgcgttgtaacggatattataaaagaaaaaaggtaaaatttacaagtttttagcacagtaaatccatttggcatataatgcctacctggtgttaagatttaatgatgcaatacaatcaatgtattgataggcataaacttcgagacaactaaaagagctgatttaatggggtgtcaaacctatgggcccatacgtcaagaagggggtagtgctagcaaattcaatgccactaccattgctctcttttaaaatggtatggacttatactaccatcatcacattctattatgatgttggtttattttggtgtggtgggagtacacgcgaggcgtgctctctaaacgcactagaaattattaaagaaatagaaaaagtagcctccacgttcgctctcatggcctataaattcctacattaatcggagaaaaagaaaaagcagagtccatataaaaatacaatttagaaatagctgaaattcagaattaaaaaaaaaggaatattagattatgagactagagtccatatagaaatacaatttacaaatagttgaaattcggaattaaaaaataagaaatattagaagaggagtatagagtccatatagaaatacaattaggaaataactgaaattcgaaattaaaaataagaaatattagaagtagagtatagagtacatatagaaatacaattagaaaataactaaaattcggtattaaaaataagcaatattagaagtagagtatagagtccatatagaaatacaattaggaaataataaaaatatggaattaaaaataaggaatattagaagtagagtatagagttcatatataaatacaattaagaaaaaaaaatagaaattcggaattaaaaaataaggaatattggaagtagattatagagtccatataggatttttaaaactaattaaaatttgaaataaacataataaaattaaaagtagagtttagagtccgtataaaaatacaatttacaaataactaattaagaaaaacatgggaagaagagtttaaagtcaatataggaatacaatttagaagtaactgaaattcgaaatttaaaattaaagaatattgaaagatgagtttagagtccacgtagaaatacaattagaaataataaaaattcagaaataaaaataaataatataggaagaagagcatagagtctatatagaaatacaatttacataaaattcagaattaaataaaaaagaatattaaaagacgagtctagagtccatataggaatatatataatttacaaataaataaaatttgatattaaaaataattaataactaacacgtatataaaatacaatatgaatactacacattagtagtcttgtaaagttattgcaaaatttaaaattgtgttgtcattttaatatatttgaataatataatgagaaaacatatattctattatttgagaaagaatataatgatgctagccgcgtaatctgcgcggactatcatgctagttatattattaaaggaatagaaaaaggagcatccatgttcgctctcatggcctagaaattctctcattaatcggagaaaaagaaaaagtagagtacatatagaaatacaatttagaaatagctgaaattcgaaattaagaaataagaaatattagaagaggagactagtgtccatatagaaatacaatttagaaacaattgaaattcagaattaaaaaataagaaatattagaagaggagaccagattccatatagaaatataattaggaaataacagaaattcggaattaaaaataaggaatatcagaagtagagtatagagtccatatagaaatataattaagaaaaaaaatagaaattcagaattaaaaaataaggaatatcagaagtagagtatagagtccatgtagaaatttaaaactaactaaaattcacaataaacataataaaattaaaagtagagttttcagtccatataaaaatacaatttacaaataactaaaattcgaaattaaaaaaaacatgggaagaagagtttaaaggctgtgttctttgctccatgttcccaacccctctccctcatattccgcgcgcacgtttttcaaactaaacggtgtgtttttcaaactaaacgaaagttgtttaaaaaaaatcaaattaatccatttttttaaaaaaattgttaatacttaattaatcatgcgctaatggaccgttccattttccgtgcggggagatgggttctaaaccatgacatgcgaacacacccaaagtcaatataggaatacaatttagaagtaactgaaattcgaaattaaaaattaaagaatattgaaagatgagtttagagttcacatagaaatacaattagaaataataaaaattcagaaataaaaataaataatattgaaaaaagagcctagagtatatatagaaatacaatttacagaaaattcggaattaaaaaaagaaatattaaagacgagtctagagtccatataggaatatatataatttacaaataacttaaatttgatataaaaataactaataactaacacgtatataaatacaatatgaatattacac

SEQ ID NO: 59200 - DNA, 696 bp, Oryza sativa
attcctgcagccccgccactcgaccgcctgttatcatgttgcatgaaataatttggtacaatttttttcatgttgcatgaaataagttatggaattatataaattgttattacttaattgaaaaatgctacaggacggtatttcattcggataagatgatacctttaaagcatcacctagtacctctgataggtatcggctgatataccgttcggacgggataatatctctgagatatcagctgatatctggtagatgataccactgtcttattttatcggttattaatgctcagtgattatgatttagtacacggcttctaattaaatttcacgggcacccggtagcctacctgtatttttcgaacagtttatcatcatttctttgtttttctctagacgagacatggctctgctgctgcttgcagaatgcagaattgcagatcctaacggtagtgtgctcgcgcgagctgttgcagcctttggcaccggggccatcggttagatatccccgtccgactctggcaacggtcgtggcttgtgcatgcaagctggggttaattttggtccaatggcatttttttttctcctaccagaaaacgatcggtaaaagctatagcaagaaagaaaagaaaacaggggtaaagaccggcagtaccactagctggtacgaaacggtgacatatgcgtgtgctta

SEQ ID NO: 59201 - DNA, 6864 bp, Oryza sativa
cgaggcccccgtccagctgccatgtggcggggacagcaagcgggaaggggacccaggctgaaccgctatcaatgcgcgcggcgccccaactgcccctcgccgcattaaatgcggtaggggcagacatgaggtgccgcccgactgacgcacatcagtcaggagtgaccggtctgtgaccggcctatcgccggtcacgtctgactggacgggcggccgtgcccccacgtcgcctctgtccccggcggagtggaggtaggtatgacccgtcccatcggagcgtgattcggagctccctccacgagaaggacgtccaccacaagtcttcacccatttatgagggaatgacagggctgtcccccgtgtcaggcagggggcgacgatgggtcccgcttaaggacgagcggtggcttggcttccgggcgaaggcacgaattgtgatctggtcaaggtagggtgggtccccaccctgtagaagagtaggtagaggcggtgcatgtggtttccccttgagctataaaaggaggaccttacccaccgagaaagacgacgactctcaggaagcctgagctctaggagaagagaagcgagaacgctctccggagtttaggaacccttgtaactctcaaccttaaatcccacacacagaagtagggtattacgctccatcgcggcccgaacctgtataattctcttgcccatacgcgactagcaagacttagggcggatacgcgatctctagaggcgagcccttttccctagccgaactcacaaaaggggatctcacgatctcccgatagagaggattactcctcgacaatgtcattttaatatatttgaataatataatgagaaaacatatatgctattatatgagagaaaatataatgatgctagccgcgcaatctgcacgggccatcatgctagttttaataataagaaaatagtacgagaaggttagtaaaaagtactgaatggataaaacttctcgatttacatagcaaatactagttaaagggatataagtgaacttattttaagataactagcacaatatcaatgcgttgtaatggatattataaaagaaaaaaggtaaaatttacaagtttttagcacaataaatccatttggcatataatgcctacctggtgttaagatttaatgacacaatacgatcaatgtattgataggcataaacttcgagtcaactaaaagagcttatttaaggggtgtcaaacctatgaacccatacgtcacgaagggggtagtgctggcaaattcaatgcccctaccattgctctcttttaaaatggtatagacttatactatcatcatcacattctagtatgatgttggtttattttggtgtggtgtcgcgtgttctctaaacgcactgtgtcgtgcttcatccatcttaaaataatcttatcttttacctatttcacacgtaccaataaaaatctctaatttattaaatgctaatctcttcgtctcaaagtgaacagaagaatatactagtaatacaattatttctcttctaatccgctctcagtagatttaccccgtacttacagccctctacaatcctccctaaacacagagtgctatagcactgtgcagtgcagtgcctcattcgtctcaaaataatcctatcttttacctatttcacgtaccaataaaaatatctaatttattaaatattaatatctccatctcaaaataaacagaaaaatatactagtaatacaattactacttatgttccaatccgctctcagtcgacttaccccgcacttggcagtctggcctctaccatccttgcgccgtcgcgcgctcgtgccggggcttggctgcgagcgaataaaaagaaaagaaaacgtcaaggcctcagacgccagagcgctacaaaatggcccacgccgccgcggccacgggcgcactggcaccgctgcatccactgctccgctgcacgagccgtcatctctgcgcctcggcttcccctcgcgccggcctctgcctccaccaccaccgccgccgccgccgcagcagccggaggacgaaactcgccgtgcgcgcgatggcaccgacgttgtcctcgtcgtcgacggcggcggcagctcccccggggctgaaggagggcatcgcggggctctacgacgagtcgtccggcgtgtgggagagcatctggggcgagcacatgcaccacggcttctacgacgccggcgaggccgcctccatgtccgaccaccgccgcgcccagatccgcatgatcgaggaatccctcgccttcgccgccgtccccggtacgtattgcccgccccactccgcccccccggaatctacgcttgcctggctgcgcggctgagcccatccagcttttctgtttggctgcaagccgctggccatagagaatcccggccatttttctgctgcttaacagttgtttctgcctacctaacccctgctcgcctcacggctccagcacgtacggcaaaatcatgagatattcagggggttttctttttctttttctttttggagacgataaactcaccatcttgattggtgtgggtttaattttgtacagtaccactattttgttccattcattcattcacttggtactcgtactacgaaaggtgtggacctgtgacagttttggcacgcactattcccaacaggggttttgcagtcctatctcacacggtagaccgtttgagcatttagggcccttttaaatcatagaaataaaaaaacaaaggaataagaaaagcacaggattctaacaggaatacaattgtaaaacagaggattgcaaaacacaggaaaaatacaggaatgaccgtttgattggaccacgagaaaaatgtaggaatcatatgagagagatagactcaggaaatgttccaagaggttagacttcttgctaactttcctccaaaatgtgcataggattacccattccataggaattttaaaggattgtatatgattcaatcctttgtttcaaagaccttcatatgatttttttttccataggattgaaatcctctaaaatttctacatttttcctacaaatcaaaggggcccttaagttcgttagcttttctgtttgaaacatgttttgcacggattatttagttgattaacacgataaatcaatattttaagaaataaactttacacataatttagagtaagtaatctaacaatgcagtagaagtttttttttttttgagaaatcgtattttaataagagtggagcaaaaacctttggcaaaaatttggagaaaagaagctcaaaaaacaaaatccgtggcgaaccggcgattgtggtattagtactgcaaagaatacgaaaaagaccaaaattgttgcctgaattcagccgtagtttacccttggagtacgtacatggttcaattaatttgctctagctgataattgtgcttgatgcctgcagatgatgcggagaagaaacccaaaagtgtagttgatgttggctgtggcattggtggtagctcaagatacttggcgaacaaatacggagcgcaatgctacggcatcacgttgagtccggtgcaggctgaaagaggaaatgccctcgcggcagagcaagggttatcagacaaggtgcgtattactactgtttattctgttctaaaaaaaattctactgtttattcgtatcgggatttaatctcgctgtagctagtcatagttacatttgacaatatcagagggtttaagctctgattactcactgctggtgtgacgacaatctgtttaagcaggtctcctttcaagttggtgatgcattggagcagccttttcctgatgggcagtttgatcttgtctggtccatggagagtggcgagcacatgccagacaaacggcaggtaagatactcctcttttttatccttacagaaaaaaagaaaatgggaaaatgtaatccctccgtttcaggttataagactttctagcattgccacgttcatatagatgttaatgaatctaggcacacatatatgtttagattcattaacatatatatgaatatgggtaatactagaaagttttataatatgaaacggaagaaatatcttggatcggagaacgtttcaaatctagccatcaggttacggtggcatgggttaccatgcatcggttggaatcttggttgagcaatcgcatctgtcgattttaatttgccgggttgcgaaaatgtagaaaaacgagaggatattaatgaaacaattctgctatttattaaaatcagatgtcaatcaactcatcttgagaggagtctgtattggatgttactgaatagtttttggatcttttcactctctttttttagctaagagttcttacctgagtcttttacagtttgtaagcgagctggcacgcgtcgcagctcctggggcgagaataatcattgtgacctggtgccataggaacctcgagccatccgaagagtccctgaaacctgatgagctgaatctcctgaaaaggatatgcgatgcatattatctcccagactggtgctctccttctgattatgtcaaaattgccgagtcactgtctcttgaggtaaaaaaacttttcatgctctgaactcgtaagtgaatttaagttacaacttgatatggtttgcacatcaacttgcgtaccatgccgatttgcattctcgcaagagattcttgcatgtgtgtgacatgtgaaatgtgccaggatataaggacagctgattggtcagagaacgtcgccccattctggcctgcggttataaaatcagcattgacatggaaaggtttaacttctctgctaagaagtggtatgatcttgccatcttcctttcctccacttatgattatcggcaaacagatgttggacaaaactgaactaatttgtgttggcttcgtcttaatttgaagggtggaagacgataagaggtgcaatggtgatgcctctgatgatcgaaggatacaagaaagggctcatcaaattcaccatcatcacctgtcgcaagcccgaaacaacgcagtagtaccctagtagtgaaattacgctcctgctatcttctccatcacgaataatgcaaattctgacgagttagcacctactgatggcgatttgttgatttggggaacagccagtgcactgttaccacgtcattgattttgtactcgtcagacttaaaaaaaaaatatccatgaatgtgcactccaaatacgtcaagaaattcttagatcttcagaccaactcgtcagctagaggtggctaaaaagctcatttagctccctcggtgcaagattgctttgattgacctagttttcttcttaaaactaaaactattttactttggatggaagttagtttcactctgtctgggctcggctcattagctcgttaagaaaaacagtttcaaatgataaaataacataataaatcaatttcgaagaaaaatggagtagataaaaagcacagccgggctcaaccgagggcttatttagattgaaggattttcatgggaattttggaggactcaaatccttgataaaatttctacaagcccctttggaacataacaggatcgctataaatcctatgcctcccaatttcataggaaaataaacatgagctcaaactcatgtttttatttccctttgagaaatctaatgcactctctccctatctctctccctttgagaagtctaatgcactcgctccctatctctatagtttctctcctttgaaatttctgtgtttacttgctactaatcatccaaaggcaactactctatagtattcatgtattttaaatttctgtaggattttatagagcgtggcatcttatttctatgttttttttatcactgtgtttttaaaattttgcgctccaaaggcgcactagcagtgcagcagcgtcactatgtcagctcgacgccgaaccgccatccttctccgatggcgcggcgcgctcaccacgccacccgcgccgcacggtgaaccaaagctggcacggcacgggcaggcaccagcacagtcgggcaaccgacggtctgccgcgcgccgcgtggtgctccggtcacggagacgtcggcaatcggcgtccatcgatgttgccgtctcactctcgtcgtccttcaggatgacccacttgcccgctccataattcacaaaaatagccaagcaaaagaacggctccatctggtacgaaaatgacagggccctggttaagaaatcaacgacgttgcgaagaaagcttggtctctgacgagagaatggcaggaaacgataaggtagtcaggtagagctagaactgtcagtttcacacaggatcattcactttctctccagcagctcaacaaaggctcgccaaatcacatcaacaagaatgcttattgtataatcatccctcgtgttcaccaataaatctgctgcggcttattggtattgtatgactaagaacagggttcgtggctatagctgacatccgtaaatttgtaatccatcttggaattaacaaaaaggtagcacacaatttgagcccaatctctgcttaatttgtcggcaggacgtccaacttttatcagttcttcacggtggttacatgcctaagaagcatctggatcacttcaggggagacatttgcagcctgctccttcagttgcgcaattttcgtgtcagtttcttgctcaagccgttttacgtttgcaccagaatcaccgctactctggaaagaaacaggaaggttagcggcaatagctcttctaattccacgaactatacaagattgaaagatgcatacctccgcaaccttcctctggaactcagcttccatctgagctgatgaactactgt

SEQ ID NO: 59202 - DNA, 698 bp, Oryza sativa
atgcttgtcatatttataataagttcattttttatatataccgcaaaaaaaaaagaatcctatgctgtgcctgtttactgtttcaaagctttagttgaccatcatagtagaagattaaaccaactgatgcagtgttagaaagggacttgtatatacggagtactggcttgtttctctaaagcaaatgtgaaacataaaggcagctggaaaggaatgtgtcttgaaagcatttatgatctgatgtatttttttaaaaaaggtagcccatgatatccaatttggtcttattttcctgtagcccattcatgaatcgcctatgcggctatgctatgcatgatgccacgagtccacgatgctcattcagtctatgacagttttctccaattatgatattgccagtcgatctacgtctctgtatattaagtctgtgttagatgctgtgacaccggagattcattttttcttgttttgggtttagttgcagaacactataactattgattgatggtacaagtatccaatcgaagtttgtagtatattttcctgaccatttttttcctggtgcatgtgcagttctttggaaaatatagcgagaagatggttgagtttttacagagctcggttggcatcattcataagaaccatgctgagagtataacttctttcattaaggagagtgttgatgaggagctgagggc

SEQ ID NO: 59203 - DNA, 13417 bp, Oryza sativa
  unsure (1)..(13417): unsure at all n locations
gaactcagcttccatctgagcacggtactcagctatttctctctcagcctcctcttttgcctgacgaataggaaaggtattcagtttcaaacccaagtcagatctctagatgttgaataaaaaatgagtaggagtaacatgtttgtattgcgtgcttagaagcaaaagatagaacatggtttctgtaaacgatcatacaaggccatcgcattctacaaaagctgtcaaagggcacaattcagggtaacataccactttttttatacatttccattcaggtgttatttccaaaatatatgtgatatattcgatgtccaactatatgaacaaaataccatgataattacatgctaaaaagatatcaaaggaatcagacaggtactttaccttagttaaggtacagaagaatagtaacaagaaagcatgtttttcactcaattttcgaggaactaacagaaaacatgaggccatctctaattcccactgttgaacatgttttaaattccagaaagcatgttttcattctgctgaacatggaattttcccactgttgatttgcttaatgttggtacaatggaacttattcaacaaacaggatgattcaaaattaccctataaagacatcaacaaagaaatatacgagcaaaatcttgttgtaggtatatcgaagcaatcattgcacatatttcgtacaacataagcaattcccccccatcaatttccgcgttattcttaatgaatatttgtggaacaattaccgctcctagcagcattaacaatctgttgagcttcttgctctgcagccaataattgctgaattccaccttggcgtctgttagcatccatcttccttctgctacatggtgtgaggaactattttattattagacaaaataacacatagtgaaagccgagtggaatataacaagtcctaaatgaacagaacacaaatgaatgtgattgcataacatatgccagaattcgagcattcacaagatacattttaagaggtataaataaaaaatggaagatgttatcttctaataaaagccactgacttttagttacaataacaggtgctaatttggcaccggataacagttacaataacgaggataacaacaaaacaaaaggactttctctcccatacctaatatccctacttgtgctactttgcattcagaagcacaataaagaaaatagcagtagtgggcctcctattgtttttactgggagtaagagggttctttccaagctaccggcttgcctgtaattcagttatgcttgtttacccatgtacaggtttgctgaatgaagaggtcacggaattagttaaccatatcagaggattttaaaagtgtgcgtgcacaaaataacatctgctctctatcccaatctacgatcacagaatataatcatgcgatattatatttcttcttgcacaaaatcaaaccacagagtggaccaagagcttttatgatgatacgatcagccgaaaagagtcagaatactaaaactaaacaagcatacgtctatagcggcgagcagaaggcaataatcccccaagattcatccctgatccggcccacaacgatcccattgccagttttcaccacctccccacttctccacaatagtgtttgagatgcgcaagcaaatgtgagtggaaataatcaggaaaaaaaaacctactagagaggcaaagcctccagattcgcttcaatcaaccgaagattggatcgagcgagggacctggtatgcgcaggcgagaggggatcatacctgcgcgcacgacgattctcgaaggggtgttggggttgcaggttgcagccttgcaggagccaggagcggatctgtggctagcgatagaggagagaagtctgagaagccgtgaaggcacagattgacaacgaaatcgggttatgattggacacataaaattgggccgtaagcggcaaggcccaacatgttcaacccaaactgtaatggaaaaagtacaccgaaggtccctcaacttgtcatggaggtacaaaatcatccttgaaccacaaaaccggatacaacgcgtccctcaacctataaaaccagtgcaaatccctcggcggtttcgaacccggttttgtccgacgtggcagctgactcagcgtgggacccacatgggccccacgcgtcagcctcttcttccccacccctccatctctcttcctctctctctccttccctctccacaggcggcaatcggcaggctgggcgcggcaggccggcgcagcgggctcggcaggctggtgcgacgggccgcggccgacggttggcaggggaggggctgggcgtggcaggccggctggtggggaggaggtcggcgaagcgagacggcagaggaggaggcccacgggtggtaagagcggcaggtgtgctcgaacaggttctgtgccgtctgcgcgcggtcgttcccgcggcacatgacagagagaagggagttgagggcgactgcgttcagctccacgccgtactttcccatgacattgaaggcctcgacggcttntctgtggttgccgctggcgcattaggaggagaagatggaggcgaaggtggcgacggtgacgaggccgctgccctccttgttcatggtgcggacggaggacggcgtcccacatgggctactccatgccggccttgccgaggatgtcgacgaggaggttccaggcgtagccggtgtgattcaccgaccgccccgaccagacgaagaagcggacggcggacttgggacgggagtagcagacgcgggacctgagcacctgctccgcgacctccgcttccgcatcccccgactggacccggcgaggatctccaggaacgcctccgcgcgcggtgaatcctcctcgccgtccagccgccccttctccgtcgccgcgctcatcggcgacaagcgaagggattaggatttaggaacaatgaaattgcttttgggattgaactgcttccgattctctgaatctcccctcaaacagcattgactggaaggttgttggtgatgagtttccgcggtgtccgtttgtcggtgaggcggagagcgaggtgaggcggcgccgccctcaccgacgacatggagattgcgtttccggagagcgagacgagtgcgggcggtggccgacgagtggcgttgtcccgctgcagtgacaaggacaatggtggctagagagagagagatggatgcgatggatgtggtgacggcgacgacgacgacatgcggatggatgtggcgctccgtgggctggtgatgagccgagcacggtagcgtggtcggcatccggtgacgcccgagctcggtgacgccgccgccgccgccggtggcagctcctccctcgccagccgccacccgcgcccatcttctctctgccaattgcccgtggagagaggacagagagagaaagaggtgaagaggagaggggaagaagatgcagacatgtgggacccacgtgggtcccacgctgagtcaactgccacggcagataaaatcgaagtcaaaaccgtcgagagacttagtttgcactggtttttgtaagttgagggacacgttgtatctggttttgtggttaaggacgattttgtaactcgatgacaagttgagggaccttcggtgtactttttccaattgcaatttagcagggcaataggccctctggagtctggacgcaaacgtgcaaactgttgctagttccatttggatttacaaaacacggtttcattcttgcatgaaaatactacctccattttttaatagatgacgccgttgattttttcttacatgtttgaccattcgttttattcaaaaaatttacgtaattataatttattttgttatgagttgttttatcacttatagtattttaagtgtgatttatatcttatacatttgcataaattttttgaataagacgaatggtcaaacacgtgagaaaaaatcaacggcgtcatctattaaaaaacggagggagtatatatttttcttgaattctaaatgggccttaaagaaaactgtattttttttctctactggttgttagtgccacttgtaatcttgtcataggggtaggactaaatccatcaggattgaattatggcattcttttaaatactagtaatatgctcgtgctaaacgctacgattttattctatctgtcttaaataatttttagaatttcatgttagcaaaaaaatatttttacatgatctatgcatttgaactttaattcaattcatatcatacataaaatatattttatgtaaagtgcagtactatgatattgcgtgggcacaataaaactttacaagatgaggcccacatgtaagtcataggagaaaaactaaaaagcgtagggcccactcgtcagccctattctccctctctgtcttttcccccaaaaacagcagagcaagcggaggcggcggcgatggtgatggtgattgcagtggtgcgggctgtatgctgtggatggcgatggcgatggcgatggcgatggcggtggtgtgggctgtctacggtgcattatccatttaagttgtatggatgaaccatgataaaaaaaataatccagaacaattttgtaagcatatgtatcccttaatataatacagaccataattacaatctcaaatgacagcctggtgcaaactgacacatctagtgtgagatagtatgtagaagataatcacacgacattccatataaaaggtgatggtgtgctgtacaaaacaagaggacgatggtgagtaacattcgatgagcaatttactatattcaatatttttttgaattaatttagatcatgcgaacctacctttgctcactagtcaagaacgtctttatacacgatatttctagtgctcttccctgttgaatcaatttctttctttggctttgccaaaatccttgttgttagccttgacacaccccttgacaatgcgacatatagctgaccatgtgaaaacacgggctctagaagatagatcccaacatttgggatggtttgtccttgtgatttgttaatggtcattgcgaaactgagacgtattgggaattgcttcctcttgaatttgaaaggtagagatatatcgtcggagcaagacaaagggattcgtgggatgaacacccttttgctggcatgttgtccaccaacaatctcagcatcaattgcattatcttgaaaagctctaaccattagtctagtaccattacacaatccattatttggatcaaggttgcgaagaagaatcacgggataattgatttttactattagctcgtgtggtggcagaccatttggagtaatagagttaaggtagtccagaggataactgttgtgagggtcatcatcaacagagtcaaagctgtgataaaccttggcctgccctggaaatctgttaatcatattcgcattcagcttgtccacgtaatcatttttagtggatagaatagcacgtgtgctcatataagatgcagagcttgcattcttttcatcatcaagtgagtgaaacacatgattaatcaattcgtgtactgaatcctcgctattcccgtaagcaatcacaatttcatcaggtaagtgaacgtaatcatctctgatagtgttttcagtgccatttccaattctaaggagatatttcgaaaaccatggatcagattgagccctcatgttacgcgacaatctgatcttcctaatattttcccataaatatgatctctgcaatgttgcatcagttatctgggcccttatcccacgtgtaaccacgggaagtaactgtctgaaatcatcgccaaaaacaataacctttcctccaaatggcaatgaacaacccataatgtcttgaagagacctatcaagtgtctctacggcttgacgcttcgtcattgtagcttcatcccaaataattaaggacgccatgtgaagcaattccgcggtgccactttgcttcatgaagttgcacatgctattgtgagaaatcttaatagggattttgaatctcgagtgcgcggtacgtcctccaggcaaaatcgacgctgctgtacgagacgtcgcagttgcaatggctattaatccctcggaccacactctagcaagaagcgccttgtacagaaatgttttgccagtgccacctgggccgtcgataaaaaatacctggctcttcttattagttacatgatcaatgatctcattaaatcctgcacgctgctcatcattaagggatgtgtatatgtctaaatggtcttggtccactggcacgttaagttcgtctataatctcttgtcattacgtcgttgcaacattcacctgattagtgaaaacaaatatatgcatcatgaaactattggtgggtggtgcaaatgtaaactaataagaaaaagacgtgatagtataagaaaaaaaatacctatatcaatgacctcgggaagaccatactccgtgatatccttccccatggaatgaagcaaatcacgtatgtctcgtagcaccatctgctctactgctgcagggttagtgttccctcggctgtaatcttcagacattgcagccttgtgattgtcccatagtgcacggatatcagtgacttcgcaaaataccagtatggttgcaaataaccgacgcagagcagatggcatttggaaagtgaatgcctcgttcaaacaatcgtcatgtgacttatccgtctccacaagccctctcttctcgcatgcctctctaaaggtagagtacgttgtacctgacactgtcctcaaatcttcaaatgaggttgcacctcgcacgtggttgagaagcactctcaagtagtatctctccccctctgcagggtgagcgtacacaacccgtctaacttggcctctctttgttttccttttttgccacacattctgtccggttatccaacggtagtgttcagggaactccttttatagcagtttccttgcttccgggtctacttgattgattttgaaatactccgtaagagttgtcctggtagaagatggaagattaacaacatcctcaagattaccaccctcattatacgtgacatactgcatgttaggaatatgaagttggagctgcagaacagctggatagataccgaacagtggaaaaccaagcatcctatgtatagcctctggtggtgtcacgtatctagcatttctgtactgttgtatctcatttatttccccagatggatcaaccgagaaagatgcacagtcgtgtcctttatacacatacttatagaggtacttcacagatttgatgcttgcacaagcctcaacattgatgtgacaattataccgcataagcagtcctggattatatgggaccacccacctattgtctaacactgcacctctaatcttgacacgccatccatcatctcttctcctgtacaaagggtacgagtccttcccttgttgtgttgcttgattgaactatcgaggaaagttgaagcgatactctccatccaccatacaagcacaattcctattcagtgtgccacatggtccatgcagcatatgcttgatgacaagacgatgtagctcagggtatttggccttgtctggtatctccgtgcaaatcactttatcgtactcatctggggttgtcaatttactgcttgacttcatgatcaacaggatgtgttcatgtggtagtccccttttctgaaactcagtgacgtgcgcgtaagcctgaacctccccaaaatattttttcttcacaataagatccaacacatctcgcagcttagccctgaaaactcttgcgacaaggtctggtcgatcttgaggttgctggccgggttcaagatgttctgttatctcatcccagtatgggttgcacgtcattgtgatgaagtaatctggcctcccaaaacattggacaagagccatcgcattgagaaaccttcgttgcatgtcgcgatcacctcccggaaaagatcgaggtagcacaatcctcttaccaactgccgaaccgcttgtctctccagaagaaagcacgtcaaccacgccctgcaattattaaataacaccatgatcaaataactggtatgttgaatcacagatgggagacaatatcaatagttgtagaaatatgttataccatttacctggtatagctcagcccgaatctttttttggttctcaggttttgagtaccaatcgagtctcatatactcgattttgatgtacatgtcaacggctcattgttggaaaagtcatcctccgaacaaatgatgtttagaagtccccttttaacctgcagcctgaagcaatagtactccctcgctgtgacaaacttgtcctttttccctttgccagatttactactatcgtcattatcatcttcattgtctagatattgtcaacaacctcattctttgcgtccaaacttacatattaatatacataaacaatgcataaggacataaagtttagaaattattcgacaaaagccatgagtaaacgtacccggaagatcattaaaagtgctttcttcgttggtatgtacatcaccaaaagttgatgcttcacatgtttcatccatttccacatcacacggaatctggttgggatcgtcgtacggcatttttaggttccacccagtctccccattagggttaaataaaggatacgccaaaggatcataacaaccatggtatgctttgatataacaaggcttatcaccttttgcatgtaccaagacatgtctatcaaaagttttcatcggatcatccccctctaaccagatagtggcaacctgcgaggcggtgggtgcattatatcttcgttggtcaggtgttacattcgtgttgagctcaatcatgtagtcatctagattggacatggatccaactctactgaaggtctgcacatatgggttctgcaccaaaatacgtaaaatgacccgaacaaggttgatatcaaggtcaggagacctgcgaaccctatgggccagtgcattagcatcttctgtatcataaaagtagagctgcatatggcacggcccttgagaacctggaaccaaattatccaagcgatggtacaacgcaccgtgcacacgaaatgtatacacaccagttcctgctgcagtgctgactcgttggtcaagggtcactccaaggctcgtaaatgagaaatgggagttgaaataccgtatgtgctttctgaaatactttgcatcattatgcacttggctggtaaacaaccgtattaattcatcaggcaccgttggaatcttaacatttatctttccctccctacaacaaaacccaggagactcaaattgaaaccttatcgcctgacagtgtttgcaatctggcactttttttaaaacatggtgtgtctttggtagcttatggtacacacgatcgtgtgggtcatcagtactaatcccaatcacaccagtacatcaacacgatatgactcgtatccatcatcctccagaacttgactgacaccttcaaaatcattgtccacacattttgcgtcctcaacccccctatagatgatgcatgagacgatatattttaataatggacaagataaaataactgtttaggtgattttttgagaactcaacatcgacgacaccatctacaattgcaggctcgaataatgcactatcgaattcgacgtagttggtttgtggaatggcatgatgaacaattggtttctgtatagtttgactttgtgtaactccatctggttacaacgtatatgtttggattaatattgggtaacactataaatagagagcaatgcacatacttgtatctaatgttctcacctatgactaaaccggctcctgtctgaccaaggtttgaagcttttcttacattgaatcgaggtttgtagacatcatttctgtgtaaccaatcatttggatcatctggatcatgattctccttgccggccacctgcgcatcatttagaatggtggaacatactgttccataaagcgatccttcattaatggtggagaaagcaccttagatatcaaaacaatatcagaatattggattaaagacggagaaattagcggaaggcattaatcttaccaatagcaggggggcttgatgtagcactccagccgtcaacattgttcaacttagccttctttcgggcacgccattcacgctgatatttcgtcttctgttccctcctcttgtctatactcgacatctcattttcactctttttgtctatgctcaacattttagaatgattgaccttttgactttcagtcacttgcgagtggcaagaggtcggtgtatgaattgttttgtatgatgttacttcatctggaacattgtttgactctgccttcctctttgcgcttttctcgtgccattcacattgctttctgctcttctctctcttttctttagctaacaactgagcatgcgtcaaattctgcatgacagtggctgatgctcctccaccatcaacagaattagactgagccttcctctttgctcgccattcacgcagttttctattcttttcatctttcttctctttcactaacaattcagtctgtgtcaaattttgcattatagcatcatttgtcacaccttcttcaccaaattttgactcggccttctgtgcgctccttgcacgccattcacatagctttatgttcttttcttctttcttttgtttgtctaacatattggtttgtgacacttgattaggtgtggtaaacacaaaaggattgacacatgtctcatactcagccttcttttcatgttgatttgtgtgctttctagcaatttctctccttttatgttcattcgttgtaaaaggtgtgtttggagctgttgtagttttattgcaaaatggaaaaaaacaaaagatgtggttcatatatgtatacaaagagcagtcaaaaagtagaaaatattatacatgctacaacacctggagaaacattagttacatctctgaaggcaatacgccccccattggctgaagcatttggatccatacctagctgataaaatataaacaaacctgagattcatccaattcataattgtggtttcatactgtatatagaaatgttatacatcaattgaatgtatcactacaaataacaaagcataatataacctttatacttataacaatacaagcccaaccagatccatttcactgtcaactttaaagttgggactcggttgcaaataaaaagaagaagttatacagtatacaaatcagttatcaagtcaatgattagcggtagagcaataccgatacagtatgaaaaaaagtggctcacctgaacaggataatcaaaatgttaacaatcttatttgcaaaaggagttaatctgaataacttatattttatcatgaaaggtaaaaactgtgatatattaatgttgtaaacataaggactgatgggccatgggtgtagatatacagaaattctcatcgaggattcccaatttctagcacaatttacattgaatatattgagcataaatgatgtttttacaaaagatcgacggcagggatacttacgggaaagaggagacatattagggatggggtaggggtggggaaggggtcttgtacctttcagcagtggtagctcttgaggcggcagcggcgtcgcgttgtcggctgtggatggcggcaccctcggcctccactgcctctgcacggaagctcaaatcttaaagcttgggagcttttagagtcctagattcagatccatggaaggatttacaacttggttgcacgagtttcatcagttgttggcttgagaattaacacatattcagatggcacgtctttgtattgtgtgattagccaaatcccatactccataacctcaatggataagtttggcttacattgctgatcagataaagggaaaagaatagcatttgtagaactaaatcccaacagtttacacccgatcactaaaagtagagaaggaaattttagctatggatcgaatctgtcaatttatttcagtaatgtttctatttgaggttgcttaacagagtaagaaaatgatattcttttgtgaaagaatctatttaattctcatatgaaatccatcgcatacacacaccatgtcacatttaaaattattatatcataacacaaaatcaggaaagaatctgttagaggtaaaaactcaaccttatcgcgggcggcggcagcggtgaggtgcatgagatcgtgggcggtgacgattggatgccaagtccggagtatatgatatggaaccctataaaaacatgaaagggttcattagtagcttcatccaaccagttctatttgaatttaaaacaaacaagtgtactatgcactttgcaactcgcctatagtgttcattgatctaatatctgccaatattgctctaattttggaggtgtagaaactgttacctgcattaactttgaatgattcacaaaggagagcattttctcacatggctaaaaatgatgtataggaacaggttgacttgtatttaatccaaaaggggagaatcagtaaaaataaaccattcaggcaaatagacagaactgtctttttctttttctgaaagtgacagaaccaagttgggaaacacaattctactctgattcgagtcaagcttaatgaaagacctgatcatgcagtggtttgtcaagggttaaacaaccaaagctaaaaatcagcacacaaatttcctttaccaaaagtacatatgaacgtcaagcaccaggtagagctatcaatcatgtgcatggcaaaatttggatgtctgacgataataatatgcttgggaaaggatcagcatgcccaatcatacaaatggtccagcaagtcatataagttattttataagattacaagtttctatagattatatgatttattatcacgagtaaagcagcacaaattgttcttatggaatttataagctgacatgtcatcctattttttagtatttgtctgacagatagtttcaatacattagaatgcataccatcgactcttcactatccagtccacaaaattccaaaattctaaatattgttctttaaaaaaatgatgttgatcaaaaaaatgggggagggaagggagggatctggcagccagggacggcaaggtcggtggcgacggcggtggggagggagctggtggaggacggcgtgggcaacggggaggatcgatggcggcggtagtgggggagggatctggtggaagggcggtgaaagacgtgcgggcgcgcggaagggcgaagagacacggatcattatagtgctggctagtttaaccacatataagcgtgcaatgttaggaaataatgttcaatcagtatagtgtgggctagttgtagttaaataaaaaagtttacatatggaacgaatctgccatttttagt

SEQ ID NO: 59204 - DNA, 11978 bp, Oryza sativa
gcccaagcctttgaatacttcagcttgatctcatatcgctcttcaagtttctcttttgctgccttagctcccttgttagggtttttctttaaccaatccttcagtctatctgcaatccagtcttgagtggccatcttcccttccatgagcttggttgtgggacactcatgtgcaaatggtagcttctttatctgcacacacattttaaatagtgctataagtcacaactttcaagcaaaatggatacaaatgtgcaaattgacatagaaacctgaatagttttgccattagacaaccttgatgcatgaatgcgccatttacacccctcatgcttgcagtgggcaatgaatcttgttggatctgtttgcaaattagagagttcaaatcctgtaacaaccgcaaagtgcctaatagcttttctgaatgttatcatgtcaggaaaaacagcttcctccttaatcactggcatctcaaggttatgaagaacattaaactctgctgggtcatcatcagtgacctcaacctcaccatgaggttgagcagtcccagaaggtccaccaggttcagcattttcaacacatggtttagcattttcagcactaggttgaccagaggtttcagcatgatctgtaggtggaatggtgtgaataggttgaatataaattccctcatcatcaacacccacatacttctccatgtcaaacacattaggcaatgtttcatccgcttcttgagttgcaggttcacctgaaactgccactttagatgcagatgctccctgccctgtctgagtaagtcgaagaacacacaatggcattgatgttggctccatgttattagcactagcatcgcagagtacactctcaacaactaagaccattaattcagcatgcatttctgacttggtacatttcaaacatgtcaaccagttgagattcatggacaattctaacgtcctcattactgcccttgtcaaaaaccacactgttgcagtctgctgctcaccccatctaacctctgagcttaagcttagcatcaacaaatccaaagagaagctaccatactcaacatcccatttcagcacacaacccttagtatacctccgtctaccatccgaatctatggtggtaaaaccatgaacctttaactctatcgagaacaatagtgtactgacattggaatgaaatcaagtcaaccacacatggaatgcacagaaaaaaaacctacacattcagctcacggcacatcgaatcgaaggaatcgactaccttaccttgatttgggctccatcccttgcagtacgtttccaacccctccatggaaagaaagagtcgtcgccgctgacgccgtagacgccgtcgccgccgccgccgaatacgccgccgctgccgccgtagacgccgtcgccaccgccgtcgaagacgccaccgcagccgtcgtagcccgcgccgtcgccaccaccgccgccgccgtagacgttgtcgtcgccgcggccgccgtagatgacgtcgccgccgtcgtcgctgctcctgctagggttaggtctaagagaacgagaaaggggataaaatgtgtgctgctcctgctaacccgactccagtcagtatagccggtcaaacgggggcattttggtcattaagaacaaattttagtcacacgtggtcaacaatcgcggatcaggcgtagaacgtggcatgtttccagtatcgtgcgatttgtaatggcatctttacaatttgtcaaatagtaatggcatttttccaaaccttcaaattagtaatggcatgtgtctaattaaccctacaacttttggggattttggactatttgccatcctcttgagtggcatattcttcccaaataactttaatggtttgccatccagatccactgatttgtttttatgttaccacttttcaccatcaacttagcaaattgagtagaaaataaccttattgtccctcccatctctcattttccttcttccttcttgctctcaggcatcaatgatgtggcagagtagtcttgcgcgtcttctacggtggtggcattgctcattctgctgctcccctacaagaggctcaacagcacacacattacacaatttgagcctgacgccacacgccttgtggcgatgatcactctcgccggtggagtggcaccagcgcgcatggacagacagccagagaaaattttgaaacacagcggccattttttgctgaccggatgctcatccccgtccaccacaagtcgagccaaagaagcagagccgactatgaagcgacttgacaagctagatggttggtggtgcattaattgaacatgacgttaattgaagccggtgagcatgatcaccccaaggtagcacatgaacaggacgtcgacgaggctgctttcctacgctgacgtcggcgtcattgtccttttgatggctgtggcggctccattcctcagaggtaatgagcgacgaggtcgaatgccttggaatgagggaattggcaatgcatagaatgccacgagaaagctagtcagctgaacatgcgtgcgttgtgtatggaaggaagaagaaacaagaaggaaaatgatagatatgaggggcagtcaagtcattttctactcaatttgctgagttggtagtaaaaagtggtaaaatagagacaaatcagtggactcggatggtaaaacatcaaagttatttgggaagatggcatttgggaatacgtcattcaagaggatggcaaatagtccaaaatccccaacttttgctgctaaaagtgaaaataaataaatataaatttctgtttttacttatagctgtccaaatggaggattgagatactctgacgtaaaatcaaaggaaccgtgtggtggctgacgtgtggcccaccgctctcggacccacccgtcagtgacgacccaacacggcacgggcctgcaaatggcatgatgcatgcctgtgcctgtgctgtgtcgatgcgtgtgctaaactgctgaggaacaagttcacttttggtcccttaccttgtcgtcgagtcagaaattcgtctctaaaccacaaaacagattcagtgtatcccccaatatacataaaaccaatgcaaacgagattcctcgacagtattattcctagttttcacgttagctaacatgacacctacgtagcttctttaactaggtttttgtcttacatggcattgatgttgacgtttacgagttacgtgtcagtgtgattcaaaataaaaataaaaagagcaaaactgaaaactaaaatattaaaacaaaatatgtgggacccacatgttagtcaaacaagaaaataaaaaatagtgggacctacatgtgggtcccactttctccacctcaccctcgctacctattatagatggctaaatgggccgcccgccacggccgggcctgggccgaagtcagtcaggccgacacggcccgacttatacgccggggcatgccatgccagcccatgggctgcacacacaacccaggcccagtaagactcgggtcgtgttgagctagcccgaaggcacgacagcctatcgtgtttcttcatagaataagtctatttgttcttcctaaacctctgtgggctgtgtccatatggctggaaaataagtctattttgtattcctcttgtcttcggccttgccttatatggttaattaagtctattttacgttcttctactattttttttcgatcgtgccgtgagggctggatcggcccaccatgccgagggagcgacccaagcacagggtggctgtcacccaatcggactgtgccgtgtttgggccaggccaaattggtatgccttggaccgggtcgcgggccctaggccatatgaccatctatactacctatatctctcctctctccgcaaacgagcgcgtagagagggacgagttggggagttcagcgaactgggcggggagggaggctggcgagtggcgaaggaggcctcccacggtctcggctaccaaccacaaatccgcaccaaccatgcctctcctcgcccgcctccgactcctgcttctccatcaccgcggccgcctgctgctccacctcctccagggcccgccgccaccgcccgtgtgatccacgtccgcgtccacgcagcagcagcagcagcaagaggtcaacatctccgtccaactattttttaattaactacatgtataagtaaattttgagagaaaattctgtggcaataggaacaattttccatttcttataaatatataaattacattaccgaattacatatatatgcaaataaatagagacacgacacacatatatagagcgctctggaacacgtattatttctcctgaaaaccaacacgcttgtgcactgaagtctccaacacataaatcgatcgttctcacacactcacactcctcacatcacaacttttattaattctgcacgaacaagctgacctggaaattaattaatcacgcaagaaccgaacgataaaattaaccatgcatgcaatcaaacagaccatgtgtgggttgatggaatggatgaatttttcagtggtagacaggcggagagctgggagacggcgcagctccgccactgttcccctcggcgccgccatcaccgtttcctgcaccgccaccaccaccgttcgccggcaatggcgtcggcttggggtccggcttgggttcaggtccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgttgacgacagcggcacgatcttggacggctcctgcccggggcacggcgtgctgctcgccgcgctgtgcagctgcgcgaagcagtcggcggcgccgtggaggtcgtcagcggcgaggggcacgctgaaggcgccgtcgccgtcgaggtcgccgatggccttgctctcgtacacaccgtcgctgttcttgcacttgatcgccacctggagacctgaacatcaccaaaaaattaatcaacgacggtgatatatcgttcgatcgaactgaccacgcaattaattagcgacgaacatatatatcatgatatatatacccttgaaagcatcctgcgccttcatgttcttcctggtgcactcgccgcacttggcctggccgacgacgatcgccgccgcctcgccgtccgcagcggcggtgacagccatcacgagggcggcgaagagtagcgctcgtgctacatctgccattgctgaatcaatcctcaaactctgttgttatttggactatgtggcaagaggctagagagctgtgtgtggatgagtgaagaaaaagcaggccaggaatgtggtttatatagatcgataaaggctactagctgggagtgatctgaggtcagctaattactccatccatctacttttgatagttatattttcatcttggcacacagatcaaggataagtaattctacttatcatccattcaaacatgctactccctccattccaaattgatctacatatagtatttttgaggttatttctaaatgatctacatatttgtgttcattcattaggtttattcgttgcttgtacattggagtaaatggacattgatgcatgcatctatgcacacaagtatttataacccacatgcaatatcttgatttgctattggctaggaaatagtggggatggtgcctgcattgagtttgttgctagagtaaagatagtataagagagttattagtttttcttggtcttggtgtacctatgaaatatgtagatcaatttggaatggagggagtactagtcattcctcgtaaacaaacgatttattaatatttacatttctcgatgcctatgcagccaatcttatatggaagaatggtgagtcacacattaaatccgagaaagttattaagaggataagttattggattgaaatatgcctatcgaaaataaattttttagatttagaaatataactatcaaaagtagatggagggagtatattacattatgattagcaatttgcgccgattttgcaggtttaaaatcattaacgccgtacgtgcattttatttgattagatcagacaccgatagattaagagtagcaaatcatggaggcactgtgaacgtgcacactgcatgcagtgttaactgttgatgctcttgccaccgattggtggtgtttaacaagcaaagttaagctttaatcgactggtactcctacagctagcgcacagtactactagtctgttttataaaaatggagaatagttctataatttaggacagctccaaccaaattgcatgattgatactatttttaagtaaatgcgtaaatttcacaaaactacatatactttattcaaactattgcaaaactattgatttaaggtgttatatcataaaactacaaatttaatgttaagtttatcataaaactacaggtttagtgccaatttaatcacaaaaatgcaacttttatagctcaaacataatggtagtgctaaaaatttgacctccaaattttgtagtttcgtgataactccaatattaaatatatagttatgtcatacttgaccttaattctttaggtttctgataaatttgatgctaaattaatctgtagttttgtgatagttcgatcaacatatctgcgctattaacatatgtttggaacgcagtcatgagtgtataagtgtggtgtctgtatttagtggtgactacatgcatgttgtccgtaaaatggtagagaatatacttgttgatagtatatatccgataacagtgtttgttttaaagtatagaagacgttggtatcaaagtatacgcgagattttggtaaagtagacgagagacaaggatttttatattgattcaggccccggtgtgggtactagccataatccaatttatatgaacatctctaggatgtatcaaactgattacaataggagagcgagctagctaatatagcttaccaactagcattcaccgagaataaatccgacgacttagaatcattggctagctattgacttcctcttgattgatattcgatgtgacttgtggctatggcttatgattcgatgctcttctctcctaggggctatatatttatgcggacaatcaatttcttgttaagttgaattcgaggagttaatatgggatacgagcaggtaagagtcttgtcggatcctgtagtcaatggcacacgagcataacccaagagtcttagcgatgagattgccaaatctttcaaaaacgctttcggcatagatacttagggttaaaaagcatatatatcaaaaactctattctgaccactatgataatgttccatatcatcaagggtttagattgcctcaatgtgtaagttcattggagaagatggccagtctactatagaggatattgaccaatttattattcaatgcgaagaagctagtgctagtattttgaaacttagccttttcgcattgtctttatttggtgatgcatttacttggtttatttcacttgcaccactctattcatgattggtctaagttagaataaaaatttcgtgattacttctttagtggtgagaccgaattaaatttgtcatacttaacattggttaaacaaaagtataatgagcctgcttttgaatacattagaagatttagatatacaagaaacagatgttatagtttaacactttctgataaggacttagtagatttggcttattctggtttacttgaatatctatactaaaagtccatgaaacttcctacaaatactcctaagacgccacgtgtcactcatacaaacactcctagacaactacatggcattatctaatctcacagtcgattttcagttaaattggtggacctggtattttggaccattagattagatctactatttaataaaaataccttcctatgctgtgggccaaaaaaaaaaagaacgtacatagatacatataactttgtataactgtggtatacacttaataaacaatgaagtatcacatggaaaaaagaaactcgtgtacgaacttaattacgataaaagcggtaaaatagaaaaaaatacgtacatggtgccattgaaagaaaacgatggtattaaaaataggattttatattatactatttaaaatatcactctatatttttgcgcaaacatacacaattaaaatatattttctacaaaataaatacaaaatattctttcaacactctttaaacgttctatctttaaaatttaaaaattatataccaaaagttcatcgagctacaattgctaacaaggtatttgtgcatcatatcgaatatctaagatatgatgaacatgtgtaccattagacgcataatacagataaaggacattttataagggacatttgctcatttaacccctttgtaaagcttaactatcaatttgatccttttttaaaaaaagtttgctcatttgtccatgtttttcaaaatcgaagttgtcgtctgaccctactttcactacatcgtgagtttttcatttagaaaaaaaagaaaaacatgtatttacaagcccaaatgactaaaatgacactgaatacatcaaccttatcctcaaccactcatttgctcattctttatcccgctctctctcctctctctgtccaaagcgcgatgggcaggaggagcggtggcggccacatggcaacagctgtggagggccctcggctgcttcgcggagggtaggagcgatggcaaagaggcaacattgagtcgccgacaaggaggaccgctggcggtggtggaagaggcggtgacaactcggcagaggggaagcagcagctccatgaagggtaggagggtggcgtcggctcagcgacgaggaggattgccggcggtggcgaatggaggcggcggctgcggaggggtggcggcaaccacggatatggtaggaggagaggaggaagagggatggtgtcggctcgatgacgaggaggataggcggtgatggtggaggggcggcggcacggtgacaaggaggaccactggcgcccacgcacatcttcgccattagcttgctacttgcattttcttccgcacaaaattgggcctaactttggaaaaataaggtcaaataagtatgggtggaagtggtatttggggcttttgttaacaccgattaatgctcttaagagaagagggtcagagtgtagcttcggttttgaaaagaagggtcaaatgagcaaagtgaccaaaacagggtcaaatcggtagttagacattcaaatagggtcaaatgtgcaattgctccattttataatatagattatatcattttgtttcattttataaacatacatagccaaagacacgtgtgatttactttaatctatctaaaaaaatgtctacggtaataagaatcatagaaatttaaaagacagaaaaactcaagagcatatatcctaataataccctaaaagtaaataaaaattatcaatggctaatccctatgatatataaaattataaagtattatttcatcggtttattaaacgccctaaagaaccctcctagagcatctattaaagcctttaacaaataagaggaaactttaaatttcttctgtaacagataaagcatctaaaacttaatcctcgttaatttaatgctcccattaattttagccattgggttatttcaatgggtatgtgtatacatacattatttaataaaaaaacattcatccaaacatgttgtctaacataaaattatttgagatgtcaggtgaggttgtattgcatggtttagagggttgttgtcaggatgactagcgttgagttttactaggttgccagccatccaatgcatcacaaaaagagcccataggaggtattgtgttttgttgatcgagcgaccatcaagagaaggcaacaagggaaccccagtacaaatattttttatgagtaaatcttctcttaactcaagtatctatgtaatattatttaagtcgcattagcttgaagcatgcataatttgataacatgatatatctagaaggctacatgttagaacattcaattaacccatcttagaaataataatacttagcaagaactcaagcaggtaacaaatttctatctttaattttgttattaaattttaatcgttggaaagggggagatagagtgaatggttcaaacagttaagtgaatattgtccaatttgcaagctaaatgtttttttttttaaaaaaagagatatagcgggttactgattttgaagtattatcatactattcaagagcagagcaagtagtattcgtatccaaaatacatacaaagagccaccatacataattttaatattcggaaagatagaaatgcccgcgcaacgtgcgggctaccttcctagtttaaaagaaaagctagatggtcatactttcttagatgtaagccaattacttcaaaaggctttggctcaagaaagccgagttagagaggccaaaatctcacagaaagttaaagtttgattatccccatgttaatatagttgatcaacaagaatctttgaatgatgagacagttgatatatacacagacgaatgggcttggaactccaactctaaaccattcgtttgctcagctcttaagctggttagtcataagaatcgacaagaggaaataaagctcacgtttgatgtggccaaatgcaataggatttttgactacttattactacctttgtcccagagtataagaacataggactagatggatatttcttagtacaatgtatcttgatacgaagtttgtccaaatacgttgtactaggaaacatcccatctagtcttaggtttttatattttgggatagagggagttgaaaagaagaaaattaaattgtaacaagaccacgtcataccttcacttcaagagtaaagtggtgagcatattataagtggcacaactcctattcttatgccacaaatgattgcaatatattccatcgacaaattcaatcggcaaatgacgaatgccgattgacttttacaaagatgcaggtggatgagctaccttttcctatacacaccgttgaattgcaagagaaggagattcccgatggcaaggagaagaccacattgaagacttcaatacttagggggcaagatgacaatatggagataccaaaatatggcaagcgaccaaggataacaagttcatctaccaagcgagtacggaccaccaacaacttacttctccttcttcatggtattacgcttggtatgcatcatggagtttgaatggtacgtggatgatgcctatttatataccatattattatccattgtgggcattgctggttgccacaaagacccattttaaataatcaaccacactcatctcatagccagttgagggaaaagaatcagtcacaaaagaatccacacaagaaagtggtgaggcaagagtggaggccaaagaaaaacaaaatacaatctgaacaagagggggcctctcgtatctttcttacatcaccattaaacatttaagccttagaggcattcatggccggtattggtggatatcacccttagatgatctcatgcgtagtatttttcggagcacaagtttgccaaaaagattggggggggggggcggggatatgttgataaccaaatttggtagtagggtcgagttatagcaagtttgagccaaattaaaaaaaataacagagctttcccgcgaagactggtctgaccgtcattatgtgaccggtcagaccagataatgcactatgatcagaccataggcatccaggcggttagaccttaaccacagagtccgagtccaattttggtatttctcgtgttttcttgttttagaccaaaaatttcaagtcctagttgatttctatgc

SEQ ID NO: 59205 - DNA, 650 bp, Oryza sativa
ggcggtgacgccggcgagagggaaaaaggaggaaaaagggggagagaaaggggggctcgcccctttcttctttgggaaaaggaggagggagcggaggcatcgcggcagagggaggagggaggctttgcctccgtcccttggaggctagcgcgggagtggcggggccgaggcgatgacgacggcgatgacggcgggcggtgtggagcggagcggcaacacgagcgacaggcgcggcaggcactgacgacggcggtgaccaggcggtcggccaccacggcacgcgcgcgcgggaagcaacgggcggcgcggcggtttgagcggcgcggctcgggcacgcgcgctggctaacggagccgggcgactgcgcggcagggcagcggggccaggcggcacagacagcgcaggcgcggcaagggcggcgaccgcgcgggcacgtgcacgcgaacacggcgcgcgggaagcggcagcgagggagcggagagggaggactcggctcggcgcgggcggctcacgcgcacgcgcgcgggcagagcggagggaggggcgctgggcgcggctcacgcgcacgcgcgcgcggcgcgcgggcggagcggaggggggagggggggagagagagagagagagaggacgccgggagggagggggagatg

SEQ ID NO: 59206 - DNA, 14281 bp, Oryza sativa
cactgacaggtggggcccacctgtcaggcccattcccaacctccggccggcgccgcccgcgcccgcaaccgccgccgcccgcctctcccacgcgtgcccacgcacgtcgcccactccccgcactcgccccgcactcccctgcaaccgccgccccactttccagcccgcacccacgtccaagatggctgggattcgaaaacgaatcccacctctctctccctctctccacacctcccccacttcgccggccactccccgcctctctcggccacgtccgacctccccagccctatataaagcaccaccgcttcctcctccacctttttccctctttcgccatccgctcccgagctctccttcgccttagcaccatgcaccacccgccatcatgcgcccatggcaattaatgaccggttcgcgggaaaccctggaaaaattcctcgtacttaccacaagccagcatgggcaacggctgggcttgtagtgtagcttccctctagctgacgcatccaggcaagggtgggcgtgatggagttcggatgggccctacgacggcctatgcggctttcggattcacctaggcacgagaggggactgcccgctgccttgcgaggagtgggggtgaaacctgaggtgtggtgtgcttggttagagggggttatgcgaagagtcctgtcacggcctccttctagtacgtcgtggtggcatgtcaacgcatgggaacgtgtcgtggggctgtgtcttatgggtacaattgtacatctctgattatagtaaaactattcgaatagccgtgtccacggttaagtttaatggaactgattagttcaggtggtggtttgggcatatctcaacgtggtgtagcgttgagcagtggttggtttaatattggctaattattacaactgttttactgctttcaattactgtttataaatgctagctttatacaaatgaactcttttagctgtcctttggttataccttgcatcataccctccattccggtaggacttgctgagtacagtgggtagttcttgctctatctcccaaccctcagagttcaagtatgcgtccgatggtggtttctccgaggagtagacttcgtccgtgccgtcgaggatgcctgtggagtggtgttcccgctgcaaaccaagtcaaggcttagctccagttatcttttattttccgctgcatttatgtaagacttttataatgtttgtaaaacgtggatctgtatatcaactttgtcgtttgtgtaccctggccggtcctgaacagggttttaatgtacattctgcttgaaattctattcgggaatttctgggcgtgacacgccgcctccatgcatcttcatgtgtgatttcctttgccttccacggagggagggcggcccgaggggtgcagactcggcggcggtgtgttaaccttcggctgcttgcctttgatgagatggcgacaggaagaggctgacggcaaaggccgccgtggagcaccggtggttggttcacggggaggcgcctcgccgacttcagattcacaattttttcacattcttttgaaaaaaatcaaaaccaactttaaatgtcaaacgagacgatgtaaatgtttgttggtcgacttaagtttatttattcagattgattgccttaaaaaaattataccaaatttgtttgtaccaaaaattatacctattgccttacatatcggcaagcacgctacaatactcttcatggacagaggagcaatgatgaaaaaaaatttactaatatacttattttttcaataatttacgtttatatatctgcattgtaaggatttgtaaaaatatacccatcctgcgacggtcccacagctctaaaacacgaaaacgacggtcccacagatccaaaacgcgggaccacgacggtcacgcgtgaccaaaacgcggcagcgccataacagccatttttatcaatgtgttgacactgttcacaaactagttggcactgtttgcatgccggttccgcacaataatgggtctgcgggactgcctaatgaacagtgctaaacagtgtttaaaacagtactaaacagtccgatcggataataaattcgctctagccgcggtgccgcgttttggtcgcgtgggaccgtcagcggtcccgcgttttggatctgcgggaccgtcccgcgggaccgcgcgttttggagctacggaaccgtggcaggagggtatatttttttcaattcctttctatgcatgtatataatggtaaattattgaaaaaataagtatatttgtaatttttttccgagcaatgatggggtaaaaaggagcctcatcattcgtcctatggcttatcaaaacttgattttaaagttggttttgaagttttgtttttcaatgtagttttattttttagctttggtttttaagtcacactaaggacacatgtagtaatttttacttgcaaatcattttttatccctaaaaataagccgttactggcttactgcttatataatcagcaaccaatgagcccaaaatcacaagaagaaaaactggcaggtaggtccaattgtatgcagataattcttccatcccatcggtttaccactacagacgctgccgcgaccgcgagatacaaaacttgaacacgactgttttcaattcacaagcaccacatgcgtaacacataagtataactgaaagaagacgacggtacatgtcttaggctattgcaggtgttatgctggaacagcgtctaagcttttatcttgtttcataattagttaaacaaatccatcacattgcgtgatggctggattggcggcaccaagggaacggaaatgaagatattgtatatggtaagacttgtttgcgactctagggcagcagagattatcttacagaacatatcccagacgaccgtcagggagcaccattggtaccatcctcattccagctggtgctggtcctctaccatatatcataggctgtaacaaaaatgtccatagaaacaactacaatgtcaacatgcagtagcagatgcagacgaagcaattgcaaacgaagaattatttgtgaatataatttttacatgtgtgttcttagcaaatctaaaaacaaaggctgaaaaataaacttcaatgagaaaatttcaaaatcaactccaaatttaaggttgaaaattcaaattttagctgataagcatcagcgaaaagatgaggcttcaggattcctagcatgggtattcggagttaattaaatcatgtttcatagaatttatataaagatgctagaaattaattaaataaaacaataatttagccccgcggatgaaaacagctcaaatgcatatatatctcacaaatttactagatatctgataactaaatgcaaagttcatgcaaaaaatcatgatccatgtttgaaaaaacattaacagagtatcaatttgactaatcttcaagagactcactcaaggcatttttctcttcagaatatgatgctttattatcattagacaaacactaagaacttcctcatctacatacaaatcaagggagtatgtgaagagaacggtgtatgggattgcttttgatacaccatcaaaggtcaatgttggtgttcttacaacacgccaatttcatatattttttttcgcttccttaaactgccttcaatgcacttgaccacaatctctcttattccctgccttagcaggcggtaaaacgacttttgtgacctctccatgaatttcaaagatctccttaatcttctctttagaagcattgtctggtaagttcttcacatatatagttttcacctgtaaaagaaaaggccattcagacaaatgttcctagggaacaacaaaacaaattaaaatgatatgaaatttcaaagctaattatctctatgaatataaaaaaaaatcaacaagcgaagggtgccttgtacgaataggacaatccatccataacagaaacaaccttgcacaggttgagccagtggacagtggtattgaatcagtagactaacttccacacaacaaagtgtagtctgttatacattccctaacgtgccatgtagaaactaaaatcatgatgcagctgcatcctggaaatacatcaataaaatgatggttattttggttcaacaatggtaatcagtagttctggataataaaaactttaatgtgaatgagacatgattaataaaaaatacaaaatatttcatgtttctttgatcatttgccagttccattagcaaattatggcacgaaagaaatactctctctgtcccataatataagagattttaggtggatgtgacacatcctaatataatgaatctgaactactaggatgtgtcacatcaatccaaaatctcttatattatgggatagagggagtaaattcaatgcctcttttacaagtgaatcatccccaacaataaattagtagtatcccccaataaataaattagcagtataaaggccactttaagagtttagattgataaatttgtcgcaatcttttgtttaccatcttgttgattaacgattgccttaaaatttctctactacgcagtcgttctctaaatggcccacaactaaacccttataatccctttaaatgggacataacgatagtgcttatcttatatcctcggctatgtttaaataatagaaaatgaggagcgtgattgagattaaatgaaggacaatgatgaaataagttggagaaaatggatgggtagtattcaaagtaaccccttcataggtaaaaaatcatttccctttcccattatccaaacggtccatcgaatctctgttacagacgaggagattggaagaaggattgcgacggaggaagtatttataggctgtaacaggacatggtcctggacctcgtcggcgcggaggagcggtgttcggcaccgcaccggcgaggcaggaactgatactagattaatctgaactttgattgattacttccaacgaaagcagcttacaatttataagggagctaagggatagaatcctaacaactcgagagataaagatgactaacaaactcctaaactgaacagagactaaaccgattactgttcctcattacggctgtgtcggcggaactctgcgacggcgccgtgcataatgcaatccccacatgacatctctcccccctggagaagcagctcgtccgcgagctgaaaatctggatactgagcatgaaaatcatccaatccgacccaggacgcctcagccgccggcctgtctttccactgaacaagaacctctcgaaccccacgtgccaaacgactttgcgacacagaagcaggttgaagacaaacatcaccatgatgcgtcggaggcaggggcggcgcatggtccggcggatcgccacggaaaggcatcaataatccaacatgaaaaacatcatgtaagcgagcacctggaggcagccgcaggcgataggccactgatccgatgcgctgcgtaatctgatatggcccataaaactttggtcccaacatgccgcgattcttgacagctagagatgcaattggtcagtgaagcaaacgaagcgcctactgccaactccagcgctcggtgcttgccatcatatgctgtcttgtaggtttgttgagcttgttccaaacgatcacggatggcgcgcagaaaatcatcccgttcttggagcgcctgttgtaccgccggcaaccttgtggagcccggctcgtaagctcgaagcgtcggcggctcgcgctcgtcgacaacacgaaacagagacgtccggagtgacgattggtacgacgtgttgtagcagtactctgcccatggcagccatcgaagccactgtcgaggacgatcgccagtgagacaatgtaggtacatggcaatgatcttatttgtcacctcggactggccgtcggattggggatgaaaagctgaggagagattcagctgaaccccagcgagccggaagatctctcgccaaaatgtgctggtgaagacagagtcgcgatcgctgacgatggtcagcggcacaccgtgcaggcgaacaatctccgcaaagaaggcggccgcaaccgaccgtcgccgtgtacgggtgggccaacggaatgaagtgagcaaacttggagaagcgatccaccaccgtcagaatgaccgtcttgccgcgaactcgtggaagcccctcaacgaagtccattgcaatgtcagcccagaccgctgacggtaccggcaatgattgcaggaggccggctggctgaagatgctctatcttgttccgttggcacgtgaggcacgcgcgcacatgctcttgcaccgtcgccctatcccgcgcgatatgaaagtccgcgcgaaggcgagagagagtcttctacgtgccctcatgtcccctgccgtgcgcgagcttgaggatggccggcagtgacggcgacgacagcggcacgaagacacgccccttgaacgtgatgaggccatcggtgaacgcccaggtcatcggtttgacccccttggcgatgtcgtcgcggatggcaactagggcaggtgtggcggccacctcacgacgcagctcgtcgaacagagaaaattggggtgccgataatgcaaacgccgccgccaagtgtttgtggacccccatttttataacagaaatcaatcgtgtaaaccgtacaatttccctggatcaagtagtctggtacacacgaatttatagctgaaataccaaatgctcatacacgagagtctagtacgaattattacaacataagcccgcaggcattatcttaaatcatcggaccgagcggtccggaatacaaccaaaagcagagtttagataaggcagcggaatttaggcagcggcatgccattgcacaggcaacgaccgtactaagacctattgggcaccatcgtcttcttctccctcctggtagtaggcataggggttctccgaagcttcatctcccgcttctgattaattttatatttgcaagggtgagtaccaaccgtactcaacaagccgccacatcaacaatacatatgataggggtatttcaaaggatggctttggttcttttgtgcaaagcaagttttataattcttttcacaaacttaagacctagcattgactgatcaaattttagtaccagtgtttgtatttaaacaacgacggttctgtccaccatccattgtgatcccaaggatagcttcccgccattgagtcgttatggttttctgaggacgtccactttcccctatctcaagaagtgactccaacagcatagaaatttcatcatgcaataacatatcccacacaagttaagaattcagagactagccaagtgtaatacatgtcccggtgctcaataaccgcgagcacggctattcgaatagttttggtttactcacactgcagtggatgtacactttacccacactccatgactgcccaacacatgagccttgtctcaacacatgagacgcgtcacggcaaagcctttcgataacctcgcattggcagtacccgctccatgaacttttcatcctcatgcactctaggcgtacacggtttctagcaatgagaggagttctggcgcacccgggaagggaagttttacacccatgtaattaagttataactaggctcaactcaacacacgacagtcctagcaatggcgacaccattgtagagcccctgccatacacatgagaaaccactatgcatggatactgcctccgctcggctatttactccgctaggtctaaccccattcgagaaatgtggttgtacgaggtcgtttcatgcttaacttcatggctcggtccttaattgaccggggacggtactagcctttcccggataccacccaaatccaccatccgccccggtctaaaacataggtttttaattcctttcttgtcaccattatcatggcaatgtggtgctcatgcctccacatgccgcatctcaattaccttcccaaaggtaattgcccaagcatatagcatttgataaatatgaatatgcaagattctagaatagcattctctaagcaagtgtcataattgactagggactcatacgtaattatggttacaaggaattgaagataaacaataacaaggcatggcataatcacaagtgggatgttcatcattgcatgcaatcttatttgtaaacaaaattaatttcacaattgggatcaacgtgatcaaggaatagtgatgacttgccttgctcgagatcttgtaggtcttgaccttcgcctggatccgcggctccctcgggctctatagttacgtgcgaaaattgatttgaattcggttagaattcaaataaaaacccaaataaatccaaatgaaagtcgaaagcgaaagtcaattcctttatattaattttactattcgcgaactaaagcaaacccaatttcgaattaaactattttgcgggtataaatatttgttgtcataagtttttaatttaatctacccgagcattacatccatataataggttagaaatttctatcgcgagctaaaaaacggacgaaatcctagaaatattataagacctaatttagtctatgactaaatgactaaatatgatacacggctaaaatccctagtttctaccgttaatcgattacttatagggattacccaaaaataatctataataatttatgataattcctatatttatttaattacatctaaattattaccgcgaattgatctcctatagatattactaaaaatgatctatagcaatctataaggattcatctaattgtttaattcgtaaataattagttctataatcaaattctagtactttaggtatttaaatagtaggagttcacctaacgatattttcattaatcctataatcaaattctagttattttaaattttctacacttccctaatctccctctaatttcctatttatttcctttttatttttcttttcttccctttctttttttcttttctttttctctctctcctctttttccctctttctcttttctctctctctttctttcctctcggtttctctccttctttctttcttctctccctcggcttctccctacatctctctctctcggctctctctctctacccggcggcacggcaacaaacagggggggcagcggctcaccgacggcggcggtgacgacggcgcacggcgcggcgcacttgggcggcggcgcggaggcactaaagcggcggcacgacagcacgaggacggcggcgcggcggcacgacggcggcggtgcgtggagaaggggagagggaggggaaagatggggaatgggtgtggggaggcttggggatggagggaaggggtttttatagggcgtggagaggaagaaagagaggggaagggggaagagaatgaaacgacggcggcgcggggcgcgacgcggcgggcgcgcggcgcgaggcgacgagacggcgcgcggctaggggtagaggaggggctgggctagggccacgtcgaacacctggcggccgatgaatagtgctctttttctattaaactgattttagtgtatttcccatataaatttgattccaaaattcctaatttttgcatatatgcatttactcaacatgtgtgttattccaaccaatggattcaccctagattaatattactcatatattatttatataatttatttgaagtcttaattagggttaattatcgtatttaaattcaattgatccaaatatggtcgcgacaatattttatttacttctatccccacctaatccttttttttaatttatattcattttaccaatttatttttagggttgatttctaattaactatcctttactcacgattaataaacttcgaaatcaaaatcaaataaaatgatcgaacaaaatcagcatgatgcaatttattaaaaagtttttgaaggcccatatttctagagtttagatttttgtcggtcgaattttcagggtgttacagtgttcgtcccgtcgtgaaagcacgtccgccaccacatttgtggagcccggcttgtattccacgacaaagtcaaaaccgaggagcttactagcccactggtgctgagggacggtggagaggcgctggtctaagaggaagcggcgcccccaataagtatggccgccaatgacgcaccgcctggacgaggccgatcaattcgcgttcgtaggcggcgagcttggcgtggcgcggcgcgatcgtcttgctgaagaatgcgaccggcccggcgccttgatgaagcacagcgcccggacctgagctcgatgcgtcgcactccacaatgaactccttgttgaaatccgggagctggaggactggagctgccgtgagtgcgtgttgtagttgtcgaaacgccgatgccactgtctcggaccagtggaagccttccttccgcagtagcgtcgtgaggggcgcggcgatggtgccgagtcgcggatgaaacggcggtagtagcccgccaagccgaggaagccccgaactgcgcacgcatttttgggcagcggccagtccaggacggcctggatcttgctccggtccatggcaacgccggcgcttgagataacgtgtcccaagtacgagatggaggagaggccaaactcacacttggatcgcttgaggcggagttggtgatcctgcagtgtctgcaacacggtgcgcacgtggcgaaggtgttccgaccatgacgaactgtaaattaatatatcgtcaaagaaaaccaacacgaaccggcggaggaacggaaagaggacgtcgttcatgaaagcctggaatgtggccgacgcattcgtcaagccgaacggcatgaccaagaactcaaataggccttggtgcgttcggaacgccgtcttgtgcacgtcctccgggtgcatccgcacttggtggtagccggaacgcatgtcaagcttggtgaagaacttggcgcctcgcagctcgtcgaacagctcctcagccaccggaatcgagaacttgtctttgacggtcttgtcgttgagggcgcggtagtcgatgcagaacctccacgtgccattccttttcttgatcagtagggccggggaggagaacgccgacgaactcgggcggatcacgccttgctgtagcatcgtgtcgcactggcgctccaactcatctttctggatgtgggcgtagcggtacgggcgcaccgcgacggctgagacgccgtgttccaggcggatgcgatggcagagatggcgctcagaaggtaggccttgtggttcggtgaagaggtcctgaaagctgtcgagcagctcggacatgagttcgcccgtcgcgccgtcgatggtggccgcctagagaggtggtgcaggtgcgtctatgctggtccagatgacgcgattgttgggtgagccgaaggcaagggactgcttggcgaagtcccagagcgtcggtccgagagagccaagccattgggcacccaagacgacgtcgtagccgccgagaggaagcgcgtagaaatcgatgacgaaagtgtggtcgccgatggtgacacgctgggacggaaaacagcctggcgaggtgatgcgatcgccgtttgcaactgcgacgctgaggccgtggcgcggttccaggggaacacgggcgcggcgggcggcaacgtcgctgataaaattatgtgtggagccggagtcgaggagggcgacgaggtccgttgcgccgatgcgggcctgcaccttgatcgtgttgaatgtgggcgtgcggacgccggccagagcatgcagcgagatgctaggctcatctagcgtgagcgcatgcgccgtcggtgttctcctcagcttcctctgggaagctgatgacctcgacgacgaaggatttcttgcaacgatgtcccgccacgtacttctcgtcgcagttgtagcagaggccctcggaacggcgttgggccatctccgccggcgacaagcgcttgcgagggagagccgacaccaggggctgtttgctggtcgatgccgatgacgcggcgtccggcgccgtagacgcggcagatgcggcggacacgggcgccggcagggcagggagcgaaggccgtggtgtgcggccagagcgagccggcacggggtccgttgtgccgagttgaacccgctgctcatacgcccgggcgagcatgatcgtgtcgtccagtgaactcggccggcagagagctacatctgtcttgaggggattgacgaggcctgccgtgaacaattgcacctgctggttctcggatagtttggcgtcgcggcaagccaaggcgaggaagctattgatgtagtcgtccactgtgccggtgcgccaaagtgtcgtgagttcgccgagcgggctgtccgtcatgggtggcccaaagcgagtgtgcaccaacttgacgaagcgctgccacgatggttcgccggaattgggttacaatctgtagtaccataactgagcatcaccgagaagatgcaaagatgcataccagacgcgacgtgactccggtgtcttctggccacggaagaacgtctcacagcgattcagccagggaagcggatcgcctttgccgtcgtaagttggaaactccaacttggcacgaggaagaaaactgttgtcgacggtggagtcgtcgcccgactgcttgtcattgtcgccggtgggtggcggagcgccgcgcggcgcgtgcgtagcggaccccgacgtctctggcacgggcgacgagcgatggctggcctcgacgcgctggacggccagattgagggcgcggacttgctcggagtactcgaacgcggacgcctggacttgtgtgacgcggtcaggcaaactgctgagcttgggcgccaggggaaccaaaggttcgaggacgctcatcttcctggccaagtctgagatttgggccgccatggatgtcaggttcttggcgatttcgtcgagctgtgcttgagtggaagccatgggaacggaaccagagaaatctgataccaagttgtcacggacgaggagattggaaggaggattgcgacggaggaagtatttaaaggctgtaacagaacgtggtcctggacctcgtcggcgcggaggagccgtgttcggcaccgcaccggcaaggcaggaactgatactagattaatctgaactttgattgattacttccaacgaaagcagcttacaatttataagggagctaagggatagaatcctaacaactcaagagataaagatgactaacaaactcctaaactgaacagactaaaccgattactattcctcgtcacggttgtgtcggcggaactctgcgacggcgccgtgcacaatgcaatccccacatgacaatctcggcaagcagccaagcacacccaggagcataatgctctacctggagtcctggacagaccagcaatgatgaggttacaaaatcacgcacccaccgaaaaaactggcacaagattaacatattggggaaaaaaatgtaaagaggtagacaggtccaactgtatgtctgcagataattttccaattccatcggtttaccactacagacgccaccgcgagatacaaagcttcaagacactgttttcaagtcacaagcaccacatgcatgacagataaatataactgaaaaaagaagacggtacatgtcttgcgcaattgcaggtgttatgctggaacagggttacaagcttctatcttgtttctttaggttaagaaatccatcacattgcgtgatggctggatggcggcaggaccaagggaacgaaaaagctagtaagggcgatatcgccggccatgactcccttcgccacctctgctgccaccatccctccggtcaccccgacgcggtgggggcggaggagggattccacctggttgttgcctgtcaagacattacaaacagaactgttaggaaatgaagatgtatggtaagacttgtttgtgagttgtgactctaggacagcattatcttacagaacatatcccagacgaccgtcagggagcaccattggtaccatcctcattccagctggtgctggtcctctaccatatatcataggctgtaacaaaaatgttgatagagacaatgactaaattgtcaatatgcagtggtggatgcaggatttctagcatgggtattcagagttacttaaagcatatttcatggaaaaggacagtatatgaactaccaaaatcaatgtacaatggatgacaatgcaatttaatttaaggtgttacaaaatcattaaagaaactactccgtctgtcccaaattataagggctatatttttttacacg

SEQ ID NO: 59207 - DNA, 1801 bp, Oryza sativa
aaagaggtacccctgtgggcgcagtattgccactaggggcacgctactgtggctaaggtgccggacggttcatctgaggacgaggggcgtagcctggctgccggttagcttgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcctttcaagaatttcctgatcttcttcttgtctgtgtccacttcctcaggggcgtaccgagccaacttattgaacatacttaggtactcattgacactgctgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattctcccaccaatctgctgcaggtcctcttagctggtgagaggcgtagagcgtcttctcaaccggagtacactgcactaagttgagttttctatcaacatctttcagccaatcgtcagcctcgacgggctcgacggtctgagagaattctggcggacgagacctcagaaaatctgtcagcttggacctattgttgctcctgtgagggtggccatttccatgcgcattatgctgaaaaccggctacggctgcggctaatccttgcaagatttgtgtctgaactgccattaagtgttgcatgttgttttccacatgaggtggggaagggagtcgttcttctccagaattgtgactggcagtgcggagagagcggtgagactgttccatccctgcatcacgggaagctgtgcgatgcgagcggttgctgcggcggggttgctcaacttctgcgttgcgggaagcagtacggtgcgaacggttgctgtggtgagactgctcattagctgactcatgattcgcttctggctcggctctaccatcttcaaaaccaaagcgggctggtgcacgagctgcacggcgggggtggctagccatctaaactcccagaagagggcggggtaagagtcagataagcacttaggagggcgaggagcaaagtaaatagcaactcagatagcacatactaggcataaattggatttttcaaatcataaaaacacctgatacaacgggtgtggacaagtcacagagctacgccgagcttgactgtgcgcacaccacctaggagaaccacactaccaaacaacacccacaacaaacacacgcacgcactacctcgccacgactccaaaagagttggcggcggaacaaaaggacctaacacacggacggctgctgaagactgcctcctctactcctcgtcggcctggctgcctcctgtagtcggctcctcagtcgaagaaacgtcgatcggctgacgcgaaggcaccggcggaatctgtcgagggccggcagcagcacgggccgctggcggtgggggagtctgtagcgcccgttccgtcgtggcgcctagcgggaaaattatctctaaaaccctaattgcgaaatttgtttcttcccttgttgtctagggtccgtgccatctcaagatctcaatccccgatctatcgtcaagttcaattcccaatccaaatccttccaaatcaaatcccttcgcaaaagtctattttgcctccccccggggtcgat

SEQ ID NO: 59208 - DNA, 12594 bp, Oryza sativa
caccatccaaaataggggcaaaacaaacattcagttaaaaaaagcgagggtaaaaacgaaaaccctaaaaagtaggggtaaaattaatattagacatcaaagtaggggtagaaacgaaattgccccaaacatataagtgctgttaaattggaacggagggatgcgactgatggagtagtatactgtgacgacctgggttgtgctatttttttttagtatagtttttccctttgacattgagatggcataaccgtaacagtcgcagttttcctattgtacaatattaataatgcagccatgcatgcgggcaccaccaacgacgatttccgtcggcgaaatttgcccttacgacctccgacgacgactttgccgaggccttccacattgcagccgtacgtgccgacggcccgacgccatgtatgtagctttccgtttcctaactctgatcgcaacatatggccccgttcggcagtcctactaagcttaggcacgcgaaacgaggaaaccattgatgtttgattaattattttaaactcatgaaatggatatatttaatattttaactcaaattctatataaaatatttttcacagaacgtaccgattattagtttgaaaagtgtgttaataaaaactaggacacaatttgtatcttaatgaaaactggaacatactaattattttcacttcgtgcatgtgtggtagctagctgcagtaaataattgactatactcgctcctctgttgcatattataagttattttttattttttttcatatcaaacattcttaaaattgattaagcctgtgaagaaaatatggcaatatttttaacataaaaacaaaatatcagaatatattcaatgctattttatttaatgaaactaatttgttgttgtagatttcgctaagtttttctataagcttagtcaaatctaaagaattttaacttaaaaaatatcaaaacggcttatgatataaaactgagggagtaatatattttgcaaacccctcattgagtatgatctgataatggattattacatgtggcgattaacaagtcacttgataagaagtgtaaattgtctttaaatgaggaaagcacagggcatgttctttttacttgtcctttggctcattttgcttggaatgtaattgccatggtgttgaatttacatactgtctctctatctttctgggatggtatgagagctatcaaaacaaaaatgaaatctcaagtgggtatggtactgtttgctgggatgttgtggggtttatggattacaaggaatgagtgggtgtttgaaaacaaactaatcaaaactcctttgcaagttgtctgtacatgtctctgtccctgatgcaaagatggaggctgctactaaaataaaaaactgcgctgacttggatgatttccatgagaaagtaatgctcattctggacggtttgcgggtggttgacaatctaccgaagacttggggtagcttgggagagtgtgtcgttttctgttccagttgcgtatatacatgattacgggtggaaaaaagcttgccgctcgtgagctcgcttggctcagtacaatagtgtcatatgcaaaagttttacaccttttctaactatttatttgttgaaaatgataattttgattgtcatattatctatttatgtgttgtgatgacatattaaagaaaaatatcactttattacacattctatgtggtaaaatgttgcttcatttctcttagacctgccaagctagctcgagcccataaacgagccgagccgagctgcacttttagctcgttgtttgtagcgagccaagccaagacgagctttccttgtaccaagctttcacgagccgagccgagccggctctgctcggctcgtttccacccctatacaggatgtggttagtgagggaggttacgttttaggacttttttatggtctgcacctttcatggaaagctggggaccccagtgtcgcgaagccttttgttaccctgtttattgctgtctacttttgtaagattctgtaagaacctattaattttcttctgggctttttacaaagccgggtagtaatatattagcttaattagatctgtgccattaaaattttgctggtttcaaaatataccattacaatttacgcatttgtaacgatgccactgctacttgtttgtaatctcagttgtgcctctaagatacgtattttgcatgtattggacgaaaataccctcatcttctacctctctcttctcttatcttctacctctctcttcacgttgcttcactactgaagaaaccatctttggtcggttgcccaaaatccaaaataatcccggtttaaataggaaccgggactaaaaaatatctttagtcccggttaaaagacctgacgtcactttttgatctttagtcccggttgggtaggaaaatagatacaggcagcaaaaaaacaataaataaataaaacagttgggacgtgaccctatatatctgtagtcccggttggtaatactaatagggactaaagatggatttttagttccggttatttcacccaggactaaagattcctatctttagtcctggattcctattctcggttacaaaaccaggagtatagggggttaggaactgggggtaaagaccatttctccactagtgcttcttgctctgccaccacgctgctcacgctccgccgctgctgctgcttgccgccgtgctgctaagcaggaagagaggaggaagaagaaaggggaagaaagaagaagagggaaaaggggtagtttggtccaattttttctggaaatgcatccgaggggtaagtagtggtatcttttaaatatgtgtaaaattataatgatatatttccaaatacatgaatacaagtggcatatttcgaaactgataaatttttattggcatgtatccaattaaccctaatgtatttgcctgatataaaaaaacaagtgacttgatatattttgcaaatctctcatttatatatatccatatacatatgcttcttcccttcaaagttaagttcctaatatttctcaatgtatatatgtactcattcctacctccagtctggtgaacgggtgcggactgcagtttgtatagtaagtacacgaagatcgagtcaagcgagcggcgtagaggtcatgtgtaccgtgtacttacttattgatgggaaaaggaattaattttgaaattataattttaaaaaaaataagaacgaactgcaattttaagattttggacacatttatttaccaatgcttcccattggagtatgggacctctgtattttggcctatactttcagtttgaccacttactaccttaggtacttttttgtactcctcaacctcgaacttatgttgcgttcttaagttcactttcccaacttcacctccctcgtttttcgagtgcacatatttgttttacttgttttgaaaaagcatgttacttgttttaaaaaaaattatattagatcaacgggtaggtgaagaattagttatattataaaacaaaatttgaataccaaatatatatagctataatatagtattttaagagggaaagagtagatcgtagcaggtggacaaacacagctctgctatctataaatacacgcgccacagacaattggagcttattgaagggaaactaattaaaggaagagctgcagctactcctactcatatatctaggaaataagttcccagttaatgttgtacaacttacatgcgttcatggcattctggctacttgcagacctgctgattcttctggcttctgccgcggagagcatctccggccggcctgccgccggttgccagacacggtgcggtgacgtcagcatcccctacccgttcggcatcggccccaactgctcccatgggaagggcttcgagatcgcctgcgatacccgaacccgaaacggcagcggcgagttggtgccgaccctcgccgccgccaatggcaccatccatgtgcagagcctgtttgtagcgccgatcccggaggtcaaggtgatgctgccggtggcgtaccagtgctacaactccagcgacagcgtcaccgagagtttcttcggcgcggtagacctcaacaacaacggcgtgtaccgcatctccgacaagcgcaacatgttcgtcgtcctcggctgcaacaccatggcctacacgaacaacggggacagtcatggcaaaggcccttacgccggcctctactacaccggctgcgtctcctattgcaacgactcgtcgagcgcgcaggacggcatgtgcgccggcatcggctgctgccatgtcgacatctcgccgggcctcagtgacaacgtcgtcaccttcggcgagtggtcacgctatttccaggtggacttcaacccctgcaactacgccttcctcgtcgccaaggacgaatacaacttccagaggtcagatctccaaaaggacctcaaccggaccaagccggtgtggctggactgggcgatccgcgacggcggcaactcctccgcatcatcgtcctgccctgcgccggaggtgagggagaagatgccgcctgagtacgcctgtgtgagcgacaacagcgaatgcgtcaactccaccaatggcccaggatactactgcaagtgcagcaaaggctacgagggcaacccctacctagtcggaggttgcaacggtaagaacacgtacacgagacaaacaatctactctttcctactcgctatctttcatattgttagacattttaattttttaggcctactaccgaatgctacacagttctaatgaaatagctcatatgtgctgacgatatcttaggtaccacaggtaccaaacacgatactcatagataccatactttgatatctgggtattataataacgtcagtatggtacctacaatactagatttgatatcgggtatcaaacatgatatctcataagtatcaaatcatgatacctacctaacatactgatttcaactatatcgtttgaacggtattgccattttatagtatttttgttaattttttcaaagtcaaacttttcttacgtttgacaaaattagtttaaaaaaaatagcaacatttataataccaaatcaaaatgtgttatattatgaaatagagggagtattgagtttgcactattgtgcatcccacgctagtcatgccatctatgtctgtttaccaatacaattttttttaaaaaaattcaaattaagttatttgtacacccgccattgaatcgaacagtatatatgcagatattgatgagtgcgctcgctcggatgaatatccctgccacggggactgcagaaacaccgtaggagattatcactgcaaatgtcgcacaggttaccagcctagaggaggcggtcccaagatagacgagtgcagccaaaagttccctctacctgcacaaattgctctcggtatgtgccttccaaccaaagtatttcttttataggaggaaccaaagtactttgtttcattctaaaatttgaaatatctagacgcctaaaataatttgttgaaaacggtgtactaaattaaagatgctcccttgcatatatatactcgcaagactatacttgatatatccatttaattcatgcggcttaacgcttttgttcaatgtttattcaaaagtagaaaactaagagcataaaaggaataattaaagcaaaaccctaattaagaggatggaaaagattgagccaagatcaaactatgcggcaggctgtatatgtattcccaaaacaacatgaactagtgaacaaatggagtatataaaatcaattaatgaaaaacaaaattgtttaattcaatactctacagtgagcatctttttctatgagatgtacaaggaaggtgtaatatagtcattcctgaaaagaaactaacggtaaattcacgtagtcaactatttcaactcctagcttacatctggagatgactccgcattaaactatatcggacgcccacccagcctgcatatatatggtaagcacggctgggctcagatcctgcagagtggcagattggcctcaccaaatcgccttttgttcactctaatatgcgtagtcgcccctcgtatgattatactttgaattttgtagttatttgtcgatcgtttgcattaatatatacataaaatgattgttgatatgattttggatatattttaacatgttcttctagatttatatataaaattaaacttattttagtatggagagtgtatgtccgagtccgaatatactttaatgtagcataaaaagaatcatttttaaaccatgtcactaaatagcaccaacactactcagtacttgaatgacatgacatcatttctattcatcctttttagttttggagacttgcagccacatcccttagctatgtcaattaactcaggtggatagctagatatagacaactaattaatgagcgaattgtattgattagatggctaatcacccgaaggtttgcatgcagcgcatggggatagggggtgccaggcccaccctggcaccctcggtggcttcgccactgcttctcacggcccgatgttgtgcattgtgcatggagcccacccgacctatctatcatgcattcttttttcacttttcttatgcgtatacattgttttatatcaaattttaaataatattgtatcgaaaagtgcatatccaatctaccaatctaccatttgattacattattatatttgttataatcaaaacattttagaaagatctcacacaattatactttgataaagaattatccattgtttcacaatttatagaaaattatgctatcacgtgtgcaaatgtttcaactcacctcattatttaagaggaatgaaatatataaacatattacaacaaaacattacatatatatcaacgagtgaaacataaacaacaaaattcatatgataaatatatgtttgcaaatacttaattttataggaggtgtagattagagctgtcatacatacacacacgtacacatatatttggggcgtataaaaaaataggagttcatacacatataatatacgtataattttttttgtatgtatacgttcagaataagtaccccataccgccgtatgtagatctcgcattagcgttttaggatgtcacctgccccaaagtgagggattgcttgtagagaaacgtcaggagcagaactgacatttgttcagtcaaacattattaacacattcgatagaacagtgtcagccccttataacagcggattagtggaaaatatgccagctgcacttcaatgacatttaatatggggaatattttaactgtttgtcactttaaaaaaaatgtcacaactcatatactacggctgtgtttagatctaaagtttggatccaaatttcagtcctttttcatcatatcaacttgtcatacacacaacttttcagtcacatcatctccaatttcaaccaaaatccaaactttttacttttatgataagtaatttttcactctttgctgacatgcatggcatgccagcctgcactcccacggtggacaagacgtgtgaaatgtttatcttacccctcgtgaaccctacaagtcagctgtatctctttgttctctatcagtatagatggccaaagggcccgcccggcacggccccgcccaggcacggctgggcacggcccagcagccatcgggccggcacggcccgcccatgggctgcacctcctgcccaggcacgacctaccagctgtcgggccgtgccgtgctggcccgaaggcatgggtggcccatcgggcctttttaaaataagtctattttttttccctcctctctaggctatttcatttgtatagctaaaataagtctattttccgtccctcctctttgggctgtcatgtgtatagctaaaataagtctattttctgtccctcctctttggctgacatatgtatagataataaaagtctattttagatccctatgctttcgttcatggcatataatgtctatttttactcccctatttttttgtgtatcgggcctagctgccggcccatcgtgccgggccggcccggccgtgccgggccgggccggcacgggcccggcctccgtcgggccgtgccgtgcttgggccgggccaaaataccgtgccatgggctgggccatcgggcctcgggccttttggccatctatatctgtcagtggatccatccaggaaattaagcaccttcttgtcgtccgagttgacagcgatgggctggggttgctgccgctggaataggccaaaaaaggctgaaacatccatggtagcaaatagataaaattaacagagaaaacctagacaacggtatcccgttgtaacgggatactcttctatgagacagtacatatacctgatacatgttgtggtatcaactacatggtacccgatacctgcgatacctgttatctggtacctatgatacctaggacctgatacctgtgatactcgtgcaagagaatagttaatatgtctatcccgttgtaacgggatcccgttttgtagcagccctctaaaattaaaggactgcgtggagcacacaaatgctaaattaattaagccaagttcgatagataaatgcaattcaccgttgtttttttaattggttggttgaaatgaaaaggcagggagctgaaccattcgaatttttttttttcatacacaaaattttcagaaatggatatggaagctttttcacatatcgttagggtttttatcaaatatgcctggatagtttcaatggacaaatggatcaactggagcaaagtattcgcactagtaaccgggaacatatcctatgcacactccgtgcataccaactagcaaatgccacgaaaattctacaaaacattatacacatacttcgaataatattacacctatatgtgaaattttatcttcaaattcattatattttggtcgtaataaaaaagacaaaattctgacacatttttaattacctagaaaactgtcagattttttttgttacggctaaaatataatgaacttgaatatgagactttatatatatgtgtagtactaataggagtaaatgtttaattttatagaatttttcgtgatatttgttagttggtgcgcacgagaaacatgtgtacatagaatatgttcctggtaaccatatatgatctttagtgagttacaaatatcctaactattttcatatttttcattcgtaggaaaaaaaacaattctttagcttttgcatgtcagtcgtacatgcataatatatataaacattacactgttgatatatagtaatatatattcatctcaagtgagcattcgttattattttctattataagttgataacaacaaaatcacaagtcaaatgtatttgttatcgttgctaatgagaacttatgatctttgtaggcataagcctgggattttctttcctgatagttgctgcactttttactctaatgatgctccaaaagagaaaaattaatgagtatttcaaaaagaatggtggttcaattctacagaaagtggacaatatcatgattttctccaaagatgatctaaagaaaatcacaaagaacaattcacacgttattggccaaggaggttttggtaaagtgttcaaagggacgcttgaagataatacaatggtggcagtgaagacttcaattgaggtaaatgaagctcggaaggaggatttcacaaatgaagttataatacaatcgcgaatgatgcacaataacattatcaagctattgggttgttgcttggaggtggatgttccaatgttagtgtatgagtttgccgctaatgggagtctgcaagacattctccatggtgatgccaatcgctcactccttctcacactagacatacgcttggacattgcaattgaatctgcagaaggtctaaaatacatgcactcgtccacaaattgtaccatacgacatggtgatgtcaagcctgccaatatacttttaacagacaagttcgtccctaagatctcagactttgggacatccaagcttcttacagtagataaagacttcaccatgtttgttgttgggagcatgggatacatagacccaatattccataagactggtcgtttaacgcagaaaagtgatgtttatagttttggtgttgtattgctagagctcattagtagaaagccaactatatatggcgagaactttagcctcatcatcgagttccagaaggcctatgatgaagtacacagtgggagggcaatgtttgataaggagatcgcggtggaagaagatatctttatcttggaagaaattggtaagttggcaatggagtgtctaaaagaaaaggttgaagaacgacctgatatgaaggaagtagcagaacgacttgtgatgttgcgaagagccagaaagcatggacaaggaagctataatttgagtcctagacaccatgaggagattagtattgaaacaactcctacgagttttggtgctgattttagcacaaatagtagtgtgagtctttctgcaacatgcactccagaacgcaaagaactctacaagctatagatcaacaactggaagtgaagcaaataagctatatatataatctatcttctggtatgtgcagcgtacctatcctataaattagtatccattgattgaaataactttatgtcttcaagcatgcatctcctacctatgttttctagctatgacagagatgcagtttgttgtagcacaagattgtgtaatctattttctgtagtgtggaacttggaccatgttagatattgttgtatacatgtaatgcacgacttcgatcacattcaagaatttcatagagctaaagtagcttggaatgtgtatagaagctttttatttgtatagtaaacactatatatctaatgatctaaatcgtttgttgacaagctacaaagctaactaatatttgcttcatcatcaaatgaaatgtctgctgaaaattatattgtcctgatcaatactatttatccaatcctgcattgatgattttatagacaattttctccatacgatcagaaaaatcgtaggttgttaaatggctttacgaagagaattcgacttaagaaaataacataatattgccatgactattcatcccccatggtagccaaatgaccattttgcttgccgtttctatttttcttcttattttctttctattgttagatataggtacataacaatcatgacaattttggtaatttctccccaaattttgaattagtaaataatataaaaaaataattgagactctgaaccaagtacttcaagatttcttacttttttggcctagtgtgagataaccgtaggctatacacaaaaacacacggtaattaatactagtgaccaatggcaaaccgtcggcctaatttcccatcggcgatcagtggtcagtaattagcgaatggccgacggtaccctcggctatcaggtttccgacggtggaaagcccgacagtttactttcagccacttgtgcagatgcgcgatttgcaggtgccatctcaattcccatctgtaactagaatgcttggtaactatgttttcattttctttagaattggtgttttatatttctatatttttttggttttgatttctttgtaaattatataatttagtgttcaagatattcacaaatcttggtttccaggtgtacctacatgggaaaacacaaactgcataaataaaaaatatgattgcagcttgtaaagaaatttcttagatatatatttcttatagcagttacattactttatttttagataaaatgataaaataatatagatccacgtgttaacaacactgatatatcagtgattcacgcgccatcaataagtaagaacatttaataaatctagatttggaaataaatgtggatggggaatcataagaatttttctatatgaacagaattggtggtagaatggtaagctctaaaggaaaagtgttgactctagggagatggtatttcatgtactctagagatgtttgggaaaggatccaaaggaaatatatcccagagcaacggttagaggctagagaaataaatggaggggttttgtaaaagtcgaaagaaataaaaaggagggttttataaagtttgaaataaataaggattttataaaatttaaaagagaacatttaactttacaaataaaatttaggtccaaagtaaaagagattaaaagaaagtaaggttgcttcaaaggaaaagtcgagaagagcacaactaaaacttttcgcgaaaatttttcccagaaaatttgagtgcattgcatcaacccttcgctcattcatcttctcatacattgcaacaagaaaaactaatattataaaaaatcacatgattaggttacgatttcgatgtcaatatagttttgaaaatgataaggtgatttttttggataatggattaaattcctgcctttacttcaaataagctacaatcacttattacaaaattctctcaaagagagcaaacattcagaccacttcatagcg

SEQ ID NO: 59209 - DNA, 528 bp, Oryza sativa
ttttcttcagaaagaaaatgtgcaggtttggttttctataatttttctagagaggaaacgttcaggttttggatgtttttgcttggaataagtccactttgactatcttaaatatatctctaatctaattcatatcccgtaacaacaataccggatatcttgaccccctcaaatattacaactggtataatttaactccctcagcagttttggaggatgggtccgctgacatggcgctttgaccgggtctatctcgctgggtcatcctgtgggacccacatgtcattctcacactccttcccttttttcccatttctctctctccttcatcttccccattcgacttcaatacagtgggctgagggacgatgactccaccacccgtgccgtgaggggaggccgcagcctcgtcatcatcgtggttgctctccacatatctgaagctttcgagcctccattctcagcttcccagggcaagcctcatcgatctgtagcgttgtatcaagaagcagcgggtgacgttctatt

SEQ ID NO: 59210 - DNA, 549 bp, Oryza sativa
atgtggaggagaatgtgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtccagtgcgtaaggactgtgtttgcgaaactggtgggtagaaacccggaaataacacaattcgaggatcttaccagatctgggctagcaattgctgatggggatccacaatatgacggtgccttcgaaccaatgtgtgatgaaccaaggaaggggttggagtttcgatcgatggatgatctgaaaatatggctacagagttattctatccgtgtccaccggccgtaccatgtgaaggaat

SEQ ID NO: 59211 - DNA, 13930 bp, Oryza sativa
gcagagaggattggacgtacgtgatcaaatcattcagtttggacggccttaattcgcccatctgcaaattcggcgccaaattggccctttttgctcatagctagctggtcgatccatcgattgatggatcaataatgcaagcaagctgtgtttgtattcatcgatgcctatataaaccgcgcgtttgcctcacctttcacttcatccatctctacacatcagcaatatttagctacacagagctagctaggattagctcagcaatggcaggtgctcctcgaggactagttctcctcggcgtttgtgccgtcttgatggcggtcgccgtcggcggtgaggcggcgtcggttgtcgtcggcacggccaagtgcgccgactgcacccggaagaacatgaaagctgaggatgctttcaagagtacgtattccctatgtagtttcgtattataagtcgttttgatttttttaaaagttaaatttctttaagttcatagaaaaatagtagcattttcaacctaaaacaaacatattattaaaaactttatcaaaatatatttaatattggatttaatgaagctaatttaatgtcttagatattgctattttatctataaatttagtcaaacttaaaaaaaataatttcaaagcgaattataatatgaaaaagaaatagtaatatttcacaatgcatgatgcaaactgcatcatctagagaaagatacagctggttacaagtgattcacaatactatttggaattttactatgcagacctccaagtggcgatcaagtgcaagaacaccaacggtgagtacgagagcaaggctgccggaaagctcgatggcaccggcgctttcagcgtccccctcgacgccgaccttgacagctccgactgcatcgctcagctccacagcgccaacaacgagccatgccctggtcaggagccatccaagatcgtgccaatgtcggagggcacctttgtcgccattgccggcaagacacactacccatcagcgttgtgcgcgtcagcgaccatctgcggtcccatcaagaagaagatcatagaccacttccacaagaagccggtgccacccaagccggagccgaagccggagccacccaagccgaagcctgagccggaacaccccttcctcgaccatatccacaagaaggagaagcacttcttcgaccacttccacaagaagccagtgccacctaagccagagccgaagccagagcccaagccagagcccaagccgcagcctgcgccggagtaccacaacccgagccctccggcaaagaactgatgaatatgatccgcactggacgtttgatcatgccgtcctgccccctgtcagattgtctgcataataacagtttgagatcgaagtcatgcattagctttcatcgacaggagttttaatttgtacttgtatctatttcttctctatcaaatgcagttatatatggtaagataatttatttatatttaatcagtactgttgtggcggactattcactgtatcagccaaagccattggatcgtaagaggttagcattggttaaagaaaaagttatttttatctgacaaactagtcccaatgacggaattttcctgatgttgatacgtcacgaataattttcgagacgtttttttgctttatcctagtgatttttggccatcataagtaatctagttgctggtagtatcttttaattcttagaatgtgcttggttgcggcttacaaaacgtgctacgtgcccaaaagcaaccaaaataatttggtgcttaattaacttttatttataagctatggctgaaacatagagaatgataaaaaaacatgtatactaatataaattgaatttttttaaattgagagttaaactgatgagttgccaagtacatacttcaatcatattattacccttataactatttgactaacaagtcttgcctgtctgtcgtaccccccattggtttccccctcagttcagttttaagagcgaaccaacctaagatgaataattcatgaaatatatgtacagtacgcgcacctatggattttcctagactagtatctcttatataagttctttttaataattttttagttttagttaaaatgaatgaaaaacaaaatcatctaatccagaaaatgtaaccaaaaaattgaacagcaaaaaaatcccccatgctagttattgtcctataatttggaatttgtcaagagttttatgtcttacacattgatctccagtcagttatacatgcatcctgatttcatgaacatttctagttcaactgtttaacagtgacatgcatggctaccagcagtagacatatgcatatgaaatagtagaacaaattccacagtaagacctttcacatttttttaataactctggtatggccagttgacattaacttcttccacaatttggcaactttttgtcaactctggtgattgatgcattcaccgaggtggccaagatctcattcttctggcattctgacatccatttcaatgctgtccacacttgctatccacaagtactggttcacctccctagctagccatctctaataccctcaccacccccccccaaaatcaaccaggcatcaagttgatcttctacatgacttccctatctactcccatgccaatcccatcgcatcaagaattcaaggtgacagtaaagtacttcctattataatcacagacaaattaactcagacaatccatacactgctcagcctaaaaaagaccagatacaggagtgaccacagtcaacagtgaaactctggaatctgaactatagttaattaattgggactattcaaccaattcaattctcacctgtcagatttttcactggacaaataaaaatgaccctaccaaatagcaattgggatattagaaaaatgggcccaactgatagtggcttgtacagcaaaaatttattaaattttcatgctgtgcctggttggatttctgctgacatcgcttcctaaatgaattgctagtatcagtagtaccaaatcaatctgaattaactgctagtcaccagtacaaaaaggtttttttctagacggcccaaaacctaatctcgtatgcggaaggtcggcctgtctgccgcaaatgatttgaaaaaaaatctgatttatacgtatgggatgtgcacctgcacgcgaaaatccaattttcgcgtgcggatgcttatgtcgttcacaagtaaaataaaaataaaaaaattaaaataaaaataaacataaccctagaatctaggcggcgtggcgcggatccggccatcgggcgcctgtggatcgagccattgcggggccggctcccgcgaatccggctgtcgtggggctggcagaggtggatccgtccaccgtcgtccaccgagccgcttgcccccgcgccctaggtgtcattcgccactgtcgtgtgccgcgctagctgccgcctgagcgctcaaggaagccggagccatccgccgtccaccgcaggccgtcgcggggccgatgcccgcggatccgtctgttgagggcccggtggcagcggatccggtagtcgcggggcccgcggaggcggatccgtccacgccgtccgccaaggtgccatccgtcaccactgtgcgctgcgcccgctagcgcccgccgccaccaccatgcgccgctaacaccgccgccgcttgccagtgagttagagaggagaggaggtgagagtgagaagagaggagagtataaggttgaaataatgaggagaggaagtgagaaaggatagggatgaaaaattttgaagtgttgaggagagaaatgaggaggtaactcagactttgggcggatccttaagaggctgtatgtgaaaatcgattttcgtatgttgttgcataagaggccccttaagttgtattgactgctatgtgtctacgggagttattttaaagatggcaatctatttcatggattgatagtcttactcaatatttcttatacttcctagatttttatatctagctcgtgggtgtgtttcgactgataggtgctctcattacggttctatcttgattcagttcactgagtttaattaatgaagctttcattatctaaaaatgtctagaagcattatctaccgtataattgttagggataatgacgttcaaaaacataaagacaacatctaactttacatgatgatatagtggtaactgttcaatacttgctgcacctagagagagagagagagtgacagtacagatgtatccatgtaaccaataatctagctacttctgcaggaaccaaccaagaattgctgcgtattggcagcttgcaatgaatgtcactcaatcaagcatgcagcaggagggttgctatcacctttccattgcattgccttaatcagattaatattgtgcagaaattaagcaaaaccacatgcagcctcgtgttaggtgaatttggcgccgaacggattgatgaaacagccaaacctcctcgagctcaactaattatatacccgattttaggctaatgtttactcttaattaagcaatgaacctagatgtaagaaattacgcgtgttcactcttagaattttatatgataatagtagaaataacaagatatgtagataggtagacaacataacttcatatgcttcatttatataaattttatctttgatcgactattaaaaaaaagctacaaacaattaatatggtgatgtttgatttaaaaaaaatgttaaaaatatagtcataattcgacatattttaataaaaaaacatgacagtaaacatgacatgtgaatgaaatgatgatccaatgtagtgctaaacattaatatgtaatagtaatagctagcatcatgcatgtagtaacatgtttagcaataaactgaatagagcattatatttgaagaccgctccagatttcagatgagtcattgttgatgtgttgcctctgttgtcgtcgctgttctctcctctacctctgttgctaatgttcccttctccactggcatcgttcttagtactgatcgacatgatccaagttatctatgtagaggaaagagaacgtgacgtataggatgcaaagccaagagcagtagcgtgaaaaagtgctccctaaaaacttgattgtccgtctacctatccaggtactcaggtggacagagttctggaggcgtgtcccaagtacccgtgcacgtaggctgcatagaaacagaagaatagagtgtgtcgtctcacggagaactagaggagagatctgcctatacttggaggataacgagagagagggagacgttatgggagggattaatttcgattgagtgctccgcccattacaacagaacaagtctccgtcagttatgtttttacacataaaaatgaaacatcctgaaggaatgcagccgttgtcgcctcgctctcttgctcgcacactctcctcggcctcctccacagccatggcctcccccggctcggcgtgactgcacgcacgcgtgtgcagtcccaccaccatatcaactgctaaatatgtgctctcagttaacagccaatttaagatgaggtctttttccattggtttccaaggtagtattaattaatcccatagcattaattgttggcctttggaattactaggtttaattttaggccgatatcatttaattctaacaattcccaccgaattttaaggctcatagaaaatgttctcagctttgtttttgtttgttataccagtgttttggttgagactgttaacttgaactttcacccagaaaaagaactacacctgaccacaactgattaatggattatgtcttgaattatcagtcttgttcagtcaggctttactcaattccttaactgatactaggctggcattagcatcccctctatttggagcatttaagtcatactattggcttttccataagtatctagagatcagccaaattttataggctgtgattagcagtcggactcatattggtgtgttccttctaagatgttttataggccaacatctctactttaagaaaaatcactcaatcacattaatgtatctccaacttgccatacagaccaggagagaactacatcaaagaaagaagcctttttaaggtctcttctcccagctacctaataggatgtttcgccaccctaatttaccagatctttgatcacataggacaggttaccactattgtgtagctcaagtatgtctcaagcccatctcactcgatgcattgtctgtcacaaacccgtatggctggtccatatagctcacctcctccaactccccattaagaaaagttgtttcaacgtccatctgatgaacgataagaccataagaggctaccagaacaaataatactcaaattgtggtcaagcgagcaactgatgaataagtgccgaaaaaaatcattgccttatttttgggtataacccttggccataagtcctgccttatacttttcaattgtaccatcaggcctaaactattttcttgagaactcatttgtatcctataggtttgcagtcgtatggacactcgacaacttcgcaagtaccattagacgtaattgagtccatctcactgcatagcgcttccttccaatagtcagcatcaggagatgaatataccgagatgaatatacctcttctatggttcttggagtatcatccacaaggtatacaatgtattcatcatcaaaagactttgcagtcctttatctcttactctttcgagtagctatagtgttatcctcctcaagatttttccacaggcgttgttcatcgtgttctatcggcacaaaagactcggggataaaataagttcttgactagaagtgctaggtacatatttctaggaaatccattctaaaaaattgtagcatctctaggctcaagaattgtaccaacaatcatatcaggtattccagaatttacaattaagaatctttatcccacgctgtggatagcataactaaggaatacacaatttatggtttttggtccaagtttgtgccttttgactataggcgcattgaccttagccaaacattcccatgtgcgcaagtatgagagattcgacattttcctttccagttcctcgaacggtgttacttctttattcttagtaggaatttattcagcacatgacacacggtcaatatagcctcaccccaccattccttggaaagccctgcaatgtctaacatgtcattcaccaaactcagttagagtgtgattctttctttcggcaaacccgtttgactaggaaaaaaagggagtcgttctctcatgaataattttagactcttcatagaaagaagtaaatttatttgaaaaatactctccacctcgatcagacctcaaccgtttaacttttctttcaagttggttttctacctcagccttatacattttcacgtaatgcaatgcatcatcttttgcaaaatctaatgcaattatctataagtgtcatgaagtatttctttttcccctttagtcaacacaccatacatttcgcacaaatcagaatgaccaatttctagcagtgccaaatttcttgtctctgatgccttgtaaggctaagtatggcatttggaaccttttaccaaagtgaatttcggaattaattaactcattgtagctaagcacaacatgcaactaaaattcacatgacagacgtgaatgccaaacattggactcatcatcattactcacatagttcacaacattattacatgcgtcatccaacattattacatgtgtcatccacagaaaagcggtacaaacctccgttgtcataacctttagcaacaaatgtttcatatttagacacgacacatttattggactcaaacacaagtttaaaattttaaacattgatcgtgccaacacatgcgaaccgttctgcatcagcaaggaggaatctctcctgacctgataaaaataaaacagggaaatatcaacacacaaccaccagtatcaacccaccacttaggtgaatgaaatacataacgaactgtaggtaaaaaattaccataccaagatgttactcctccatcgctaataaccatgtttgcagattttttgaccttgcgatcagggcaatacttggcccaatgacgacttaacacacacacacaaagcagttatcctttgcctttctcttgccttttttttttaaaattggttatagccttgggtttgatatcatatatgactttttttcataaaattagttgtagccttgttgtgggatgcttgagcattccttttctgcaccaaatgctaaaacctccctcaaactttttgtcgcggttgttctttgctatcaccttctcctcaacacccaaagaggcaatgagatcaataacactgaacacttgcctcatgtgttttagacaagtagcaaagtccaaccaatatgtcatctatcacaaacttgtctagcaactcgtagatgttgttctcaagttcctttggtagtgcctgaaactcatgagcttgttttactatagaacggtcatcgacgatcttatactcatagcaatgtttcatgacatacaactcactgccagtatcgaagactccgaacatggcctcaagtgcatcccacatatcctttcgtgaaggcatgtgcatgtacacttctactcttttgttggctaatacacttatctatgctccacggaacaagcaattcgcgaactcgaacttagcctcctccacaggggagagaccgtacgatcgtcttgccctatgaaacaaagaaatattgcatagccgtcaaccacaatagtgcacgtgccttctatctcttataatttgaaccatcaattgcatgaggtttaagtgatgcagcaaaggcaactaccaaaaagacctgtcaagtttttggattgttgaaaatataatcataatctctactatcataaaattgaagatatttttctggtattttggtaagtcatccgtgcttgagtcggttttaatttcttgtttcggttttaatctctactcctcaaaatccgtaatttaaaaaagggcgaaaaaaatcacacggaaaaagaaaacgcccataaaataacatgaaagataaacagggaaaaaaacgtccgattcgtaccggaacgaaaaaaaggcaaaaaatgctgggtaaaacaaaaaaaaccgaccataaaaaaatgcaggacattggcaaagtacttcagatataacatgtactactcactgtagttatgtggtacttctattcaattaatcatctctcagtacacattgcacaaagttataagttctcacccgtagtttacattaggaccagttcgattattgtacttgtaacgatgattcatgctgtcatgcatgcataaagcggtgcgtggatcctacgtatgccagccattaatggataggttattatcatttatattctcttcgtctcaggacaaaccaacttaagatataagatgctactcaactaaggtcctgtttgtttcagcttaaaattattgtaatctagactattaaatcagattactctaagcaggattataataagctgacataaaataagctacgagttgtttgtttctctagattattagagtcatctaagggtagtgggtcattagccacttaataatctggaaaaagctcctctagaggagattattggattatagtaatctggcttatagattataataatctagcataataatctacttgtttgttttagcttactcctaataatctagattataataatcctaagctgaatcaaacagggcctaagccaaccaaagggggtgaatggttggtataccaaaaaaccgaaacttttagcggaaataaaaatgacccccaaattcgacggagatcggtctgaccgcagttgtccagccggtctgaccgcgcctgtgccgtcggtccaaccggtgtagaacgatcggtctgaccgccctgagatcgcctttacgccgccggtctgaccgcctttacgccgctggtctgaccgccgtgatgccgccggtctgaccgccggtgtgtcgctagttagaccgccgaaatccggtgaaatacaaatcgaagaactcttaaagtgggtgactactttattgattctctctgtgtttacaaactcatactagaagtcctatacaacttaggaaaccctctagtacaagaaacaaactttacataaccactcataccaaatttggactcctttcaaattcgactccgcattccatacacacacaatacctccatcgtataccatatggaatcttcaccaaccatgtgtattgaactctagccgtagtatcccgtatgatctctgaccaccacggacgtcgtcttatccccaagccgactcttagtccatcaccgcaaatactctcctgccatccgagtcacctacacatagaacaaacaaagaaatcatattccgagaccaagctatctccaaccttgactcattagtagcaaacaacagtattacatacgtatagtatccatctagaagccataatcatgaaacaatcacggatatccaaacaaacaacccgaaaccgaaaccgacacagagtccgccggtcagaccgcgggctgcaccggtctgactgcgcgatacacgccggtctgaccggtagcacatgcctggtctgaccggacctattccagcagtacctgtagatttacctgtgaaatccaatcatctcctaaaccacttcgtgaataaattctaaatatcaaaaccaataatctccgatgccaattgttcatcacagaataacaatcaaaaacacctttaattttacagttacatagtctagtataacgaatctgaatatcatcatgtccagatttattgtattaagttataccatatcctttcacagatttactactgagtgatcagatcattcagtttggacggcatcaattcgcccatctacaaatacggcgccaacttggtctttttaatttgctcatagctggtagatcatagttggatcgatcaacaatgcaagctgtgtatattgatcgcctatataaaccacgcgttgcctcacctttcacttcatccatctctacacatcagcaatagctacacagagctaagctagggttagctcagcaatggcaggtgctcctcgaggactagttctcctcggcgtttgtgccgtcttgatggcggtcgccgtcggcggagaggcggcgtcggtcgtcgtcggcacggccaagtgcgccgactgcaccaggaagaacatgaaagctgaggatgctttcaagagtacgtaacaatttatctggaattcactgagctgatcagctatacaccatcaggatcagaaagatatagctaattacaagtgattgacaatattatttggaattcttttattcagacctccaggtggcgatcaagtgcaagaacggcaatggtgagtacgagagcaaggccaccggaaagctcgacggtaccggcgtcttcagcatccccctcgacgccgacctccacagctccgactgcgtcgcacagctccatggcgcgaccaacgagccatgccccggacaagagccatccaagatcgtgccaatgtcagagggcacctttatcgccgtcgccggccagacccactacccatcagcgttgtgcgcatcggcgaccatctgcggtcccatcaagaagaagatcatagaccacttccacaagaagccggtgccacccaagccagagccaaaaccggagccacccaagcccaagcctgagccggagcacccattcctcgaccacatccacaagaaggagaagcacttcttcgatcacttccacaagaagcccgtgccgcccaagccagagcccaagccggagcccaagccagagcccaagccgcagcctgcgcctgagtaccacaacccgagccctccggcgaagaattgatgaatatgatctgcattggatggacattagcatgtttgatcatgccgcagatgatgatcctgctcagcacaggagtgtaatttgtacttgattatcgggcatcagcagggatgtttgtactatttgcatatttttctctcccaaatgaaattatatatggtaaaataatttatttacatttagccagatttggtgggacgactgattattcaccatttagcattcaccttagcttgattcaagctactgggctcggccgagagaaacgtacggtacttgatcttacgataagtcatggcagcggtggcaagacggttgtgaccagaatttagggcctgcatggaaatctgaacttttttttttggtcaattaagtgtaaaataatatgtttaccatattggaacccagaaaagctgcttcgatacatggactaaaacacactaaatttaccgttgtactatttgggaaaactttttaagctacgggtgaacgccgaattgtttaatttatatcgactaaatgattataaaatctttttaaacaaatgacatgaatatattactctataaattaacatgctagtataaatttggcttctgcaaattgtaacaaaaataaaaataataaatttgactgcaaataaacgtatactaattaaagtttaatacgttatttttttataacttgcgcataagtcaaatttaaacttgcatatttgtgaagtgatgcattacatattaatctacctttttatcaattttttcagaactatttagttgacatgtgatgaacaggtggacgttcactcgggtgattaaaatccttctccttgtatttgggccactccaacagaaattaggagtgtggtctcaaagaagccacactttttcgaattagggcggggggtggaggggggcggcgccagccaccctggcgccgcggcgccaggggcgggcccaggtttttcaacttgggtattcgaaattgtaagagaaaaaattttctaacccaaggtctaatagttgtataatatgtaacggtataagcatgattttataaagtcataaatagatagaattgaccataaattgaatgcgttaagcatattagagtacattactaaactattattgacaaaacaaatcaaatttatagagcacataaaatggcaaaatgataaaaaaaatcttacaatttagagagaacttttcgtttcttgatattttgaaaatgattgatcatgtcttcattcttaacttgcaagaagaaatctctttcaatgaatgtaaccaagcaatcattcaaatattctggccccatcttgcttcttgcaatcattcaaataatcaatacacttcagttcagtctgaagaagcattcaaacaataatatcctcattagtcattcaagcattgaagcaatatcctcattcaagcattcaagcaatatcctcaatcctcataattcattaatcgatatcctagtatttcctcaccggctcaccgactcaccgttgctcggttgctgtcttgctgactgctgtcgaggatgggaggagacaagttgggcagctccgcagctgggcaagagccaggaggcgtcgaggcggcgtcggcgggcgggcggtgggccgcgccgccgcgggcgacggccgaagccgggctggcgccgtggcgcggcgacggtgcgtgcgtcggcctagcgagctggcggcggctggcgtggcggctgggaatgggaaggggatgggaagggaggtgaggagaagagatagggttagaaaggaagtgggcttttctttgctattgggccaatgggcctgaaatgctgggtggtgggagggttcagtttgggcttcttttgatttttgaatgggtataagtattttttttcttttttcctatatatacatatggaatatatacttcatatatgtattttttgggcaaaaattt

SEQ ID NO: 59212 - DNA, 1130 bp, Oryza sativa
ccctcacagactaacacatgtcttttctgcacactttgtcctcactcgtgtgcacccgggaagaattcccccaggccgggcccgcttacatctgatagctttcataggtcatagactgctctcacagactaacacatgtcttttctgcacactttgtcctcactcgtgtgcacccgggaaatgtcttttctgcacactttgtcctcactcgtgtgcacccgggaagaatttcccggtcggtcacccatcccaaattgctccaggccaagcacgcttaaccctggagttctttggagattggctgccggaaaagaagttgcaacttgttgatatgaatattctattaatcctattaagccctaggccggaatgttacaccctcacccccttaagagagatcgacgcccccgtcgatcaaccctaggccaggaacgtcctctcttggccacgtccatgtgtccagtgccagcgcatgtgccatgctgtgtaaccactcccggtctacactagccatgcgcaccatgcctgcgcaactgcgacacacgcgcccgtgaaaccgcgagagtcggctctgataccatctcttgtcacgccccgaactagtcccgactggaactagcccgtgacgctccaaattaacctgttaatcgataccagtcccaggaaatagtgctggtatcacaggaagacagaatatcacagcaacagaggtctctttattatagagtaggagtacagtcatgttgggctgtggacagatcccgagctcacaactgcattacaaaaggaaagcggaagccaggactagaccaaacaacacaggcgcgacttgggaactaggccgagaccctaaaactcatcgtagccggcttgctcctggaagaactcctcatcagcaggatccgcttcatcttcttcagcaactgggggggattatttatatagagcatgggtgagtacgggagtactcagcaagccatgggaaataagtgtttaatgcaggcttcaaggaaaggctgttgtttttgcaattgattttagttgaactcttttctaaaaacaactgagtgctcctcaaacgacacggatgagacagtgcgtctcgtccggtcggagtatgtgtatcagct

SEQ ID NO: 59213 - DNA, 633 bp, Oryza sativa
attcctgcagcccttcagcaagtatgattccctccagccacctgtcatgccagaaggtggttccagctccatttccaacttccactgtagttagctcgtgcaggcagggcagcagtttttgtagggaggcccaatgagggccaagaggcctttgtttcataagatagttttcagaaggaataagttcactttgtgtccctctatttgtcgcccagtccgattttcgtcccttgatcgtaaaaccgggtataacccgtcccccaacttacaaaaaccgggtaaacatagtttactcggcggttttgaaggcggttttggctgatgtggcgtctacgtggcttgtttgactagatcttcgttccacgtggcattgacgtgacactcacgtgacaattatatctcggaaaaataataaaaagtgtggccccacatgtcagctgcaaaaaaaaatttaaaatggtggggcccacgtaggccccacatgtcagcctcactcctctctacttccctttcccccctctctctctctcgccttcccgggcagcgaacggagcgagtgggtggcggaacatgcgagctccggcggcggcggcgggcgtggtcggcgccgccccccgaccggagcgctgccgg

SEQ ID NO: 59214 - DNA, 30255 bp, Oryza sativa
  unsure (1)..(30255): unsure at all n locations
attatcggtctgtgacagtcacagccggtcagatccgggttaggtgcggccaggcggtctacgcacgccttgccccatccggcaaggtgtaagttttaagcacttcccccccccaattgaagctagcgtgttacatcccagagatggcacgttagccccgatcgatttataccaggcttcatcctaaccattacaggcgaggtgttacacgaagaagggcaaacatgcatgttattaaactgacgcatggtggacaagaatgaccggtctgacactgatcgcatcagcaacgggcagccacgatctcacgttgcgcctgtctccgccgggagtggaggtaggtgtgggccgtcccatcggagtgtcattcggagggcaaccataccaatctccgtccataaagagaagaaaagtccagtttggaaagagaagggtgcatgtggtatccccttgaagtataaaaggaggaccttgcccatagagaaggggttggttgattctttcccggattgagtgctgagaacggggggggaagtcagctcacactttgtaactcattcatacacagatccaccaaaacacaggagtagggtattacgcttctcagcggcccgaacctgtatagatcgccggtgtctcgtgtttcttgctggcagacgatctttccacatacagagagagagcgagagcttgagattgcaccctaagcccccggccgaaccggcaaaggggggcctgcgcggtctcccggtgaggagccacgagctccgtcagacatgtataccgcaaggacaacatcgaaccggatgatctagcacggcgtgcgtccagatgagagccactcgaacctagcacctttctggacgtcctgacaaggccatcagtgaaagacgcaagcggcaaagatagcccggtctccctcaacaatagctcaggggctacaaaggcagagcgcgtcgttgccgacattgagaccacagacgactggcacaccccactcatcaaattcataggcagcgaagagttgcccgaggacgacgcaaaagcagagaaaatatcccgtaaagcaaaagtctactgtatgataggcaacgatctatacaagaaggcgccaaacggggtacttctaaaatgcgtctcgtccgacgacggcagacatctcctcctcgatatacatgaaaggatctgtgggtcacatgccgccggtcggacattagtcggaaaggcttttcgacaagggttcttgtaacgccccgattttcgttcgggtttaaaaatcaattaataatacattttctagaaattaaataaaagttaaatcaatttatccaagtgaaatgttgggagaattaaaattttcccttaaaaatcattggccgggaatattttgtaatattctttgtgccctaatgtactctccggaattttccgtgaattttcggagctcgagaaatagttttaatagcacaaaggtcattgcatcaatttaaataaaaagaaaacaaaataaacttccccttcctccctttcgggctcggcccaaaatcctctctccttcccctcccgcggcccggcttgcctcccctttttggcgcaagtcttcttttcctccctcccggcctcccctctcactcaggccgacaggtgggacccgtggaccccacctgtcatccccaacctccggccagctccaaccgccgcccacgccggccactccctccgccgatcccgcacctcccctcgtcccaaccggcgtggacccgagaccccttccacctcgcgaccacatcccgccccactccccctctctccccgcgggaatcaacgccacgccgagccggcacacccccacgacgccggcccactttccctcgaaatccggcgctccccggccctctcctcgcccccttgagctataaaatcaatccccgtggactcctcttcctttttccccgttttcccgagtcccccacgccctctaccgagctctccacgccgatccccttcgccgccgctcgccggcgatgtccagccgcccgccaccgccgctcccgtcgctgccgcgctgcgccgccaccacctatagcatcacaccaccccaccgcaccccggcatccactccatctccctcctccaccgccggaaccaccttcccatcgcgaggccgagccactaccgccacacaccgccttcagccggccgctgccgctgcgttagtcgtcgccgcacctcgccgcttgcgccgtcggcaacgccgtgccaagctctaccccggcctccgctccgtttccccattccaccaccgcaaccacccttccaccgtgcatcccgagccacctccaccatacgccgcctccagccgtgtgccaccgtcgccttagccgccgccgcgtcgctccgtcttcacctctcgcctcgcagcgccgtgcagcacctcggtcaccgttgttcatcgccggaaacccaccggaacgtggtacctctcggtcgccggtgagccccaccattcctctcctctctggcgtggtattctcgccgctccggtcgcctatttccctccctaaccgctccaataatttccctaggtcttgccggccctcggccgcggctccgccatggtcgggcgtcgtcggaccgccgttcccgtcgcctcccgtgtcggccgccgccatcctttccgccgccggtcgcctccccatggtcgtcccgtcgccggcgctcctcggtgaggacccccttcatctcctttccctttcccctcttttcgtcgcctcccgtgcgtgccgtcgcgccggtggtcgtcgccggcgaccatcgggccgtgcgccgtcgctcccggccggccgaccggtgagctggctcccgctcgcccgtggccgcccgatcctccttcggggcgatctgggccgtccacgtggccttcccgtgccgcccgcgtcggtgcctctgtggcgccacgtcggcgccacctccgctagccgtccgtcgtggccgccacgtgtctgccacgtggtgcgcccgcggaccagcgcatgcgtggactcggtccacggtgcgcccgccacccgtgagtcaccgtcaggtggggcccgcttgccggcgccacctctcccccgtcggatgacgtcataattgatttaaattgcgcaataaatcggtaataattctagaaattcattaaaatggctcaaaaccttctaaaattcatatctaattcattcgaactccgaattgagccattcaacttgcaaaattcatctaaaattgagctctacatgtttgtttactttttatgtactgttttcttggtgtttattagagtttttcctcgttttgcgtgccagcgtgtagtttccgtcgtttcggaagtccgcggtcgcgaggaaaagagttcagaagatcaaagtgaagaagcaaggcaagtcacacattctccttgagcatgttgatcccaatttataaatgttttaccgtttacaaataaatatgcatgttttgctaattacatgggatcagggttttcctatctgctcgcttgcgccatgtttacttgatatctgttctttgtcaaccttgggtaataaattgactagcttgtgttacttatgtgacctagctagaactatatgcttagccatgcttaattaccactagctcagtcgatgggataattgcagtattagacattctagtatcttgttgagctgcgtgctcgagacatctggccatgttttatggtcgtaattatccaactaaaatgcgactgaatggtgggctgtggatgcatggttttgcgagtcgcacccatagcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagtaaaggtgggttggttgggcctgttcaacgtggtgtagcgttgatcagtggagatttaatattactttaattactcaacagttttactgttttgctcaataaaatgttttacaactgcctttatgcaaatagccacaaaccgtccttgtgttcccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacagttcttctggccaaccgccctcaaagatgcttgcgacatggtttagcggtgtgaagctgtcaattccacagtaaacacacaaggctaccagcgcaagcactccagaccatccctctcacttggccgttctcgtactgggggctagatatactcggcccattcccacgaggacagggcggctacaagttcctattcgtggcgattgataaattcactaagtggattgaagcgacacccacgggggaaatcaaggccgacaacgccatcaaattcatcaaagggatattctgtagatttggattgccccaccgtatcataacggacaacggctcccagttcatcagtgtcgatttccaggactactgcatcaggctgggagtcaagatctgcttcgctcggtttctcaccctcagagcaatggacaagtcgagagggcaaacggcatagtactacaaggaatcaagacccgcgtctacgacaggctcatgtcacatgacaagaagtgggtcgaagaacttccatcagtactatgggccgtgcgtaccacaccgacaacgtctaacaaggagacacccttcttcctcgtgtacggctcagaggctatgctccccaccaagctacgataccaaagtacacgagcacataagtactccgatgagaatcaggaggagcagcgaaatgacgatgtgaatctactcgaagaacatcgcgaacgagttgtcgttcgagcagccagctaccaacaggcccttcaccgctactacgagaaacgcatccgagcacgcacactttcgatcggggactacgtcctccgacgggttcaaagtcaagcagggcgaaacaagctctcacccaaatgggaaggaccgtacacgatcacacaagttctgcagccaggcgcattcaaaattgcagacggcgatggtcgcgagttggcaaattcctggaacattaatcaattacgtaaattctatgtataaatcaatagtatccatacttgtaagacatcttacagcttcaataaagcctattttcaggtacaaactacaatcaaagtgttccttcccgatgatcccttacccagatgacacctagcgttgaaacctatcctcatgtccctttacgccgtcttgacaaggcctccaaggaacctaagggaacttcggctggggacgcccagagccgataaggccttgtcggatcctgtagagatgaaagaccatgtaagatctagtcgtgtaagagttctcgccgtgcgtattaaccaagccgtgtaatcggaaattaactttccaacttcacggctgggggctaggatcagtgcttgttcaaccgaggcaggtcaaaggtctaagagccttatcttccgagacgaattctccgatgataaggctgggggctagggagagtgtataactcaaacgactgatcgaagtcacgaagtgagaagacactcatacacgctacatccagagtaagaaagcttagttagatagatttcttttctatttcacaagtacttcttacaattccacaaaaatccaaaattatattacactttttcctaagacatttgtcacaggacacggagactaccaggaaggccaacgccagtccatggactggaagaccttctccgccagcggtgccatcgacctcgccaggccatctatctccgtaggagttcttcgagaacgagaatacccttcgtagaggaactcgaggtgcagctgcgggcgatgatgtcgtatgcaagccaacacatgccccccggcatatcggctcgatcgacgacactcctgcttcagggcctcgtcgatacgctggtcgatgccttcgagctgggcacaggccccattcagccacgagatgtatccagccgccgattcctcgggatccccacggggtactcggagctctctacatactcttgacatggaggtgcagcaactcttcagatacgagttgaaccacacagcgcgaccccggagtgtctccacggcctggtccttcttcacttccagcatagtcctctcgagtttcgcgacctcaaacttcgtcctctaatactggatgcgacgatcctggtcagcaagcacactctcgaggtctgctcagtatggaaacgactaagtcaaactgctcttctcttccgagaatacagcagatcaagtcgatccagacggaagagtaaaggagatgaaaacaaagacaaccaacctaagggagtcgtcgccatacccgtttccacaggtgaattttgagctacgtcgccatccagcacatgtggctcgaacgcaagtatcggaacgatcactggcagctcaggctgcccgcgctgctggacatcctcgacatcaacatctctacatacgacaacaaagtactcaagatcaaaatgctgaagaaagccaaggtgataactgcacacacaaaggcagttggaaccaatgagagttttacaaagcatgactaaagagtacaaaagagccaaaatcctactcttcaaaaagcgggaggacagactcccccagatcgccgacttctttcatcacatccttgcgcgcgtcgctagccgccccctgatccaagatcttccgcagatcgagttcagggtgcaccagcctcacacacgcaaggacatggcacgccccggtatagatctcgttgggcgtctcctctctgatcatggccgcgtgcttggaggggatcgcctccatcgccatcgccagctccgcaagcgaagtcgtcagcgagaactcatcgggattcaccggaatgatggacttgataccacactccccggtgagttggtgcagactagtgtaggtgacccgcaacgagccacgtatttccgacaagttgttctcgagctccgacatgcggtgctcgagcccctgccgttgtcgctcgttgccggccaccagttccctcatcttctggaggtcctcgtgaacctccgccagatcacgcgccagccggtcggtgcgctcattcgccgacgatgccgtcgtcgccctcgcctccacgatctcgcggctaacaccgcgagcaccagcctcgaggaggtgccccatctcgacctggagctcctcccatgtgaggacggcagtcggcggaccccgaccagccgcgagatcgctggctgggccactcggcgtcacctcgcggctcctgggtacgaccacgacatctgtcgaggccatagtaggggacgcgctggaagtccctccggacccatcttgcgccgctttcacccgcgccgccctgtgaaaggctacaattgagacatgctgcaagagctcgatgaagtgataaaacctcaaagttcacccacttacttctcaccaagcgtcacaagccgctgccgtcgtggaggtgggggggacgcatccgaggcctggagtataacgggcatgatatgaggaggaagtttcccgactacgcgatgaaggacaaggagaacttaccgagagggtgggtgtctttcgacgatgtccgatcacagaggagaatttcctcccctttttcggagcgttgccgccactcgttgtggcagcagcggcagcagtgtcagacgcctccttggcgattttctccttcagcgacgccgccacctgatggtccacgagcggcctgatgatatcagtcagagggagagcctacgcttcataaagtcacaatgcgatcccggaagaaaaatgcaaaagggccgctgagtacacttacattgatggcagcttcacgttcggctgcccctctctcgcaacgggggacggggacgtcgctcgccgttgtcgggccgctgaccatcaattggccgacgcggtgctccacggttgtgctgttcaagcctgtagatcgagaccagaatccgataagtcaggaggaacacgcacataagggagtcaatttaactacaagaaaaataccccgaggagaaacccgggtcgcatcctctagcccagaatagtcaaaggctgggtgggctcgagcctggagcggctgaatccgcctaccaatgaagtcggcagcgacttcataccccgacaacccccgtactcggaggtcatcaatgggatcgataaaaattggagggacggggtcaaggcgggtttggcggtccaaggtgaaatcttgtctggttgctccgttggaacaatgaagaccggatccgaatcttctatctgaagatagaaccacctcccccgccatttgctgtgagataaggggcactggaaggggatgtatcgcgacttcaggccatcccgaaaccggaaaccgacacacccggacacctttttaggttccatccagcgcaactcatagtaaaagcggaagaggtcaagaaacggctctaccccaatgtaggcctcacaaagatgcgaaaagatactgaggaaggcgatggaattggggttcaaatggagcaaggaaaggccgtagaaattcaagaccaagagaagaaattcagaaggcggaggaagaaaatcacaaagaatatagtcctcgatctcaaccatgcgacccaggacatgttggggttcagtacctcctgcttctctctccatggtcccacgaccgggaagggcgccatcctcctgtagcttcttcagcgatgcgctggtggaggtagacttgtcaaggtccattgccgccggggatcgccggagaaaggaccgagatgagctagctagggtttttgctgaagcagagaagacgaggaacgcttggaggctggagagttttttcacaaccagcggacttcaaattggatccccaaaactcccttaaatagtcgcatttccgacggtgcaaattccaaggaaaggagagagattgccgccggaaatttctgggtccgttacgcgtggcagtttttcggacttcaatttaaattcactcatgaccgttgagcttcactgggcgttgtcaatcacttcttatccctcggtcctcacaccgagaacgacaacaacctcgacatcagaagtcacgatcgattacacgagttcatttaagcagaagtcgggggctactgtcagggttacgggtaaggtataccctctacccttcgatatacgtcatacatacgcgtatacggacgttttcggcatacgttaaggaaattcatcatggagttcacagatggaaggagtcctactcggacagaactgggtcatcattttatcgtgccgagtccgatgtctccgagtcctacttggagaccagttaacctgcgatataaaagggacccccgggaggacctaagggatcaaatctcatagtcagcacatccaccacagcctacggagttgaagccaagtcgccaggtgatctagtcgaatcaactcgactacgatctcattggtatcatcgagttctgcttctccttctgtaatctgtggtttccattatataatcccatatcaactggtttagggctattacctatcaaggggcctgaaccagtataatctttgttttctgtctgcttgatgtcgtattacgtagatcctcataccagcgtaccccactaccctctatatccggtctacgggtatcccccgtcgacagtggcgtgccaggtagggggacttggtgctcaaggttctactactatgacatccagcttcgtcgacaacagcgtcaacaccaacctcaaccaaggagttcctacttcaacaatgctggtgtggactcaagtcggcgaaatcgtcttcccggtttacaccacggtgtcgatctcggctgtccatcaatgaccgaagcgagaacacagtggctacaacccagnatgactccatgtcgaaggatcctcccgccgaagcgaagaacggaacgtcgatgacatctgagccgagaaaggatcntagtacgtccnaaccttgtctttccgacaagaatcactagccgacgaggatgatttccgaggtgacaaggtcctggtgtcctatccacaaaaccagaaaacacaacttgcaagcctgctgggtttttctcaacgtccacgcagaaattcgtgcctgcaaagagtgcggaattcagcgtacttctcaaactcgtgatgtatattgtcctattcacaagacaaagaatcacgacctctcaggctgcaaggtctttctcagcgccatgaagacgtcacctcctaaggtccaacagtcacgcatccccctcagggatgaggacaaggaacaaggagcgacggtgatttcagatcgattcgttggggtagtcgatatctatcctcacgaaccatcagtcttgcatctgctcgaagactatggctcatcgtcaacaagtatgccgcgcgaggtattggctatcgacgagaccggcacgtcagcgcgcgctaatgtggaagcggagaatcaagtgactacaccggcccagcacatcagggccgtcaacgcaatactgagggaaaccccttacgatcccgttctgaacgacgatctcgcacgatggacagaacagttgcgggaatcagtgaccaacctcagcaacgcgttcgaggaggccgctactgcagcgcacccggaacagccaccaactggcggtgctaatggtgaaaaccctaaacagcgggaattgcctcatcgagccacccctccacctcgcggcatcaacgatctccgcgatcacctgaatggccgccgagaggcgcgatgtgcacgagacaacgagaacagtttccgacatcgcgtctcttcacggcgtcacgataacgaagaacgaggaggccgtaaaaaagaagaccgagaccgtgataaccgccacaaccgctacgatcacgacgatcgcgaacggcgggtgctggncgatactggtcgagaacgccgccatancgacgacgacgacgaagatcggcgccgagacaccaacggaagacgacgacaggattctcgagaacccgaccgacgtcctcgtaatcgtacaccggaaccaagtgacccatcgtcatcgtcgtcatcttcctcatcctcatcatcagataggtatccacgaaggacgtacgaccgccgacaacccatcgcccccagcgctggttgaagagctttcagtcgttcactgcgtgatgtctgatggcctgagagatttcgaccaggagcaatagagaagtacgatggagtaccgacccagaagaattccttcaggtttactccatggtactctacgctgccggagcggacgacaacgcgttggcgaattacttgccaaccacattgaaagtctctgcgcgttcatggctgatgcatcttcccccctactcgatttcttcgtgggcagacctgtggcagcagttcatcgccaacttccaaggaacttacaagcgccacgcgatcgaagacgacctacatgcgttgacacagaatccgggtgaatccttgagggattatgttcggcgctttaatgagtgcagaaatacgatccccgaaatcaccgatgcttctgtaatccgcgctttcaagtccggtgtcagagatcgctatactacctaggagttggcaacgaggcgcgtcacgactactcggagattatttgaaattgtcgatcgttgcgctcatgcggacgacgcactgagacgcaagaacgacaaaccaaagaccggaggagagaagaaaccagccaaggacgcacccgagtcaagcaagaagaaaaattgcaagagtgggaaaaggaaagctcaagcggaagttatcgcaacagaatacgcggaccctcctaagcgccctgacccacaaggcagcgacgcgaagaaaacatggtgccctatacacaagtcagacagacactctctagaagattgcctcgtcttcaaaaagtcgctcgcaaaacacatgccattggaaaaaggcaagcgagtacgcgtggtcgagaaggacgctgaggcggctactcaggaatcgggctcagcatacccagactctgatctccatgtctcgcacatcttcggaggttccacgacatactcctcaaagcgagaatacaagaaagtggaacgtgaagtctgttcgacgtggcagggagctgcgcccaagatgaagtggtctgagcagaagatagaattctcagaagaggaccaccccaagactgctgtcatcccagggcgatatccgatcgtggtcgaacccactgttcggaatatcaaggtcgcacgagttatgatcgacgacggcagctcaatcaaccttctcttcgctagcaccttggacgcgatggggatcccacgaagcgagttgacacccaccgatcaacccttcatggaatcactactcagtcatcgtccaaaccattgggcaaaattacgttgcttgtgactttcggccaagcaaataacttccgaacggagcagatcacctttgatgtcgctgaattcgatacagcatacaatgctatcattgggagaactgcactcgcgaagttcgtggccgcatctaactacgtgtatcaagtgctcaagatgccgggaccgaagggaacaatcactattcaagggaattctaagctggcagtgcaatgcgacaagcggagcctcgacatggtcgagcacacgcccagcccacccgccacagctgagccacccaagaaagtgagcaaaacaaacaagacgccgaaaccggacggtgcaatcaagatcgttccactctctagtgccaaccccgacaagacagtcaaaatcggggcatcactaggcgggaaataggaactcgcgctcatcaccttcctccgcgaaaatgctaacgtgttcgcttggcggccgtccgacatgccgggggtacccagggaggtgattgatcacaaaatcatggtgcgacccaacgccaaaccagtaaagtaaaaactgcggagatttacaccagatcgaaaacaagccatacgagaagagctcgacaagcttctcaaagctggtttcatcagagaggtactccatccagagtggctagccaacccagtcatggtgcggaaggccaacgggaaatggagaatgtgtgtcgatttcaccgacctcaacaaggcgtgtcccaaggatcacttccctcttcctcgaatagaccaactggtggactcaacagccggttgtgagttgttgagctttctcgacgcttactccggctaccaccaaatcaacatggcgaaagaggacgaggagaagacagcattcttcacgccgttcggggtattctgctacgttaagatgccgatcggactaataaccgcaggaaacactttccaacgcacggtctagggcgcacttagcggccaactcggaaacaatgtcgaggcctacgtcgacaacattgttgttaagaccaagacaagcgactcattgattgacagtctgcgggaaacgttcgacaacctccgacgatatcgcctcatgctcaatccagagaagtgcacgttcggagtaccatcgggaaagctgcttggtttcctcgtctctagcagaggaatagaagcaaatcccgagaagatcaacgcaatcgaaaacataaagtcgcctacaagactcaaggaagtacagaagctaaccagatgcatggcggcactaagcaggttcgtcactaggatgggagagcgaggacaacccttcttcactctgctgaagaagcaagacaaatttgtatggacacaggaagccgaagaggcattcattgcactcaagcgctacctatcaaatccacctgtacttgttgccccccaacctaatgaagaattatttctctatattgccgccacgccatattccgttagcactgtcattgttgtcgagagagagaaagtgcaacgaccagtctactacgtagacaagatatccacagatccaaaaactgctctacgtggtaatcatgacatcaagaaagctacgccactacttccaagcccacagggtcaaagttgtatcctccttccctctcggtgaagtagtgagaaacaaagacgttgtcggccgcattgcgaaatgggtagtcgagctaagccaatttaatgtccgctttgtgccacgaacaaccatcaagtccaggtacttgccgacttcgtagccgattggactatgactgataacaggtcaggcaaccaaattgacaacgaaacgtggacaatggtgttcgacggcgcactcaacagccaaggagcaggggcatgattcatcttgacatcacctttgggagatcagttcaagcatgcaattcacctcaacttcagggcgaccaacaacagccgagtacgaaggactactcgccgggataagagcagcagctgcactcggagttaggtgactgatcatgaaaggggattccgaactagtcgcgaaccagatgcataaagattacaaatgctctagccccgagttatctaagtatctcgcagaagtcaggaagctggaaaaaaggttcgatgggatcgagatccgacattgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgcacctgccccgaccccgagggccgaggtgccccgaccccctgaggggtttgcactatgtacatgggttgggtgagcacagcagggctcacctaaccgcatttattgcgcatcggctaagcgtgtcacgccgcacgaagtgcagtgcagtgcactcgattatccggtctgtgaccagtcacagaccggtcagatcgcgggttaggtggcggcaggcggtctgacgcacgccttgccccatcccgtcaaggtgtgagcttctaagcacttccccccccccaactggagctagcgtgttacatcccagagatggcacgttagccccgatcgatttataccaggcttcatcctaaccattacaggcgaggtgttacacgaagaagggcaaacatgcatgttattaaactgacgcatggtggacaagaatgaccggtctgacactgatcgcatcagcaacgggcagccacgatctcacgttgcgcctgtctccgccgggagtggaggtaggtgtgggccgtcccatcggagtgtcattcggagggcaaccataccaatctccgtccataaagagaagaaaagtccagtttggaaagagaagggtgcatgtggtatccccttgaagtataaaaggaggaccttgcccatagagaaggggttggttgattctttcccggattgagtgctgagaacggggggggaagtcagctcacactttgtaactcattcatacacagatccaccaaaacacaggagtagggtattacgcttctcagcggcccgaacctgtatagatcgccggtgtctcgtgtttcttgctggcagacgatctttccacatacagagagagagcgagagcttgagattgcaccctaagcccccggccgaaccggcaaaggggggcctgcgcggtctcccggtgaggagccacgagctccgtcatctggcgcgccaggtagggggctcagtgtgtgttttctgagctctcagactcttccgcgtgcgccaagtctttcttgttcagcataatggctgagcaaggaaaagcgcacgacctctctccgagtgtgagcggcgacgacggggagccgaatccacgccgtcgagctcgtactcccccacctcctccgcgccaaagccctaagcagggggaggcgcttgagagggttgataaatccgcagcatcaccgatcgcgggtgatgcaggagaacggcgagatggggagcggcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcgtcaaggcggagggcgcggcgagcggcggcggctgcacggcattcggctgccactccctcgtcgacaccctcgactcgggaggatcagcatggggagccggatgcccgcctcgacatcgagcgccggcgtaatagccggcgtactccccgtgcaacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccattaccgagaagtacgatgggagcgtcaatcccaccgagtttctccaggtctatacgaccgggatcgaggccgctgggggtgacgacagggtcatggcgaacttctttcccatggccctaaaaggacaggcgcggggttggctgatgaacctgccacccgcgtcggtccactcctgggaagatttgtgccaacagttcaccatgaacttccaaggcacatatccgcgcccaggcgaagaagcggacttgcatgcagtgcagcgaggcgatgatgaatcgcttcgctcgtacattcagcggttttgccaagtccgcaacactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacatggaactcctccggttccggagtggcagcttcggccgcccccggatccgccgctcagacagggcggcgtgacaggaggaggaagaagaggtcggaccgctccggcgacgagggtcatgtcctcgccgtcgagggcgctccgcgggccacccgaaaggggaggcctgtgagcgacaagaagaaagaggctggtactcccagcagggagcgccccgccggcaggtggtgctccgtccacaacacctccctccacgatctcgcggactgtcgcgcagtcaaaaacctggctgagcgaacgaggaagtgggaggaggacaggaggcaggaacgccatgagggcaagtccccggcggttccttccggcaaacggcgaagtgaggccaagcagaaggcccccgccgttgacatcgatgatggtgatgatgacctaggtttccaagaacctggggccaccatcgccaccgtcgatggaggagcgtgtgctcacgtctctcgccggagcttcaaggctatgaagcgagagcttctggccatggcccctactcatgaggcgacgcgtcgggcgcggtggtcggaggttgctctcactttcgaccagaccgaccacccaccgtgcattgcccggggagggcaggttgcgatggtggtttctcccaccatctgcaacgtgaagttgggacgtgtcctcatagatggaggagcggctctcaacatcctttcccccgcggcctttgatgctatcaaggccccggggatggtgctccgaccgtcccagccgattatcggtgtgacgccggggcacacgtggccattaggtcacatcgacctaccggtcaccttcggtggacccgccaacttccgcacagagcgggtgagcttcgatgtggcggacctcagtctgccctacaacgcggtcctagggaggcccgcgttggtgaagttcatggcggcggtccactacgcctacctccagatgaagatgccgggccctggtggccccatctctgtccgtggcgaccttaaagtcgcgctcgcttgcatggagcaacgcgcggaccacctcgctgccgcgaccaagcccgagggtggtgacgagaggcttggcgcctctgcccccaccgccccgaggcagcggatggccacatgcgacgaggtcccggtcaaggaggttgccttgggcgacggcccatccaagaccacacggatcggtggtcttctggatggcaaataggaagacgcgctcgtctccttcctgcgggcaaacgctgatgtcttcgcatggagaccagcggacatgcccggggtccccagggaggtgattgagcaccgtctcgccgtgcggccgggcgcaaggccggtccggcagaaagtacggcggcaagccccggagcgtcaagccttcatccgcgaggaggtggcgagacttctagaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttatcatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaatagggcgtaatgttgaggcttatgtcgatgacttggttgtaaaaacgcgcaaccaagaaactttactttcagatctagcggaaacttttgggaacctccgctccgcccgcataaaactgaaccccgataagtgtgtgtttggtgtacctgcgggcaagcttctcgggtttttgatctctgcccgaggcattgaggccaatcccgagaagatacgagctatagagcggatccgcccccccagcaaacttagggatgtgcagtgcgtcactggttgcatggccgccctaagtcgtttcatatcgaggctgggagagaaggcgctgcccttgtttaagctcctcaagcgctcagggccgtttacttggacggaggaagctgaaaatgcccttgcccagttgaaggcgtatctcagctctcctccagttctggtcgccccggagccaaatgagtccctgctactttacttagcggcgaccccccaagtggttagtgcggcgttagttgtggagcgcgatgaggacaatcctcatcctgcgcacccctactccgtgccgacttggcccgggagcaagcagggaggagaggcccccgagtcaaacggtggcctaaggcccctgacgaccggagacggccctctacccgcttgtcagacggtgctgggtgcccccgaccctcaggaaggccccgaggccactgcgggaaggccgcacttaacgccctctgaccccgaggctaaccctgtgctgactcgacccgggaaagagcaggaagaagaggcccccgagccgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaagacaagtgcgccccgaaaggccacttgaacgaaaaacgccccgggggtacggcccctagcgaagaggatcggccccgccgaaaggtgcagcggcctgtctactttgttagtgaggccctccgggacgccaagacccgatacccgcaggcccagaagatgctttacgctattctgatggcctcgaggaaactgcgccattatttccaggcgcatcgggtcactgtggttacgtcttaccccctcgggcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcacgaacccctctcagctgcctcacaccgcccactgggtgatgcagttcgacggttctctgtctctccagggcgccggtgcgggggtcacgttgacctccccaaacggagacgtcctcagatacctggtccgtctcgactttcgagcgaccaataatatggcagagtacgagggactccttgccggactcagggtggcagctgggctggggatccgccgcctcctggtgttaggcgactctcagctggttgttaaccaagtctgtaaggagtaccggtgctctgacccgcagatggacgcctacgtacgccaagtgcggcgtatggagcgccattttgatgggatagagcttcggcatgtacccagacgggataacatggttgccgacgaactctcacggctcgcgtcctcgcgagcccagaccccaccgggcgcctttgaagaaaggcttacccagtcgtcggcgcgacccgaccccttaggggagacggatgcgcctgaccggcccccgaggcccgtcggagtccaggcctcgggacccgaagagagcgctccaagctcccttagattgattgcttggatctctgagatccaaacatacctcacagataagactctacctgaggaccgcgaagggagtgaacgcgtacaacgcatttccaaacgctatgtgctgatagaagggaccctctatcggcgcgcggctaacggaatcctcctgaagtgcattcctcaggaacaaggcgttgagcttcttgctgacatccatgagggcgagtgcggagcccattccgcctcgcgtaccctggttggcaaggcctttcgtcaaggattttattggccgacggctctcaatgacgcggtcgatctggtccggcgatgcagagcgtgtcagttccacgccaagcaaatccatcagccggcccaggccctgcagatcataccgctgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaatcgtattattacggataatggcacccaattcactagtgaactcttcggcgactactgcgaagacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctgggcgaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctgaaggggggggtcgggtgtcaggttttggctcgggctaaccccgcacccccctcgggtgtgcagggttagccgggggctaccacacatgcacatatattcctttcagcatttcaataaaagcagtttcaaattcctaaaggttgtgtctgtgccgtttttccttctgaaaaaatcttaacttgaaataaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgcctttcgaagactgggacttgggcacgggcccttaaatcaggctaagacacaaaaagaggatcacggcacagatcatcctcaactcattgcatagcaaaataaaactaacacaaaaattttttcatcatttctgattgcagattaagttaatttgtacaaaagagaggcatgaaggccttagaagaaagaaaaagaaaaaagataagattggcgggggcctgggggctcattccgatgcgcccgggtcgccggcctcgtcgccaccgtcgtcctcaccgctggcgtcgccctcctcgtcggagtcaggggcgaacgcgagccgaggggccgagccctcgaagctgttgacgatgtggtcggcagcatccccgacccgcgcgcgcgcgtcgtcctcggtcccgggagggaactcctccagcgccatccagggagagaagctggggtcccgggcctggtaactcgccagcacgagttcgaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggccggcttgccgaccggcgcgcttcatgcgggagaccgcatcccaaagcatgtcgggcccaatctcgcccgccaagcgaagggcctcggcctccccggtggaggagtccagcgctcgctgcatctccgcgacggtgtgttcggcagctgcgaggcgggcggctaagtcgctttcgcccgcggccgccccgccgacaggcgtcctcgcgtccagctccttttcccgtgcctcgaggtcagcagcccgctgctccagtgcggctctctcggtgcggacgcactcaagattgcggcgcgcctgctcctcctgcgccgcctcgcgaagggacaggctgtccgccagccgtctggtcgtggcctcagcatcctcgagagctcgctcccgctcagcgagtgcgtcctcgcggaggcggagcgcgcaatcctcctcggcgcaggcggcctcgtgcgccgccagcgtcgcctcccggagagcagcggcgacctcgcggtccgtcaagcccctctccacggcgccggcgtgttcttctagcgccatggcacgggcctcaagggtctcctcgcgccgccgagacgccgcttcagtctccgttacccgccgctctcgggcagcggcggagtcaaggaccccttgggcggcgttgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgccttgcgggcttcaagctccgagatgtggcggcggtgggccttacggcccacctccaccatggcgtccaccgagcgccgcccctcctcgacacgcgcccatgcggcctcgagctccgctcgttccgcccgcagggcctccacttgggtgttgaacccatccagcactgcggtgtttgcggcggccagggcctgcagaaggggctcggcgctcagcggggcgacagaagaagaggagaagagccgccttggggaaaaggcgacgcggcttggccccccggaggatgcgctgggctcggggatgtcccccgggcccgtttggtcctgggcgtcgcccggtgaggtaggcccaggcgatgcgccagcagcctcgtcgcgagccgcctcggaggatgtcgcttgagggccgcccgagggagtgggcccaagtgatgcgccagcggcagctgtcgcctcagcctggcgagcccgggcggcctcctcccgagcagcttcttcggcttggcgagcccgggcggcctcctcccgagcagcttcttcggcttggcgagcccgggcggcctcccgggcggcctcttcagcttcccgaaggcgatctgcggcttcacgccggtcagcttctcgcctccgctcctctgcggccgccggatcttcggcctcggactggccggacttggggtggcgggaggaatgcgacgggacatcgctgaagcagaagaaaaaaccaaaagacgaacaaaatgagcaagaaaaaacttctttttggagaaagatggttgcaatgagagtgagacgaacctgcgagggggacgggtgaatgaccaccttggaggggaaatcaggtttccccggcatggctccgtctcccccgtcttgcggagccgcttctttttgcgctccccctcgggctgcgacgtcggcgcggccccctccgggcgccgactgctggcacgtgtcgccccgccccctcggggaggagatgggggaggtgttcctcccagcttcctcttccccggggcgtcggcagggcggctgctccccgagaccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaaggttcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcggcggaggtaatcgccgtacaccattgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaaacagtagttgaaggcagtaaaacagttgtagtaattaatcaatattaaccaaacactgtccaacgctaccccacgttgcaacaggcccaaccaaccacctgaactacaccagttcattaagctaaactaggaatgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaatcatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggaaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctagtcattttgatacccaagttatcaacggcatatggtaaacaatatgtggctgaggaataggacccatcccacattacattgtaaaagaatgcaacatttaatagaaatgcgggatatttgtaaattgggtacaatatgatcaaacgtatttcatgacttgccttgctctcgcactgacgagacctcagcaacgtcttcgagaaaccgtggatcgacaaaacggccgaaacctacgcgacaaacaaagcacacaagcaaaacaggctataagactactgaaacagggaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcgaggggagggggtggcgccgacaggcgggccccactgatcagcggcactaagggggggagagggggcggctggcaagcgggccccacgggcagtggctcaagggggagggagtgggcggcgacatgctcggcacggctcaagccggccggccatggcgaggcgacgacggcgcacgaccgccggcggtgaccggcggcgcggggagacggcggcggccggcgcgaaggcggcggcggcagccgaagacgacggcgcacgcgcggagggcggcggcgctcacggggggagaggaaaggaaggaggaaaggggattcctcaccgaggcgatggcggcgaccggcgtgggaagagacgagcggcgatgaccggcgacgcggaggcacggacgggcggcggcgacaccctaggagaagatggagaggcgttaggagaggagacgacgaccacggcggcttgaattgtcggccggagatggaggggagggaaaaactcaccggctcgcgaggggagaggtgctccggtgggattccggcgacgcgaggcggcggccgggaaagctcttgcggcggcgaagctaacggcggcggcggtttggcgcggcggcgactctagcggcggcggctcgcggccgaaggcggcggcaagcggcggcactagcaacaagcggcgcgagcgcgataggaggcacgggagagcgcggcgagtgcgaaaaacgagagaggaagacgcggggagcgatttataggtgcgggagggggcggacgtggccggggaggtggccgatttggccggcgacgtggggagtggagggagagtgagagaggtggattcgaaatcgaatcccgccctctcgagcgcgcgcgcgggccgggagatgcgggggaagaggcggcgacgtgggcgcgaggtgcgggcgcggagagggacggagaaggcgggcggcgtggggaggtggggcgccggcggttggggctcggctccaaccggctagaggaggaagacgaccgacaggtgggccccacctgtcggcgcccgaaggagagagggagggagggaggacttcggggaggggaaaggggaacgggccggcccacaaggggaggccgagcgcgggcgacgggtggactgggccgacggcccaagaagaggaaaaaggaggaaacaggaaaaagaaaaagaaaagaaaggattttcctgggatttaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaatttttaaagcaagcaaaaggggggaaacttcagggcgtgacaaccatggccccggtgagcccctgggatcgcaggcccaccaggcggtcgaggacggcgtcgtactcctcccccagatctaccggcgcccgccagctggagacctgcgccgggggctggcttggaagtcggaggcgcgcttcgttggcgagggaggtgtagaaccagtcgctcttccagtcgtcccacttcttgcggaggacgcaggggatgtagcggttcagcaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaatgagaaaatggcgggaccagcccagccatcgcgaaggggaggaagaagatggaccgccccgggtagtctggtgccgggcgccccttgcccagcatcactatctcccgaccggtggcggactccggcatgaagcggcgcggcagtccggcgtgcctctcattcacaatgcgggaaggcggtagcacgctgccgtcgagcagagcagagccccgtgccatggcggcggaggatgagatgattgagaacgagcgcgtgtggcgaaagtggggcgtagcagagaaagggttagagctcaggtggcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctcgtttcccgcgcccacgcttccactaatcccattcgcccgcttacggcgcatgaagtggatatgcggttgtggcattcgaaatggatcgtatcgtgcgcgcgttaattacgctcgccgaccgaagcggcgttaccgtatctccgggcgagacaaatctgctcacccagattcgcgcgccgctcaagtggtgtggcagtcttgaatagccgcccattatggacaaccaaagttatcaataccaatgtgcatggattgagaccgttgggtattttgcccaactacggagaccggtcccacctgtcaccaggctttaggggtggcgtcacacctgaccgcttcccttgggaaggaaaattgctctggcataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggg

SEQ ID NO: 59215 - DNA, 657 bp, Oryza sativa
tgaatagtgccgatacctttcggtgtgcagttggcatttgggagcttccgctatggatgctttggttaacagggtctccgaggtgaaaaccttgctccgcttctggtgctagcaacggtgactccctcgagtgccgttctccttctttaaggcgttgcttttggagccctcgtttcaactccacttcaagggaattctccgggtgaaaactttagattcgttaggatcggaagttgccgtcgttctgtcggcgttaccttcttgaaggctttgttttaggagtttcttctctttgttggactactgttctttggttcagtttgtcaatgccgggttttcaccggttttcatgaaattaaccgtgttgttgtaagatttttgggtccagttttccttataaactggatcgactatcttcttctatagtgaaattgcaggagctccctgcatgtcccctcgaaaaaaaagaatgtgtttgaccatgaaaaatctacggaaccctaacttcagacgacccatctacagatatgcaccctgctcaatagagattgcttgcgtccgatctatcgagccccatcaagaacataggcaatggaagcatgcttggctccggcgaaacgaaggacggtccagcgaactctggcgagcgaaacgaag

SEQ ID NO: 59216 - DNA, 6343 bp, Oryza sativa
agaagtctccttgcacgacgacgacgccggcggccgcggggaggcgggcggcgaaaaaccggccgtcgaggaggccgaggcgccccgtgcggcgcgggcggtgcagcgctaggtcgagggcgcgcgacgcccgcggcgccgcggaggaggcgaagatgccgccgtcgaaatggcgggggaggggcattctccggcggggtggctccgttgcggcggcgacgctaggtcacgaggcggaggcggaggtggaggcgcaaggcgggagccccgggagacgaagggggtggaaatttcgggcgggtcgcgagtcgcaacaaggtgccgtgctgcagggtcggtcggtcgcacggcacgagccggctcacgttccgggtgcgacctgaatgagcgaacccagccagatcggtcggtcacacgacacgagtcggctcacgttccggggtgcgacctgaatgagcgaacccagccagatggtggtgcggttcgtttcgaacgcgatccatatgtactaggtatatttttcgtgaaaggtaaatccccaaatatcatatggttgatccacgtaagcaaaagaaatataaatatgatagagaaatattgggcttgtttgggaagctttagattcggagaagtagctgtttggtagccagcttctaacaatctagaaaagctctgaaacccagcttctccagtttttagcttcttagtttatttttcagaatctgtaactatatattctcagaagctgtggattgtttggaacagcttctagcaaaagcagctttttaaaaaagatgtccaaacagaacctgtacaagataaaaataacattggacctacatgtcatattctaccttttcctcctactcgccctaaccttcactccatgcgacggagccagtccacgtggtggctggcacgggtacgggcaagggcaacgctgcatgacaggattagacggagaccatggccgcacgggcagaggccggtgtgggggcaccatgcgacaggccaggccgcgtggtggatatttcggacctctcacgttatttctctctcttattcaacaaaaaataaatattctaatgattatggtgttcaacaactaatatccatctttcgagaatatctatttttaaagattgactttcgccgtgtcctgaagataaaaccgcagtcgtagtgtcaatttgtcaattataaaactctgttttacatatgaatttaaagtttgcagtcggtagataatttattgtcataataatattgtttattacatatcaaaacaaatgtgcttgctaactagactttatgataatttcattccctaatacattaatttatataagctaaacaatgctaatatgttcccaacatttgtgagttacgtcaatttcatgtccaccatttacacaaatgatcactatgattgggggcctaaccttattcacctacatatcatgttcaaacccctctatttattatattataaacgggccctcaacctatttaataaaaattggtcaagttataaatgcaccttaatcctctatctagacatggattatttgaaaaacatttacaaataaacccttatcttatatttataaacctcaatagactaaaaataatttattcaaataacatgtaaagacatccaatacagagccagattaaagttgcacgaatgtgcgactatttgcactagtaaaagggtgaaagcaaaatcgtttttaactcaaaagcaacacaaacaaataaaataaaaggtcatcataattgtgataattacaaaatatggtatatcattccagtgcaagatttcctctcccatctatggcatgctacttcaacgacctgactcatttccaacaaaggaaatactgtaaaatagtacattttcataggagaaattataagcgatctaggcacaatttcactatataaacccctctttgaatttgaataaagaatgtcattgtttagcaaaaagaaggcatctaagtgatgtttccactgctacgacgacataccgctttttatcagctttgaagatttttctaccgcttctagctcaataatcagccaaaaataagactatctttcagctggaatttgtttcatatattcaaatataaaggagtcgattcaagtaattcatgtggggcgcgtggtaaaaaccattgctttcggacttccattacatatgtcaaactgcaagttagacgtgtgtggatgcaaattgtgcaccagatatccaaaatatgttattaacatgtgtccaataagaaaatactactgtacttacctaaatctatcatgatgtagatgccaaaaaggggaaacacttttttcacattccaattttgcctttgtatatgttaatcctcatctaagcaggtgaaatgaatgttatacaccacatagcagtaaattacaggctacaacagtgcataaagtataaatgattccattagtttttgccacaagaagttcccctgccatttagtgcaactttccagaccatgttaaaaacgaaatgtcatttgtaccaaagtttccttcatcagcacttttcctaagagcagctgcaagaatggagatcaaattttgttaaacgggagtaaaaaggaaaggaaatggacttttttttaggacatgctaaaaaatcatcttggttaccagtgtatcagaagcaattgtacgcatagtgatcattttgcagcttttggtggataaaactctctcatgtactgattatcctctgcatgcaagaatataatacaagtactgggagggaaaaggtaacactgtcaaaaatattttcagattacttactccgcaaaaatggtgattccttaatccagcctaaatgacgtatttctgcaatgagtttcaccatatatgtagggcactctttcatcagcagcctcacaacggctttcctgtcctccactgtttcctgtatgaaacagtacatgggaagattaagaaaaatctaaactactttaaaataagcaagtggtgggggtgagtgaccaatctaccggactaccaccaaccacatcaccaactcactacttttttgtgaaggtaaaaaaggagtgtggagccaaagagcccacccgtcagctaaaatgtatacggagaaattaacaaaatgagaaatgtagaaagcgatgacgaaacaggtcgatctgaatgtaatataaattctttgcagtaaagggtgccaaacaacatgtccacatataagtattctaagtttacatagaaacaattttaagtccttcatgcataaattcataccgatccaaattaattgaaaaaaattaacaaaattgcaaaaacagctaacgcacctttgctccactgtatcctttgattaaatcgtctcggtgtgcaaccatgtaaactctgaggaagaataaggagttatacaagcttttgtcattgatttctttgtttggctctcttgatttgttcacctccaacttgtcaatgcagcttttgagaccaagagatgctctaagcttaagctgggatatttttgcctcatcgttgttatagtgccaatatatctccctgataaattgcactttgctgttatgttcccataatccagcttcccacaccagatcttcatacctgtacaccattattttgtatcaacttgggtgcaatgctaaaagaatacctaaaattatttttgtaaggaagtgttacttactttactgtttttttcccaagaagttcagcaaaatggtttagttctgcgtgaagtccaaggtttttatggagcttttgaagaagctgccccaaaccattccaatttgcaacctttagctcatcaacagttggtactgctaagaaaagagagattactcacaagttaggtgacttaagtatattgacaaaactactatgttatacaaattctctcctcaataagagacataaatttcatgaaacaccatgttttctgacatttctaatgtaaaaccccatttctataacttgtataaaggatccctggatttgagaccaaaatatttcagaatttctttttgataaacagaagcaaagctgattcatttcattgattaaaaagagtacaaacatcaaaaccaaacaaaaggggaaacaattaacaaaatattttagattaatcctgattcgcatgtgttcaacatgtctgtggatatacctgtgctagaagctttacccttgcctttccggttatttctcgcattaccggttggtgaaatctccaacttgaagtcagttaacaggacacggtagtcccgctgagcgttcaactggtaaaatattttactttcatcaaaattcaatgccttcaaaggtatttgttcatcatcatataggtcattgacatatttgacggccataaacatttctctgcgaaaaaggtaaaagtatcatctaatgctataaaataaaggcaataacccaaatattaattctgcatctgtgtaacacatacatgcttacaagcttaacccatgcatctgcactgtctcgacatgtttgttattattttgatctatataaattaatctacttttgtcgaatgggcaacaagaaaattcgaaaagtaacatgcttgcatgtatcaggatagtcctgtatggttaaaactatagatcaagctaattaaatcaaacatgaatgcattttcctgctatgcaaagactactttttgcctaaatccatttgtgtttctacagaatcccaaccataattagacatatcttcattatgtgaacagttgagatgtttttttcctctctattaattccagaacttttagttattttcaatcaatacagtaatttctagtctatgaacttgttgatctcaagcctctaagaagaatgtaacatttaaactgacacttacacaaaaattttgcatccttggtcagtgaagccaaatgtataagatttgtcattcgtggcatcctccacatcaaatatttcttctgttggaattaaactcagtggtccatcaaagcatggaaaaacaatatatgccagcttcgtccccttttcttcccaaattccaataggttcaatgatgttgctgtgggagcaacttgcaaggatgtcaaaaagtgcatgagcatgttccaatcttctacacactgctacacatttctcttgttgaccttccggatatgacaacatagcattatatgccacactatcaacaactttgctggcataaactgtcaagtttctgcttcggttttgaatttcaatctgcacaaattaaaaccgtaataggataaggtatttcctatttgtcttattgttttatttgcatcaaataatataaaagttgaaattcaccttagagtctccagggattttaattggcattctgaaaaacaaaacatttcttttgtaagataattttcatagcatgaacttaagtaagaaagaactagtaaagggtgagaaagaactaacgatggatcaggaataggtagattagccacaattgactcattcactttcctttttggagccatcagtaactctgcattgaattgattaaaaccaagagttaggtttcatagcaattgtgtttacccaactttttctaaaggagtggacccttggaacataaagccttaaaagctggcccaaacctatctgagcactccatgtaagactaatccgaccacacaaaatgtttatactatgtgggcccaaaccagcatacaaatgtgaaccaaacagaacacaagtgacaacacatatatcagtaggaaagaaaattaattatggagagcacatagcataaatcgaatccatctgctgtttcaagttgcacaacaagaatacaacaaagagagcataaaaatgttttatcacaacaatattattataccacaagcttatcaggttttatagcacaacaatattattattaataggtttatagcataaaaaggcttattgaaacataaagtcatataagcttaggtagctaagttgggagtgggtatttcagcaatgcccaccccattaatcaaaagcaatgagaaactaacacacaaaaatagtgcacaattagtgaattgttatggtgttagtgaccaaaagttagcgagatgcatactggttgtaaatgatggagtatgcattatagtgcaattaactaatagagccaatgagacccaacatctaacaattcgtctgaatcaaaacacttgaaacatgaggcaaatctaacagcttgcccacatttacaattggtacaaattaatgtcctgaaaggaatctgaaatgagtaggtggttagtttgttggataag

SEQ ID NO: 59217 - DNA, 1054 bp, Oryza sativa
ggaagaactggctggggcggcctcggccgggctctaagtagccaacgtcagcgccaacttacttggcgctgaggttgggcacatcagcgccgaagcggttggcgctgaggtagctgccacgtcagctaggggatcggcccggccgccacggtggcacaatgtcagcgccagtcccgttggcgctgacacagccaacctcagcgccaatgcgcttggcgctgagccgacggcctagttttggttgaagtttttggcaggggttagtttcgaaataagtttttgaaaagggttaatttgtcaaaaaaacggcatatatggctatacattcctaataaaatatagtagcttcagaagtaatagcagtacaactacacttgaagttattggttgtctacagatccagctaaaagataccaagtaactccagctaggggccattaatctaactcgtttcgtacccttggcaggaacacgaatggcgttctttcacccaaccacactagcatagttgtcaactagcagcataacatgctatgtatttgctctctgtgatgcttagtatgggatgagtgatacagaaattgagcaagagcaacagcaggcctccaatcaaaacccaagaaattaacaactgtatactgatacaacctccacctttacatggtaattgataaaactgatgcactgtatttattatccacaaagaaagattcatttgaagaacagaatctcatgctggtcttcagtccttctctcaaattcttttcaaaattatcataaagttcacgtaccaggtacagttgaacatatgtattgtagcttcagaagtactaacagtacagtacagtggacttgacattatcaacggtaatattgtgattgtctttaaacctaataagaacaccaatcaattctttggtttatcaaaaatgatggtgttgtagcatgggataaactccgtccccccatgctcgtccggaaacatatgctaagaaaaaaaatgagttcgagtcaaattatttgctcaaatgaagtttccatgcaaagtgatttt

SEQ ID NO: 59218 - DNA, 27304 bp, Oryza sativa
cctctcccatattcctcctccccttctcctctttatactacagtagactacacaaatttttttgaaaaataaaagttagaaaaatttatgtatagaaatactatatataaaaaatttgaattcaaattcaaatttgaatcgagtatgtaaacttttgacttataaactttgggtctataaactttaggtgtataaactttagatgtatagaaatactatatatagaaaatatttgaattcaaattcaaatttgaataagatataattcaaattcaaatttgaatcgggtatataaactttaggtctataaacttactttaggtctaaagtttaaactttaggtgtataaactttagatgtatagaaatactatatatgaaaaatatttgaattcaaattcaaatttgaatcggatatttgaattcaaattcaaatttgaaacgggtatataaacttttgacttataaactttaggtctataaactttaggtgtataaactttagatgtatagaaatactatatatatataaatatttgaattcaaattcaaatttgaataggatgtataaacttttgacttataaatttttggtctctaaactttagatgtgtaaactttaggtgtataaatttactaaaataggaaagtaatgcggtgccaacaaaggaaacaaggtggagagatggagggaaggagggggggggggcgcaaaaactgatcgccctgagcgattaagggcgatcgctcgcccagtagcattcctggccaaggacgattgaaacaacaagcaaccaatcgtcaaaatcaatttatttatccaaaccctctatattctacatatatctccctccttcttgctacctatctcaaattttattatcctcaaatcctcaattgcttggcatctgtcgtttccacggtattagaagatgccctagcttgcctgccgagcttaggataaaccaacgttcgttcaccctggcaggtgggtgttcgttgggcgcaagttgcacataacgtgctaagatgtggtgttgtgattctacgtcaacatgaacaatcttaaaaatacataaagagattacattacgtagaacacataccgcattacatatgcgaataaatagagacaacgacacacaggagcactctgaaacgcgcattatttttcacctgaaaggcaatgcttatgcactgactccaagtctccaacacatatatcgaccgatcgatctcacacacagtcacactcctctcacatctcacaacttttatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgttgacgacagcggcacgatcttggacggctcctgcccggggcacggcgtgctgctcgtcgcgctgtgcagctgcgcgaagcagtcggcggcgccgtggaggtcgtcggcggcgaggggcacgctgaaggcgccgtcgccgtcgaggtcgccgacggcctagctctcgtactcgccgtcgccgttcctgcacttgatcgccacctggagacctgaacatcaccaaacaattaatcaacgacggtgatatatcgatcgatcgagctgagtacgcaattaattagcgatgaacatattatcatcatcatcatgatatatatacccttgaaagcatcctgccccttcatgttcttgctggagcagtcgccgcacttggccaacccgacgacgatcgccgccgcctcgccgtccgcagcggcggtgacagccatcacgagggcagtgcagacgatggcggcgaagagtagtgctcgtgctacagctgccattgctgataaatcctcgcaaactctatgtagcaagaggctagagctgtgtgtggatgagtgaagaaaaagcaggctatgcatgtggtttatatagatcgataaaggctactagctgggagtgatctgaggtcagctaattatattacaacatgattagcaatttgcgccgaatttgcaggtttaaaatcattaacgccgtgcattttatttgatttgatcagacaccgatcgattaagagtagcagctagtagttcatggaggcactgtgaacattcacactgcatgcagtgctgactgttgatgcacttgccgccgattggtggtgtttaacaaggaaagttaagctttaatcgactggtactcctacagcgcacagtactactagcctgttttataaaaagggagaatagttctatagtataggacagctccaaccaaattgcatgattgatactatttttcagtaaatgagtaaatttcacaaaaactacagatactttgatcaaactattgcaaaactactgatttaaggtgttatatcataaaaactacagatttagtgttaagtttatcacaaaactacagatttaatttgaaatatatggtcacaaagctatagattaagtaacaaaattatcataaaactacaagtttagtgccaatttaatcacaaaactacaacatttatagctcaaacataatggtggtgctatagatttgacctcaaaattttgtagttttgtgataacttcaatgttaaatatataattaattacgtgatacttgaccttaaatatgtaggtttctgataaatttgatgctaaatctgtggttttgtgatagttcgatcaacatatccgccttataaacatatgattggaacacagtcgtgagtgtataagtgcggtgtatgtatttagtggtgactacgtgcatcttgtctgtataatggtagagaatatacttgttgacggtatataatagtttttttaaagtatagaagatgttggtatcaaagtatacgcgagattgccgtaaagtaaacgagagacagagatttttatattgattcaggccccgatgtgggtaatagccataatccagtttatatgaatatctctagaatgtatcaaactgattacaatgggggagcaagctagctaatctagcctaccaacaagcattcaccaagaattaatccaacgacttagaatcatcggctagctattgacttcctcctgattgatattcgatgtgacttgtggctatggcttatgattcgatgctctttgatctctcctaggggctatatatttatacggacaatcaatttcttgttaagtagaattcgaggagttcatatgggatacgagcaggtaagagttttgccagatcctgtagtcagcggtacacgagcataacccaagagtcttagcgatgagattgccgaagctttcaaaaacacttttggcatagatactagggttaaaaagcgtatagatcaaaaactctaccctgaccactattataatgctccatatcctcaagggtttagactgcctcattgtgtaagttcactggagaacatggctgatctactttagaggatatcgaccaatttatttgtcgggtcccaaaattaaaaacttggatccggctgagattaatgtatcaacccctggatcagtaaatattgatacataatatgcaactggttcttcattgcatacgttaaattttacaatactaaggttttacaagaataggtactcacataagtaagactattacatagaggttttatacattctgactagggaggtataacctctagggattttctatgttattggagtcatcgtagtaataatcataggagtcttcttcttgacccaaatctgaaaaaggggttataagagcaagggtgagtattcacaatacccggcaagttaccatggaaacatgttatgtgttggtatagagtagagttctttgcaaaagacaataataaacaatctggaagtattaaagcaagagtttgtaaatacatagactttaggtttctaaccagagtactatatgggtctcggtactcaattccatgagtacggccattcgaatagtttcatgaatattctactacagtagatgtacgctttactcgcagtccacgacttgccaatattcattagcttagtcatgacccagtattaggttattaacaattgtggtacctgttccatgaactctagtcctcatgcgctctgaacgtaacgttatcagcagcgagaggagttctggtgttcccggggtatttaagggggatctcgtatgacaccacgtcatctcgatcagggtttagaattataacataataatttatactcgagtatcatcgaccatttacttgtacatggtaatggtaaaaattgcccttcgtggctatagttgcctcttgctcgaggacttaaaaataagaaccacgatacagaggtaccacattgctaattaatataatgactaggtatgtccctattctagaaactatggtcgtacctgttcgttcgacataagtacctggtaataactatatcgatcgagacagtactagccacccgaaaatcatccaattcctacgtactgtcccaatctaagtatgaaatatttagaccagattgtaagcaaaataagcaatactaaattgtttgggtttctatggttgaattatgcatataaaatagagtattgaatagaaggctataaataaataatttgtaaaatataggcttaaatgatcaaaaggtagaatagtaacttgccttgctcgatgtcctgagattgactgatattatctaatatgtcagaggactcttcaagacctagggttaaacatataaaattcaaattcaaaaggaattcaaataaaatccaaaaataggaaaaataaaataaaatagaaaaatagcaaaagtagactcaaaagatagagaatgattttagaagaattttggtccaagtttcactggaattggatctatattttaaaagatatgagcttctaaagtttgaaaatcaaattaaatgtgaaatgatactgtgtgcgggtcccacctgtcagtctctttctctcttctcttcttcaacctctagccgttccccatttacggccggcggtgctagggttagcgatttcggcggtgatagagggggaaagggggttgcggccgaggaggggaggtagctagggttctccggcgacggcgagtggcggcggaggggttaatttgatgtgtgggtgggctaacggctagggcggcggtgacatggataggccgtgaaggtgatcggggtggtgagagttaggcatagcacggggagggttcctagagcatctacggggtacttagaaggatttaggtagcttgccgactttcggcaaggtgtggaagaacttgccgacgagcacctccattggcgacggacgagctcatgtcggcagcccagaaggtggcatggtaatgctggccgattgcgaatatggaatctagggagtacgtagatggttaaaatgaaagaactcaccgagataggctgagacgacggattgcggccggaaaaacttctcggcggtgagaaccagagcagagcaggggcgacagtgcttagctcggtgcgacgaggtgaaactcgacgcaaagcttcggttaggctccaatatgctagagcatggttgatattaggtgttctaaggattagttaggatggagagtggatggaggggcgtgaagtcaatcgcacacaaggtgttcgaccgacgggcggaagtggttgatggtatggtttggcaaagcagagcttcagggttgtggggttatggttgatgatgatcgatgatggacaaggaagggattggggtcctatttatagggccagaagaagtggatgagctcgggcgccatcaacgccattgatgagcttggaaattgagcacggcaggggtggcagggagctgtgagagggagggcaagatcaatttgagtggcgggaggccacgttcgaattcttactgacgaaggcttgacttgaccatgggtgaaaacgtctggcgacgtgttggcgccaatccgggctcgacgcgcggcagcggcgagggttaaaacggtcagcatggcggtggtcggtttgaattgtgataggggaaaccaccgcttatcttcaatccaacagtgcggcaagaattggcgcgattcaccccgggtagaagcgaattcggacttggcggcggctttggacgggcgtgcacagcgtcgagcggcggtaacttgcggcggaggtcatcctggcttcgtcttcatcacgattggtgcggtggcggtggtcttagggcgtcgaacgactagcggcgcgccaaggcggtcgggcacacgcgaacggccctgaagccgacgcgcggcggctcggcgtgcggcgatggaggatgccagggtggcgcaagtaaagggggtggaaaaggcaaagtgaaccacagttttggatgggttgtggtccccaaggatcaaacttagactttgcaaaggtttgggtagatgttgggctgagatagttgggctgggcatttcatcgaacaccttgagggcaatgaatagtgttttcagaaattttgaatatttttcctagaaaagaatgaatttaatctataagtttgaaagggtttcactagggtttagagtatagaaaattctcactaatgaaagggggtaaactaaagaaatatactaaagttcgaaatttgtgagaatttgctaaaattcactaagttttaggataaagggaataattagggtaagttaaaagagttctaaaggaataatacttgaaccaataaaaggattcaaataaaattttaaattgtactaatctagtcaaaaaccagcatgatgcagtcaaattttagtttaaaatttgaggatgttacattattatacaatgcgaagaagcctagctagtagtattttgaaacttaggcttttcccattgtctttatttggtgatgcatttacttgggtttatttcacttgcaccaactctattcatgattggtctgagttagaacaaaaatatcatgattacttctttaattagtggtgagtccgaattaaatttgtcgtacttaatatcggttaaaaaaagtataatgagcctacttttgatctacattagaagattttatatatacaagaaaccgatgttatagtttaacactttctgataaggtcttggtagatttgccttattctggtttacttgaatatttaaaagaaaagctagatggtcatactttcttagatgtaagccaattacttcaaatggctttgactcaagagagccaagttaaagaggccaaaatctcatagaaatttatgtctgattgttcccatgttaatatagtttatgaacaagaatctttgaacaatgagacagttgatgtatacatagacgaatgggtttggaactccaactctaaaccattcgtttgctccgttcttaagctggttagtcgtaagaatcgacaagaggaaataacgttcacttttgatgtggccaaatgcaattagaaacaaaggtagctcatccacctgcattaccttttcctatacagactgctgaattgcaagagaaggagattcccgatggcaaggagaagaccacattgaagacttcaatacttagggggcaaggtgacaatctggagatatcaaaatatgacaagcaaccaaggagatcaagttcatctaccaagcgagtatgcaccaccggcaactaacttctccttcttcatggtattacacttggagaccacattgaagacttcaatacttaggaggcaagatgacaatctggagatatcaaaatatgacaagcaaccaaggagatcaagttcatctaccaagtgagtatgcaccaccggcaacttacttctccttcttcatggtattacgcttggtttgcattatggagttttaatggtatgtggatgatgcctatttatataccatattatcatccattatgggcattgccggttgccacattgaccgattttaaataatcaaccacactcatctcatagccggttgagagaaaataatcagtcacaaaagaatccacacaagaaagtggcgaggcaagagtggaggctaaagaaaaacaaaatacaatctgaacaagaggggcctctcgtagctttcttacatcaccattaaacatttaagccttagaggcattcatggccggtattggtggatatcgcccttagatgatctcatgcatagtattttttggctcacaagtttgccgaaaagacaggggggcatgtgttgataatcaaatttggcagtagagtcgagttatagcaagtttgagccaaatttataaaatgccagagctttcccgcgaagactggtgtgaccgttattatgtggccggtcaaaccggacaatgcactgtgattagaccataggtatccaggcggttagaccttaatcacatagtccgagtccaatttaatttagatacttctcgtgttttcttgttttacaccaaaatttttgagtcctagttgatttatatgcctaattgcatatgaaaaaaccccaggaagcaagtccacccctcctataaatataagggggccaaggacggggggccctaatgggcgatcgatcgccaggcgatcgcctgggcgatcggatccagcccccctccccctatactccctcctctcccctattcctcctccccttctcctctttatactacagtagactacacaaatttttttgaaaaataaaagttagaaaaatttatgtatagaaatactatatataaaaaatttgaattcaaattcaaatttgaatcgagtatgtaaacttttgacttataaactttgggtctataaactttaggtgtataaactttagatgtatagaaatactatatatagaaaatatttgaattcaaattcaaatttgaataagatataattcaaattcaaatttgaatcgggtatataaactttaggtctataaacttactttaggtctaaagtttaaactttaggtgtataaactttagatgtatagaaatactatatatgaaaaatatttgaattcaaattcaaatttgaatcggatatttgaattcaaattcaaatttgaaacgggtatataaacttttgacttataaactttaggtctataaactttaggtgtataaactttagatgtatagaaatactatatatatataaatatttgaattcaaattcaaatttgaataggatgtataaacttttgacttataaatttttggtctctaaactttagatgtgtaaactttaggtgtataaatttactaaaataggaaagtaatgcggtgccaacaaaggaaacaaggtggagagatggagggaaggagggggggggggcgcaaaaactgatcgccctgagcgattaagggcgatcgctcgcccagtagcattcctggccaaggacgattgaaacaacaagcaaccaatcgtcaaaatcaatttatttatccaaaccctctatattctacatatatctccctccttcttgctacctatctcaaattttattatcctcaaatcctcaattgcttggcatctgtcgtttccacggtattagaagatgccctagcttgcctgccgagcttaggataaaccaacgttcgttcaccctggcaggtgggtgttcgttgggcgcaagttgcacataacgtgctaagatgtggtgttgtgattctacgtcaacatgaacaatcttaaaaatacataaagagattacattacgtagaacacataccgcattacatatgcgaataaatagagacaacgacacacaggagcactctgaaacgcgcattatttttcacctgaaaggcaatgcttatgcactgactccaagtctccaacacatatatcgaccgatcgatctcacacacagtcacactcctctcacatctcacaacttttatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgttgacgacagcggcacgatcttggacggctcctgcccggggcacggcgtgctgctcgccgcgctgtgcagctgcgcgaagcagtcggcggcgccgtggaggtcgtcagcggcgaggggcacgctgaaggcgccgtcgccgtcgaggtcgccgatggccttgctctcgtacacaccgtcgctgttcttgcacttgatcgccacctggagacctgaacatcaccaaaaaattaatcaacgacggtgatatatcgttcgatcgaactgaccacgcaattaattagcgacgaacatatatatcatgatatatatacccttgaaagcatcctgcgccttcatgttcttcctggtgcactcgccgcacttggcctggccgacgacgatcgccgccgcctcgccgtccgcagcggcggtgacagccatcacgagggcggcgcagacgatggcggcgaagagtagtgctcgtgctacagctgccattgctgaatcaatcctagaaaactctattgctctttggactatgtggcaagaggctagagctgtgtgtgtcgatgagtgaagaaaaatcaggcatatgcatgtggtttatatagatcgataaaggctactagttgggagtgatctgaggtcagctaattatattacagtacaacatgattagcaatttgcgccgattttgcaggtttaaaatcattcacgccgtgcattttatttgatttgatcagacaccgatcgattaagagtagcagctagcagttcatggaggcactgtgaacattcacactgcatgcagtggtgactgttgatgctcttgccgccgattggtggtgtttaacaagcaaagttaagctttaatcgactggtactcctagagcgcacagtactactagcctgttttatgaaaagggagaatagttctgtagtataggacagttccaaccaaattgcatgattgatactatttgtaagtaaatgagtaaatttcacaaaaaactacaaatactttgatcaaactattgcaaaactattgatttaaggtattatatcataaaactaagtacatatagtgttaagtttatcacaaaactaaagatttgaaatatatggtcacaaagctatagattaagtaacaaaattattacaaaactacatgtttatagtgccaatttaatcacttcctcctgattgatattcgatgtgacttgtggctatggcttatgattcgatgctcttctctcctaggggctatatatttatatggacaatcaattttttgttaagtagaatttgaggagttcatatgggatatgaacaagtaagagtcttgtcagatcctgtagtcaatggcacatgagcataacccaagagtcttagcgatgagattgccgaagctttcaaaaatgctttcggcatagatactagggttaaaaggcgtatatatcaaaaactctatactggccactacgataatgttcaatatcctcaagggttttgattgcctcattgtgtaagttcactggagaacatggccggtctactttagaggatatcgaccagtttattattcaatgcgaagaagctagtgctagtagtattttgaaacttaggctttttcccattgtctttatttggtgatgcgcgcaattttttgggtttatttcacttgcaccaactgtattcatgattggtctgagttagaacaaaaatatcatgattacttctttaattagtggtgagaccgaattaaacttgtcgtacttaacctcggttaaacaaaagtataacgagcctacttttgaatacattagaagatttatatatataagaaactgatgttatagtttaacactttctgataaggtcttggtagatttggcttattctggtttacttgaatatttaaaagaaaagctagatggtcatactttcttagatgtaagccaattacttcaaaaggctttaactcaagagagccgagttaaagaggccaaaatctcgcaaaaagttaagtctgattgtgcccatgttaatatagttgatcaacaagaatctttgaacaaagagacagttgatgtatacatacacaaatgggttttgaactccaactctaaaccatccgtttgctccgctcttaagctggttagtcgtaagaatcagcaagaggaaataaagttcacgtttgatgtggccaaatgcaataggatttttgaataattactagtaaaagaagaaaattaaattgtcacatggccacgccataccttcacttgaagaatagagcggcgagcatattataagtgtcacaactccaattctcatgccacaaatgattgcaatgtattccatagacaagttcaatcggcaattgacgaatgacgattgacttttacaaagatgcaggtggatgagctaccttttcctatacagaccgttgaattgcaagagaaggagattcccgatggcaaggagaagaccacattgaagacttcaatactgtcggtgaaatgggcccgggggtacgcacagtagagggaagtatccttcccatctagtcgcgtggctacgtggcctcgcctccccccgcccctcgggtagcgctgaggtggccagagggacctcggggtgccacgtcgcactcctcgggctttcggggcgtgctaccccgaggccctcgcctgaccacctcgtggcggggagagcgggcggggcgaaagacactgctccgcgccttcaatgcgcggtgcaccaaccgccccaagcagcatttaatgcggcgtggagggatgtgcggcgccgctcgattgacccatgtgttggtatttcttacgtccacagataaatccgcaagcgcacggaatactgttgtagcacttcaccttcgggtgaccccaaaaagatatcgaactcagggaacgtgtgtaatttacctaaggctaagacgatccaatgacaacaactatagataggctaggcaagctagagaggactttctatgtgttttaattatctaagctaagttgaaggtaatttcctatttgttgcttcgggcaccgacccctgctggtctgccagcgtggttccggctatagctctatgatgtatccgaacgtggagaattattaggacgggattcagggctgttaccacttgtcgcctacctctgacaaatccgtgggatacacaacaaacaaaggtaatctctaacctagacaccacgtctaagttattaattactactctaatacttgtacatgaacttccttctttatccagagtcctagtactagagcacttagtatgaatactagataaagaacccgcaaagatgaaaatctatcttacttagacaaagtaattaaataatataagaaaggaacacgaatgcttactttatagaagaggttctccgaacccagagcagagtgtaccgacagctccggtactccccccgaattcctcctaggaagctacactcgtcgagatagaagtcggatgagcgccaaacttccgggcactcctccagagcttcccctcactctctaccttattataatgtacaaaagatacaatagagcctcttataattcagctcaaaattgtgtgtcttggaaatgagaatgtgacctccttatataggctccaaatgacggttaggggtatgggaaatgaccaaaacaccctgcaactgccttaggggagaaatccgagccgtccaggtgaaagcagatgatgggaagcgccaggattggtttgtccgaactggtgggttcggccaaacccaaaaactctcctcccggcctctccttcagccgggaggttgcttattgggcccccaacaacctgggctatgttttggcccaattctaaatggtttttattgacttattgggcctctaatccgtgtaaacgcgtcctgaatgcgcggaggtgcattttgtcacatgacggatgtgttttctcctcaaattacttgcatacacatatttcaccaatactagtggaaatgattagtaataatacctaccactaagttggataccatgttttatttcattatatgcaggtattgacggtccgatattatgatttaaggaccgtcaacaccatatcaatcgagcttgaccggcctgtgaccggtcacaggcgacgggacgggggcagtgcccccacgttccgccctgtgtcaggcggagtgggggcaggtatgccctgtcccatcggcacgcttccaggggcgccccacgcgcgtggtgagccgccgaagtcttcatacaataatagggaatgacagggatgtcccccgtgtcaggcgggggcggcgctgggccccacctggagccaggcgaccatgttgcttccagttgaagcaaaggatagcggtatgattagggccatgtgccccccctccgatggaggggtaggtgcaaacagtgcatgtggtatccccttggactataaaaggaggacctcgcccaccgagaaaggggacgactctcagagaacttgagctcggaggaagaacagctaggtttcccttagagctcaaaacctcatgtaaaaattcaccataatcccatacacaagagtagggtattacactcaataacggcccgaacctgtataatccttgatctcccacacagccacgagagcgatctagcgattagaccgcaagcggaagtaggcccttgatcatcgtgccatttcccccggccgaactcacaaaggggggggtctcacgaccacctgctagagaggatcattcctcgacaaatacttaggaggcaagacgacaatctggagatatcaaaatatggcaagcgaccaaggagatcaagttcatctaccaagcgagtatgcaccaccggcaacttacttctccttttccatggtattacgcttggtataaatgtattatagatttttaatggtatgtggatgatgcctttttatataccatattattatccattatgggcattgccagtttccacattgacccattttaaataatcaaccacactcatctcatagccggttgagagaaaagaatcagtcacaaaagaatccacacaagaaagtggtgaggcaagagtggaggccaaagaaaaacaaaatacaatctgaacaagagaggcctctcgtagctttcttacatcaccattaaacatttaagccttagaggaattcatggtcggtattggtggatatcgcccttagatgatctcatgcatagtatttttttggctcataagtttgccaaaaagacagggggggcatgtgttgataatcaaatttggtagtagggtcgagttatagcaagtttgagccaaatttaaaaaatgccagagctttcccgcgaaggctggtctaaccgtcattatgtggccggtcaaagcagacaatgcactgagattagaccattggtatccaggcggttagatcttaatcacatagtccaagtccaatttagatatttctcgtgttttcttgttttagaccgaaattttcaagtcttagttgatttatatgcctaaatgcatatggaaaaaccccaggaagcaagtccaccccttttataaatataagggggccaaggatgattgaaacaacaagcaatcaatcatgcatcaaaatcaatttatttatccaaaccctctatattctacatctctctccttcttgctacctatccaaattctaaatcctcaaatcctcgattacttgtcatctctcgtctctacggtattagaggacgtcctagttggcctgctgagcctagaacaaaccgacgcacgttcatcctgatggggtccttcgcgggtggtcgttgggcggcatctacccactccctatgatggcgcgtctccgagtgctgccgcgagttacacataacgtgctcaaggtgtggcattgcgattctacgtcaacatgaacaatcttataaatatttaaattacattatgtagaacacatgtcgcattacatgtgcgaataaatacagacacgacacacataagcactctgaaattatttatcacctgaaagccaatgcttatgcactgactccaagtctccaacacatacatcgatctgtaaaatcaaaggtgtttttgataattattctgtgatgaacaattgagcattagagattattggttttgttatttggaatttattcacgaagtggtttggagatgattggatttcacaggtgaatctacaggttatcattttatgtggaccggtcagaccgggcaggtgttgccggtcagaccagcggtgatcaagcggtcggaccggccagcccgcggtctgaccggccgacactgtgtcggtttcggtttcgggttgtttatttggatatccgagtttatttcatgattatgacttctagatggatattatacgtatgtaatactattgtttactgctaatgagtcaagttggagatagcttggtctcggaatatggtttctttgtctattccatgtgtaggtgactcgatgtctcgggagagtatttacggtgatggaccgggagttggcttggggataagacgacgtccgttgtggtcagagatcatgcgggatactaaggctagagttgatgcacgtggttgatggagattccatatggcatacgatggagttattgtgtgcgtatgggatgcggagtcgaaattggaaggagtccaaatttggtacgattggttatgtaaagtttctttcttgtactagagggtttcctaaggtgtttaggactcctagtatgagtttggttcgtggctttaggctgcctacctcatgtataaatagagggggagcgtgaggcttcccggtatcgctttagagagcaatagaattgagttttgagttagggtttcgagtttagtcgaaatttttgtaaggagtgttgttggtgcactttgtaaacatagagagaattaataaagtcgtcattcactttaagagttcttcgatttgtgtttcaccgggtttcggcggtctaaccgacaactcaccggtggtcagaccagcggcattgcggcggtcagaccggcgggagcacggcggtcagaccgacggcggcgacagtaggcggcaggcgatcacggcggttagaccggtagatcaacaccggtcagaccgggggctacgcttcggtcagaccggctaatctacttcggtcagaccgatctccatcgatttcgagggtaacttttatttccgctaaaagttttcggtttttgggtataccaaccattcaccccctctggttggcttagttcttgtgattcgatcctacacgatcgatcgatctcacacagtcacactcctctcacatctcacaacttatatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgccggcgatgtggaggagtgcatcctcttgccagcgacgacgacgaaggtgttagccttgtcgccgccgttgtccgttgttgacgacagcggtacgatcttggacggctcctgcccggggcacggcgtgctgctcgtcgcgctgtgcagctgcgcgaagcagtcggcggcgccgtggaggtcgtcggcggcgaggggcacgctgaaggcgccgtcgccgtcgaggtcgccgacggccttgctctcgtactcgccatcgctgttcttgcacttgatcgccacctggagacctgaacatcaccaaacaattaatcaaggacggtgatatatcgatcgcaattaatcaatgatgaacatatcatcatcatcatcatcatcatgatatatatatacccttgaaagcatcctgcgccatcatgttcttcctggtgcactcgccgcacttggcctgaccgacgacgaccgccgccacctcgccgtccgcagcagcggcaactgccatcacggcggcgcagacgacggcggcgaagagtagtagtgttcgtgctacatgttgaaattgtatcttcagctgtggccccatcgtgatccattttgcagttgcaacggtgtggagaataagtcgccagcaggttgttagcaggcgcgggtgatgcggcgatctgggagttgaagaccgtgtcgtgtgcgtgagtttagcgcaggggagtgtgtgtgtagcgagtcagagaattgcggatcgtgggatggcacgatttttgcctcggattcgttctgttatgtatggagtataaatagtttatttagctcagttttacagttgtaagtttattattcagttgaatgaaaaacaaccagaaaattccccaaagattgtgcgatctagttcagagttctgaaacttctctgttcttcactctgctctgaatttctcctctcagttccttgtcactgttgctgtgttgtgccgtgccggacgcgtgcagtctgcgcgcaaggtgttcgatcagggaaatcttcgccaacactactgatgccattgttgaatcaatcctagcaattagcaaactctattgcccctcctccttactatgtgtggatgagtgaagaagaagcagaggccatgcatggtttatataggcgccagcatgcatagcatcatgtagatcgataaaggctacctgggagtgagctgagatcagctaattatattacatcatgattagaaatttgcgccgaatttgcaggttcaaaattaatgccgtaagtttgattttatcaggcagtaccgatcgattaagagtagtgcactgtgaacgtgcacactgcatgcagtgttcacccttgatgctcttgcttccaattggtggtgttaaacaagcaaaagttatgctttaatcgagtagtactcctacagtacacagtgctactagtccgttttattaaaaaggaggatagttctatactataggacagcttcaaccaaattgcattattgatactattgtgctttcttattactgtcttggttaatttggctcttggataattacctgtttaaatttatcagcatatactgcctactagtatttgcagaaatcgaagccagcataagtttaagtaaaatgttattgtgtcttcgtctattttaataacgtagtgtacgtgagtatatgagtgtggtgtcaccgactacacgtgcatcttgtctatgtaatggaaaaagaaaatctctttgcttccttaggctgaatccaccatggcagtccagcgcatattctagatgccaacctgtatgcatgacccgacatgagcatatgtcaactaggcctttttctttacctcttcacccaccttgcgtctctgcaacacacaacgccacgggctgagataaagacgagaatgctccagccagacgctagatctagcccaaaaaatgggtagcccatgtccaagccaccccatgaactcctccatgaactcttttgtacacaatgctatctttttatctgaattttaggtagtttcaaattgtatttctatatggactatttcttgtagttttaatttttattccgacttttagattgaattatatttatacatataattttatttcaatatttattttaaatttttaatccgaatttcatatttttcagcctaaaaggtatttctacgttgactcttgtcttaatttaatttttaaatacgaatttaagttttcttttcaaaattgcatttctacatgtacttcttttatccttttattattattccgaattacagatatttttaatctatacacttggactctatttttttcttttttattaatatgggaaattctaggtcatgagagtgaatatggtggcttttatattgttttattgagttaataatagatcgacagttacaggtgttcctttttctgttacttcatgaatatttcaataactagatgaaactctgcgcattactgcggaaatttagtatgataacaataaaaaaaataacgtgtaagataactagataacatcagattaagtaaattaatgtggtttacgataatttaaatttaaatagtatgtagaatggtgattcaaacgtaaaaagtaaggtggtatgactttatggaagaagaaaagtagggagatagtttgtaccgtagattaatcatctaaaggctaaaaacaattgatgtgatatgacttaattagaggaaaaaaagagaaagataatttgaaccatagattaatcatttaagcactaactaagtgaggatgaactatataagtatataggatatcataaaacataataaagatatacattgaaacatgatgtgaattcacataattatgttagattataatttaacatgtttgtatttgaaaagctcttaaattataaaaactataaagatatagcatgtttgcatgatgtttaaatgtgatgattgttagtgaatgatgatgtggtatcttgttaattagtggatgatgatgtggcatcttgttagtggatgatgatgtggcatctttgcatgttaagcttaagaagttagtgggggataactttatagtaagataggatatatttgacatttacagctagctctttttttcttttacttaatttaattttttttatagtaagataggatatatttgacatttacagctagctctttttttcttttacttaatttaatttaatctaataatatatttacatgttacagctaactggacaaaaaaaataagggctaaaaaggaatcgaagtctggacctatagagtgtcctcgctagtggaaaccactgcactagaacagcatattgttatttttagtgcaggatgctaaacaaatatttgggtgttagcgtaaacctcatcagcacaaaatcatttatttgtccccaaaacaactcacctaaaagaaatacttagcttcttcatagcacagcaatattttgtatatagtacaaacaactgaacaaataagtccatttgaacacacgacgaaaaaattcattgagaaaatagttagagaaatatatcaaggcagataacaaaattagtgataaaaaatacttcaaaagtgtatgaacatatcacacgatcgaaataacagacaaatcccattaaataatgaagtctatcacaacaaaactagcttgttgggtcatcctcatcactatctgatggttctgtacccatatcatatagatccctcggcctatatggttgtgcaacatgccatccttgtgcttttggttcctgcacatagaacacctgtgatacttgtgatgagaacacaaaaggatcatgctccatcttctctcccttatcttcctctgtcacctccttatcacaacaacaactcaagcccgctggtcaccgcgaacttgttctccttcgagcccgatgtaagtacttttttttttaactaacgtattagtattttttaactaacatatcatattcaatggataaagcactgtcgctatttagaggctcctactgtgtatatattaaatatatataattaaaaaagaaactgtatagatctcaatgcatgctgtctagccattctataatcggaaaaagtacgaattaccccttccccgaactatcgcgatcgtccgaattatccccttgaactcgaaaaccagacattttacaccctcaactactaaaaccgaacaaataacccccctactcaatctctggagtggttttgatcctacgtggcatacacgtgtcagccaagtcagcaatcctttaaaaaaattcggtggggcccacctgtcaatctctctcctgtattgctcaccttctctctcctcctggattcatcccctcccctcgctaaagcacgcagcggcggggcgagcggtggcggcgggcgcggctgagcgagcggaggtggctgcgggcgcggctgggtgagcggcggcggctgctgcgggcacaattgggcgagcgtcggcggcgacgacggcggctgcggatgctagcctcgccggcgagctccgccacgggcccccaccctggcaccaccgcccaccgtgtccacctccactatgccgacgtccacgtccgtcttggtccgcctcggtgcgtgggcgagcgcctcgtcgccgtcgccttcgtgcaccaccgggagcaacagcacggtcgtcgcctccgccaccacgggcacggcggggcgcgagacggcggcggaggcgctgtcagtgtcgtcgtcgtccatctcctccccggcgaccttcctccctgcacggtcgatctccagctccacacgcgccctcgcggactccgtctcgaccacctccaacgcgcgctccagctccgccacgtagttgttaacagtgaaatttggtaagcccggagtagtcatcggcgtagagtcagcatcggcttcgaagtcctgagattagccgatgagagttgtcaagtcgtcagttgtcggattcttgctatattcggttaaggaaattgatctactaaaggaagcttatccagaagagaccgagtttaaagagaatacggcatggtaagttatctattaattaggaatagtttgttagtttccttttatctttaggaaagtgtgtttagtgtcctataaggactttatcttttccttttatctttaggaaagtttctttcttgtccgacaaggacttatatcaacccatggatataaatatgtacacctggggtctatgtaatctgtcctcacgatcaatacaattcggcgcatcgccaccttttttacttctacttttgtttttacgttccggcggaacttggcacccgacgcggggctgcatcgtcttcgatctccggcgaagggataagtccaatgtttcaccggtccaggcaattgtatcgtttacgtcggcgtcaacagtagtcctcaccacctcgacgccacttgtcgccagtcctcgcgtgccgaccgcccgcgacgctgcaccccaccagccctcgcccgctgatggcccgcgctgccaactgtcgctggccctcgcgcgccgaccgcaacagccgcacgcgcttcaaaaacgagaaggtcacacacccctgttcccgcgctgaccgcccccaccgcctgtccccgcgccagccgcccctacacgccgccgcccaccgcccgtccccgcgctgcgctgctgctccccccttccctggagacgacggtgaggtacccctctcgagctccgtgtcaacggcggtgggcgacgagtcctcctcggggagggcacggcgggtgtcgtgcgcggcatgtcgtgctcgtcccccataaccaaaggcggctgtcgtgctcgtccctcatctccgcctcatgcttctgcggaggctcgccggcgcaccgacgtcgccgagcggcgggagcctcatgctccgtgcatcgatccgcctccgccaccggccaccatctcctccttctccagccgtagacgcaaagcaagagagagagaagggaagcagggggaatgggattggggagggattggtgtgaggaaagagatgacatgtgggactagatttttttaatgttttattttgctgaccagatgccacgttggcggccacatatgctgattccagttaaaaccgtccaaaacagtgctcggggggttatttgtccggttttagtagttgagggtgtaaaatgtatggttttcgagttcaggggggtaattcggacgaccgtgatagttcggggggggggggttaattcgtactttttcctttactagaaaaaatgcccgtgcgttgctacgggtaaaaactttttttatcctatacattatactccctttgttttggaccggatgcttctttgtttttggaccggacgttcattccttccttcttttcagctctagtcctagagcagtccgctacctctatctgctcggcctatctctcttcgcctcagcccacaagtggagctgtaggcctagctcgaacaatctcgtgcccgtaccatgacggagccaaacctcccatcaaatccggtaatctggtcgagctcgcatagtaccgtgtccgtatgatggcggagttgatcctctctgtcaaatgcggtcgaatctttctcgatctccaaaattattagagattttgatccacttgatcccctttttcgtttttttaccaaaatcgaagcaatccacaaaacttggggaaaaaaataatgaactgaaagggaaattcaaggggaaaatgacgagagtagtggagaatcgatttttgcaatcaattggatgaggaaacacataaagatgcaaatcgacatggcggcggcgctagggtttggcccgacgaaaaaaccgcaaaaaaaaaatagcgaaacatagttttcctttttacaatcgttttttgccgcactttttttttccgcctttttagtaggaataggaatcggtcagctttttttttttgccgcatttttttgccctgggattttttaattacaatcggacttttttatcatttttttattaacggacgaaggaaacatcttaaactctatatatatatatatatatatatatatatatatatatataaaagtagtagtagatccgtggtaactctattttgttctctagataaccaagacaaaatttgatttttgtctggatttacaaacttgaataggacttatatttctgaaaatcgtatgattgcttgtgattcaaatactccaagccattgtgatgataatctccatgtaaaaggggaaacatatgtatcttcagagagatcagtaaaaatatggcttcaacttgcatgcacgctacaaccggccagcggcaattaaccacaccggacacgatgtcagcatgcacgtcaagtatacagaacaaatgaccgttgaaccatgtgctgctagtttcacccactcaatcaaggagcactgttgcaaaagataccatgtggcatccatcccaaggtgcaaaaacttcaaaaatctagaaaaccgatatggtagctagggaagttattaattacattctccgtttcatattataagttattttgtttttttcttctagtcaaacttttttggtttgatcaaatttatagaaaagtataatattttaaacacaaaacaaacgtattatcaaaatatatttaatgttacatttatagtaaaactaattcgatattgtagatgttgctaatttttttctataaacttagtcaaacataaaaaaatgattagaaaaaagttaaaatgacttatagtatgaaatggagggatcagtataaattagtattcttgagcagaaggttggtcaaaaatagatgttggagagtatcttcaaaattcatccttcctaacatattcctatttttcaatctatctttcatgaataaccagaaaaatactttgtgtttttttaacatatgaataaaatgttgctactaattcactaccttccctgcacgctgcctcccatcattccttgctagcatggctcgttccccgtgttagagtataagtgaattactaccatctttctttgcaattgccccttcttaattagtttaagctcttattttgaattagttgttaatacttatatttaactccatatgttatcggagtgaagtcccaaaatcacaaagaccaaaaccattcgcttttgagtaaattttagaaagagtaaattgctcccacggtacaacaacttggcatgtggatgcgatataatgcaagaacttgaaaattgaacgtccaagtgcaacaacttgacaagtgggtgcgttctagtataagaacttaacaatttagtatttttgtacatcaacttggctaagcatatacaaggtgagtttttttcacgatgtcaatatgccattacatagtaatcatatggatattgccttataagcacatagtagtacaatttacatccaattacctttaagattttttttgttttcttcatcttatcaaatatcaaccgaaatataataatttctacatatagtttaattggctttcagttattagttattatgataaaaatataaatacacttatcaaatctgtgaaatatgcgctagtatattgtcaaaattagtacttaaaaattgaatttataaaaaaaatgctccaaataatcaagttgtagcataactttttaatttactgtatcaaaatcgtacctaccttgcaagttgttgcatttatacgatcacttataaagttcttatactaaattgcacctacctaccaaattattgcactagaacgttcatttctcaactcaagttattgcactaaattgcacccacctgccaagttgatgcaccatggatgcaatttactcttttagaaaacttcgtgttgtatggtcaaagttgtagaaaccatatgtattatgacacgcggcatctaacctcaagtattgttgttttcaaagtttcacaaaactccacccttatgcattttgagcatgaatttacttaaaattaaaaaacgtagagtgcaaatgaaaatttaattattaagttattgactagattgatag

SEQ ID NO: 59219 - DNA, 1715 bp, Oryza sativa
tatgtggaacaaattagaacacactaagtgtgggcaacacatagatataaatttgagacaaaaatggcatgttatcaagaggtagtgtttgattaactcgatgtgagaaatgctcagtgaaacataaagtgatataagctcaggtagctaagttggagtggttattccagcactatcagttccattaatcaaaagcattgagaaataaatacacaacaatagtgttaatgaattatgctaaattgaccaaaattagctatatgcaaaatagtgttaataaggagggtttattttgcttgtttctggtgtaaaatagttgatcttgtctccttcagacaaccgagaaacatttgaactaaagaaaaaaagaatgcacagacacacatcttactgctgataggattctaggaaagatgcaacttgacatttttcctaacaaggaacctagggtgaattatgtgaaatatgccgagtatcctgatcaatcgttgtttttataattcaaaattttaaagaaaagtttgattcagtatctcagttcataaatacattcttaaagtggtttctgcataaaaaaacatttgctgtgtaaaagaaaaaacttgagagactgatttactattctgctgtactgtacaataaaatagccttttaaagaacatagtattacttaatgggttaatttgatccatgccattgtaaaatatgtcgaattagataataccattactattcacgatatcggctgggtgctactagaattttgtaaaattataaccatgccatcgtcgtcacattttccttccatgttcttcattctctccatgaccaggtggtgttcgtcgactcttcttatctttggtcaacgcctcgccgccagacgggccctcaccctccatgcacctgtcatcgacggtgtcactgctcccgctgccgtagcaggaaatccagcgacggccagatgaggcgccacgattgacgctgctggtcggtcggctgtgtcacaacaagtgcagctagcgtccaacatacttgctacggaagacacacaagtatgttcgtggttgctctcatcatcaccgctggcaaacatacttgcgtctgaatacatgagaagctagcatacgcatgccatggcgagcccgtgtcagattgcattgagggagaagatgaagcctcggcagcccacactgcttcatcttctcacccgccactgcgccacccctccatgctgaccgccgccgcccctgccaccctaccggcgccagcgtgctcgtcgcaacggcggcaaggtttggagatggctatgagcttgtcgcagcgccatcgccattttttcttttttttttcctctctatattttttcaggagctaattggttccttgctgtagtttggggagaagatgacggaaagtgtgacagcgatggtatggttccaaatttacaaaattggagtggcacccaaccgatatcgtgaataataatgatatttttctaatttaacatatttgcaatggcatacatcacattaacccttacttagttgatcgtggccaaaatcaacagcccaagactaaagcatgcatacagcatactccctatgcagtgcagtctcagcctaaactgaacctattattggctagttaagcatagataggagacaagttgttcaacactagtagaaattaaaggctgttcatggaccatacatacg

SEQ ID NO: 59220 - DNA, 41742 bp, Oryza sativa
  unsure (1)..(41742): unsure at all n locations
gtattaactagttaatctcaaatttattagtatctcgatgatgatatttcacatggaccgatggactacatcaccggaatacaagagcaaagaacctgcatttgatgtttatgcaactttgttgaaagatactccctccgtttcacaatataagtcattttaacatttcccacattcatagtgatattaatgaatctagacatatatatctatctagattcattaataccaatatgaatgtgaaaaatgctaaaatgacttacattgtgaaacgaaggaagtaataaactgccaattcctgcacaggaactgtcagtaccaaacaaaaatggcatactaattaatttgccagggcagaagttttgaaacataaactggaaaaaaaaaacttaatcatttcatcatcgttcgataaggcacctaagaaggataagttatagaccatcaccaggaaagactaacaacacaagcgtataatgaggcacaaaaaaatggtagacaaccaaaaagaacataaggaataggtgctctgcaaattacagaccactacgatgaaatgatagacactagcaagtaaaatatcgaagaactgaaaagggcaatttgtttcttcgactacttaaggctaacagtacttccatctatggtcatgtattagcatatgccaaaaaaaaaaaaagcaccagagaatcctaagacaaagttacaaaagaattattcaaaattggggaggttggacaagttaaggatgctgacagtgagccacaagcaagcccacaagggagcacaaataagagtgacagtggtggccaaatgggccgcactgcacggacacggcccactcagacgtcaacccgagtaaaaatacttccctctcaaagaaacaaaagagtaaaatactcgttcatcttggcgcgcgaccaagaaagcagaattcgccgtcttcgtgcctctgtttggttaggttagaattggaggactgaacaaggtagtcagtctgtgtgtaactttgcactgatgattagtcagagtcttgttgttggctttagtcccacatcggtatttgatgacgggggagcacgacttaaaaggtgggggtggtcttcacccatcaaactagtcttttgggttgtgtaggctaaaaacctaaagttgtggagcaggtccaatgtaacctgggtggcccacggttggtgggtcaggcctacgcactctaacacttgtgttaggactgatgtactctgtgatcttatattcttctgattattcattacaatcgtatttatatttatgtaatgctattcaatttgtacataacaattcaaggcctacaaattatcagctttatcagcttgttgaatcttgtttcatgactgcttgttttttcatcttcagaaaagggactagttttgtagtttgtggattctgtccttgatctttcagtacataggagtgttaaaatgaaaaacatagtgacctccaaaagaagggaaaatgacgagtagaagacatgtatttgggtagttccataatgcacacagtagaaatcatttgtcagaatcagtgttttggcagaaaaggtagaagaacgcagagtactctgcattttgtaatataggcattggactagcatagaatattagaatcgatagtctcaggattggtgattgcattagtacattggaattgcaatcaggggaatcttattcttctgtttattcattgcaagcataggcagctgcgcagtgggcacagagcgaactattctttcgccttttactaaagaataccgtgtgctcgctgcaaatagcagcattgcaagcatacttgtgtagtattaagcatgctcaaataaatttgaaacaaattcaaggccatgtttgtttcattaattattagcatgttgagtccggcctcatcctcatgtgcttgcttgttaatcttcaatcgaagtactggttcagtagttatggattgtgtcctttcatcctcccttcagtttgtgagcatatagcaggaaaaaacttatgttcaaaataaaaaggaagaaaggaaaaacagaggggaattaaaggaataggattattggtttgtcatgcaaacattcagagggaaacgttgacaaagaaataaaaagaacagtgtgacctatgtatatgaactagtatatgggttgtttcagccaataggttccatttgtcagaatagagtttttttgctgatcggcgagttgcttgaggtcctgccggagcaaacaagtcgacagttcaataaataatggtttcgtcagtgttggtttgtgagtcttcagcaaaacaagtattcagttagagaaaagaaagtctatgtcaataaggctggaattgatagttctgaagtcctgatcatagccgaattcatttgttggaacaggaattttgatataaataatactataatacaaaaaagaaaagtttgataaacctcgtttgttatatctagtctttttgtctgtcaaggtatagaaaatgtttgatttttgttctgaaggggaggatctctaatatattcagtcagtggtcagtgccaactctgataaataattgatgccattacttggagaaaaccttgtgaggattgtaagaaaccgagggaaaagaacattaaaactaaccagtcaaaataactgtgctgacaacaatcttcacttgatgacttcagtcatgtttttttactaattttattgaaggagaacaaccttttctttggggatccaatggtgtttttccacggtagtttctcacatgtgcttggttttagtcacccgcataacatctaaatcagtgtaacttttaggtgtgtcttctgtcatatagacttgcaaaaaacttcttaagaaaaaggcctgcttttattcatagcagtactaagagagtgctcttcatcctggctatgtaattgggaaccttttgaaattgtagcaaccctttgtccctctgtctaactgaaatagaggtccatgtccctgcaaatatgcattactgtacagcaatctggaaattagcacaggctgaaactggacagttcccaattgaagcccgtgctttatttgatatatttgcctacctatttatcatatatcttagttaatctaagtcgattatttaaatttacttatatcggtcagatcttttctagggttttgccagtatcggctaaattgttttgtcgatctagattagctattgtatctaccacccagaaaatcagtcaaagaattgatattatgtttcttttcatacttagtgctgcatcaattgggtttgacctactaagtcatgcttataactataatctctagcttgctttttgattgccaataagggtttcatcagggtttcaactgatgagttatctaggcgttgcttcggctcataaggattatatacaagttggatttagccgatgacaacaaaattttcattgattatcaaatcgtttggatttaatgacatcggagctccagtcgatgtatgttttaacctttggatcagagcttattccattatatcattattagccgattggtttctaccggtttacatcgttgtcttattatattatcattagccgactgtttttatataattatttactcaagtatcagaatatgcattggatatgtagccgacagttcaaaaccctatcaacatcggctggtatcgccccatcggcttgtcagccaagcgactctttagtgatcaacatatttatctatcttgtcagttgcaggatcaaactggctggcatgcccgcatatcatcaatatttaggacctgcactagagctaagcagatctcctaggccattgtgttcgtcgacttagttcgcgctaacacagatcagataccatcggccaagcgcggatttttttgtcaacaagacggaggagaaggtattgaccaagattgtaatggagatggatgtggcggtggagaccgtagttgcggaggagacagtggagatggtggagtccgaggattctcaagctacagcggtgggaatggatgccgctgctcacctgggaaacacgatgtagcgcttgcaccataatatgatggcgtgggatatctctcctagatttgtctacccatctcctatagggatgtccagctcaagatcgtcaaatccttagcagacccactccacctcgatctttgagtatcgaggtggatcgcgtcttgctggacttgtatggctatgccctccgccatcttcacgagaaacgaggttagttagtaacatatgcaccaattttcgcaagctacaaagcaggatgtgcaaactatgagcataccttgattgataggtccttgaagggaatatgcagctaacatggtgtctgttgcgtgatttcatccacggggcatggatttttcaatgatccctcagtttagggatttttcaaaatttggtgttagatccttcaggatatatctgttgtacaaatctttcttgaagcagttgagttgttgggccatcttttttagagtccaatcctttactttgttctgttctacttgagggatcgtgaagatctcgagcatggtggtccctaacatgtccttctctgtatttggaagatatgtttcttccacatcgtcgtgtgaccttgttttgagccaattccgtatactgatgggcacgtgagccctcacgacccaaccgctgtgtgacacaaacttccttgcggcatcttcgggggcaactggttcgtcgtctgctataactgctgttataatcgtctcccctcgaccttccttgcgagaccccattgtccgcgtaccctcttcgatccaatgtttgattggttgtcctgttgctcatcctcgtttccctcctcgtctacttcttcgctcctctcctcattcatgtattggtttgggtcctcgtttccctcctcatccacccagtattgacgcctactctcattgatctcgtccaagaggaactgttcgtcatcgcgaaatgccatatgttcctaacattaaataatacagaaaatgtaaattactacaaaaggtgcatggtatattgttatatctacattgtcaaatatgcatacacccatgggtttataatagataaaatcccttgtatgctctaaaaatttcatcattcccttttgtacccttgaatcatactcaatctcttctatacctccgaattttcaccttgaactcttctatacccctaccgttagttgttctttagttgactggttagtttgcttgaaaatgtccgttatgcccttggcttggttataggttagatgaaaaaaatgttaataggcttctggatggttggtctaacctagaaatgtccatgatgaagataaaaatctctcggcacaagtgcaccattggatccgtcctccaaccagaatcgatgtaaccagctatcccataaaacaaatcatttgcatttacctgcatcaacaagagagaaaaaacagaaaacacaaggggaaaaaaatcccaaatttctttcagcggcttgctgctccagatttcttctagctgcttgctaattgtttcagtcaacgaagcgggcgtgctgccctttccacgccggcaggatctggcatcattacagcaacaacttcatgcggatggtgggaaccaacaaggtgaagcagcagagatgacaatatccagcgagtcgtcatcctcgacggcaacttcgcaagatgctggaagaccacggcttgaagcagcagcaacatcaacggtgaaatcccgttgttgatgcggggctgacggcgacgtgcagtggtgcaggtgcgtcgtgcacctggagagcaacaagtcgatgcggggcccgacggcgatgctcgaccaccgcacgcacgacgaggcccgatggcgatgtgtaggcatgctgcaggatgacccagagatgtggccttgacagcgccaggcaggcacgacgcacgtaggggggaagaagagacggccgtgactttatgggcctggaagtagtggcgcagtttccgcaatgtcatgattacaacgtagagcagtctatgtatttgaggatatcagaccttggcgtcatggagggcctcgttgacatagtacaccgggtgttgtgctttatccctctcgacaacgatgacagtgctaacagaatagggtgtggcggcaatataaggaaataactcttccattggctgaggggcaacgactacaaggggttggacaagtaccacttgagcgcgatgaacgtgttctcggcatcctgtgtccactcgaatttgtccgggtttttaagtaaagcgaagaaaggttgtactcgttctcccatcctagccacgaatcgacttagtgccaccattcatcccgctagcttctgtacctccttgagtcttgtgggcgaattcatgttctcgattgccttgatcttctctaggtttgccttaatacctcgcttagagacaaggaaactaagcagcttccctgatggtactaaaaacgtccacttctccggatttaatttcagtcgatgtcgtcggagattgttgaatgtttccctcatgtcgtcaatcagcttgtcgcttgtctttgttttgaccacgacgtcgtcgacgtaggccaccacatttcggccgatcaggtcaccaagagccccttgaatctcgcgctggtacatgttgcctacactgattagctcgaagggcatcttggtataacaaaaaacatcgaaaggcatgatgaatgttgtcttctccttgtcctctttagccatactgatctggtgatagccggagtaagcgtcgagaaaactaaatagctcacaaccagctattgagtccactagttgatcaatgcggggtagagggaagtgatccttgtggcacgccttattgaggtcaatgaaatccacacacattctctacttgtcattggccttgcgaaacattactggatttgtgagccactctggatggagaacttctcggatgaaactgttgacgaaaaatccgtgcttggccaacggtgccggatctgtgttggcgcgaacttaaatcgacgaacacaacgacctaggagatctgctttactccagtgcaggtcagtttgatcctacaactgacaagatagataaatatattgatcaagaaagagccgatcggctgacaagccgatatagcaatgtgagctgatgtcgatacggttttgaacaatcggctatatatctaatgcatattttgatacttgaaaaaataatgatataaagacaatcggctgatgataatgtaataaaacaataatataatctagtagaaattaatcggctaataatgacatgataggataagcactgatccaaagattaaagcatacatcggctggaggtccgatgtcattaaatcgaaacgattagataaatagtgaaacatttgttgcgatcggctaaatctaacttgtatgtaatccttataagctgatgcaatgtctagataacttatcggctgaaaccccgatgaaacccttattggcaaccaaaaagcaggctagaaatcatggttctaagcatgacttagtaggtcaaacccaattgatgcagcactaagtatgaaaataaacatctagacaatcaagcctttgactgattttcaaggtggtagataccttagctaatctacatcctcctccaggtacgagaggtggttggtgtcctcgtggccttcgagagccacctatcgatgatgatgaagacaacgaaggataactataatcgggagtacgacctctggatctatgccaatgtccttgatttctccgagaaccgggggaacgtgaatctcgtcgtcgtctgttgttatcgtggtgttttcgacctcggccattgtcaccctgacttctccagccttgattgttctcgtccttgcagctttgccaatccagtcggtctcggtcctcatttagatagcttcatgattgccatcgctgttctgttatcgttgtggagaacaacgttggtgatggccgacgtccgtcttgttctcgtcattcccgtctccgcctgttcaagtggtcgcaaagatcacgattacctcggcaagtggggttttccaacttggtcttcttggcaatgcattatggggattacggcctgggtctaaactcaggtgttcgctagggacatcttcaacattgacattcccaactccatgttgctcttctccttgagatggggaacaagaaggacgctaggttgttggtccaattgtctccaagaaggaattgtttagattggctattgtagatcgtatctgtccaacctagtaatctgcttcagggaacatgactgggtccatgttggtatttcttaaccttatagagatataccgatgtaacacttcacccaggagtattctcaggtatcgatttccacagggaacgtctgtgtcggctcttcaccaggtacgtccaagtacataaagctaaggataagcaaaggatagagtggattcaccggtgagaaacagtgtctatggaaagcttaactttaatcctaatacgatacttcgggcactggccagcttactactcccagatatcgctctactacgtacctagttagggaggacttcagtgatcttgagggctgtcaccacctctacacccaccccacacctactgtgggatacggagcgattaataactacctagacacagcgtctaagcaattaataacttactttaatgttaggtacacactaaagcaatcactatattttgctggattatagtgaacgatgatctcgtacgctgattaggaactaaccaagagataattctcaccaagcaaaactaaattactcgaaagatatttctattataatcagagtagttaaacaaagcaaaagaaataagaagaggattaccgacaattccggaactcctctgacttcttctactctactctctctctaatctagtatacaataaagtacaatagagcctcttataattcagctcaagcttggagtgtgtgagtgaagtgaagatgtgaaatgtccattctaccctccaaccgccattagggagtcatctggactgtccctgccaagccgcatatcagacagctgtgggagtggttcggccgaacccatgtatggcccaataggcccacttttcggcctgttgctcctcctcagcctcccatatctatttcttcgagtggaaggaccatttgttgatgttttgtgtagttattggcccactcgttgtatggataggatttcacctccacttaagtctgattttcatcccaacttcggcggtttattacctgcaggcacatatgcaccaacactcgtggaatatgttagaaataaacctaatcactatgttggatactttattctttctgtttatgcaggtattgacggcataaatttggcatttaatagccgccaacaaactccccacacttagctctttgctcgtccttgagtaaaggttagagataaatttcagaataaaattatccaatatataatagaagcacataaattattcaaaactattcttgtacctgtgaacttcagcggtggctatcttactatcctgggtgattgataaatggaacagtcttgaatctggtcctcctcgtattctacttcagacttttgggggtttataaattttcccaaaccagcttttctcatcataatgacttaccctcgatcactcggatattttgtaatgtctgtggatccttaccaaggcatattttgctgaaattattccttattctaaaggctgtatgtgtggagtttggtaggcataattcggaacataccttcatcatatatattacaaaatcaaatacatggactcaagaagataatcgatcatactctcgaaacaaagatcgctaatttttgggtggaaagtgtatgatatgtgtggaaaaatggaaaataaagaaaatgcttctcctttatttatacctgcttctccaattttctccttcataattgtagagggggcatggccattttctttctttcttttttttccatgttgctctatatttttgaagagaaatatttttttaatagccatgcctttccctccttttctttttcttttccaaggatttttcttaggagaagaagggataaattgaatggagaatttattcatcaaagttggtttttctttttcagtggtagtcgaaatggatggaatggtgccaacttccagtgtagaagcttagcatcttatatggataacatagtggttgtgcaaccttgatcgagagagcatgagagacatctaacacgagtcacaaaaatttggtaaagctcaatataattacaggtagtcatacacatgcataaggttcatcattaatggcttggtgtatggccttgttgggtaggaataaagtcatatgaggagtaaggttccaaataaatttttgattttaaaaacaaatccccaattgtcatgagatagaacacaagaatttccttcatctcaactatatctcaattatcatctacttagatgcataaggttccctaacatagatagttgttcacaagtaacaagtctagtcaagaataaaatgtgtacaagatcaatcataggaaaattctattagttggaatttttatcttctcattaagcttgaacatattgtcattgaattttctgctcatgtactaggcatttgggggagaaaatgaggaagtagatgtgcaaacttgtcttccaggagaaaatgacaggaattggggctagtgtgggtttggtcgaaccaggtgttcggccgaaccactcggacgcccaatttacctgcatttttatgcagtgcttggaaatgttcagtggttcagagatgtggctgcagtttctgaatttgcatgtcaggagtccgaaaggtctccccccacacctattttcaacctacaactttatttggacacaaaaaatggaaatagaaaggcaaacattggggtaaacaccaatgtgccaaacttttattgaattaaaactgagataggtgccttattacattgagtaaggcaaaattgaaatgaaaataaactaatgcacctatcatgataaaatgagagggggaaggcctctagttagcacaataaagttcctccttccccatctccctaaaggcatgcttgaccttggaacataatgcacggctaagcaattgaaattcattcctaaggtcggctatttctctcctacgctccgtgtcacgttccctaagctcctcattctccctacggagtcgctagatcctcttggcttagtgaccgaaggttgaggggagttactaccctcaaacttcccggcctcccccttgatagccggcaaatatacttctactattatcatataaaacatctgcagcaatgcgtgagatcccgtgtagttaattactccatccattctttaatagatgacgacgttgatttttagacacatgtttatccatttgtcttattgaaaagttttgtggaaatgtgtaagatataaatcatgcttacactactaaaaggacacatgcaagtcagcattataggtgctggaatagctaaaaccagcgaaaaccggcacctatagtgttttccccaccttcgcaggctgaaagtacaaaaaatggtacgagtataagtgccagttgtagagaaaaacccttttttaaaaaaaaattgacacctttattatattataggtgtcggttaataaaaaatcacacctataatatactataggtgaaaaagacacccgaaaaaaccgagccaagtctggatactttttagctcacaggacgccgagagggggccttatcgactccccccccacctcgtctcgccctcctctcctcgacggcgccccccccctcacctccccatggtggcggcaccctcccctcaccttcccacgtcgacggcgtcgagcgcagctagatctgacctatgtggctcaagtgcgacgaccagatctttcttgcatttttttttgatgtggataatgattttttttttaaagttgattgtgcgattgtgttcaagttgatcgattcaggggtgattgggagctgcatcgagccaccttttttttattattcttgggacatagaaccaacacctttgatttctctcattagtaccacctactatgtgctggttttcccgatcggcacctgtgtggggggtttccaaccggcacctattcgcgtttctgtagtagtgttaaaagtatttttaatcataaaacaattcacaataaaacaaataagaattagcaactttttgagtaaaacaaatttaacgtccaaatttaacaactttttgaggtggtgtttgaatctcctgaagatgaagatgaagatgaagattaagtgtttcacgcaaaatgaggtggtaataacgtgtgattaattgagttttaattattataaacttgaaaaatagattaatctgatattttaaaacaactttcatatagaaagttttcgcacgaaatacaccgtttaacggtttgaaaagtgtgccacgagtatccaaaagttaatccaacttttgttggagaaaagaacagggatgtatttgaaaattttattaaaaaaaattatgggtttctatccaacatttgatcatccgtcttatttgaaaaatttataaaaaaagaataagttatacataaaatattattcatgttttacgatcaaataataataataatattaataaaaaaatttcaaataaaatgaacggtcaaatgttggtcacgaaaacatataaaatacttaagataggacggagggagtagtatactgcgacgacctgggttgtgccgtttttttatagtatagtttttcccaaagacattgatatggcaattcaaaaccgtaacagtcgcagtttgcatatagtacaattaataatgcagccatgcgggcaccaccaacgacgatttccgtcggcgaaatttgtcctaacgagctccgacgacgacttccacattgcagccgtaatttgccgaggtcttccacattgcagccgtacgtgccgacggcccgacgccacgtatgtagctttccgtttccaaactctgatcgcaacatatggccccgttcggtagtacttctagagtactgtttgattcacagtactgtttaattcagcttagggttattataatctgaattattagaaataagctaaaacaaaccgataacatattatgatagattattataatctataaagcaaattactataatctaatccactcaaaagatgctttttttattattgggtggctaacaactaacaaacagcttataatccaggaaaacaaacagctcacagcttattatatgtcggcctattataattcagcttatagtaatctggttcaataatctaaattacaacaatcttaagcttagacacgtgaaacgaggaaaccattgatgtttgattaattattttaaactcatgaaatgaatctatttgatattttaactctatttcaatgaaaataatttcacggatagtactgattattagtttgaaaagtgtgttaatgaaaactgtgacaaaatttgtatcttaataggaaaagaacatggcctatgtactctactttcacttcttgcatgtgtggtagctagctgcagtaaataattgactatactcgctcctctgttgcatattataagttgcatattataagttatttttattttttcatatcaaacatttttaaatttgattaagcttgtaaaaaaatatggcaatattttaaaacatttataaaaacaaaatataaaaatatattcaatgttatatattatttaatgaaattaatttgttgttgtagatttcgctaagtttttctataagcttagtcaaattaaaaaaaattaacttaaaaatataaaacggcttatgatataaaactaagagagtaatatattttgcagacccctcgttgagtatgatctgataatggattaccttacgtgtggcgattaacaagtcacttgacaatattatcttttgaatgaggaaagcacagggaatgttctttttacttgtcctttggctcattttgcttggaatgtaattgccatggtgttgaatttatttttggaatgtaactgtccctatctatcttttctgggatggtatgagagctatcaaaacaaaaatgaaatctcaagtggggatggtagtgtttgctgggatgttgtggggtctatggataacaaggaatgagtgggtgtttgaaaacaaactaatcaaaactcctttgcatgttgtctgtcatgtctttgtccctgatgcaaagatggaggctgctactaaaagaaaaaactgcgctgatttccatgagaaagcatgctcattctggatggtttgccggcgcgcggttgacaatctgccagaagactttgggtagcttaggagagtttgggatggtttagttcccaaacaaaatttttcacatagtcacatcgaatatttgaacacatacataaagtattaaatgtaaaaaaaaatacaattacacagttcaccaggaaattgcgatatgaatcttttaagcctaattgcgtcattatttgataatgtggtgctaaagtaaacatttactaaagacggattaattaggcttaataaattcggctcgcagtttcctgacggaatctataatttattttattattagactgcatttaatacttcaaataccgtatatccaatgtgacgtgcaagggtaaaatatttttccaaataaacaggccctttgtgtcgttttctgtcccagttgtgtatatacatgatgtggttagtgagggggcttttagtactttttgatggtctgcacctttcatagaaagctggatgtccccagtgtgtcgcaaagccttttgttaccctgttttagctgtttacttttgtaagactctgtaagaacctgttttcttctgggctttttacaaagccgggtaatatatttgcctgatatacaaaaacaagtgacttgatatattttgcaaatctctcgtttatttatatccatatacatatgcttcttcccttcaaagttaaattcctaatatttctcaatgtatatatgtacgtcattcctacctccagtctagtgaacgggtgcagactgcaatttgcatagtaagtacttattgatgggaaaaggaattaattttgaaattataattttaaaaaataagaacgaattgcagttttaagatataggacacatttatttaccaaggcttcccattggacctctttattctatcctatactttcaattagaccccttactaccttaggcacttttttatacttctcaacctccaacatatgttgcgttcttaagggtgtctttagttcgcaaaaagaaaatttttgggtgtcacatcggacgtttgaccggatgtcggaaggggttttttttgacacgaatgaaaaaactaattttataactcgcctggtaaccacgagacgaattattatgcctaatttatccgtcattagcacatgtgagttactgtagcacttatggctaatcatagactaattagcctcaaaagattcatctcactttccatgcaaactgtgcaattgattttttatctatatttaatactccatacatatgtccaaagatttgatgtgacgtttttagaaaaaaaaatggaactaaacaaggtataagtttactttcccaacttcacctcccttgttttctacgtgcacatattccaaattgctaaacgatgtgttgtttgaaaaaatatagaaaagttgtttttgaaaaacatattaatctatttttcaatttttatttagctaatactttactaatcataatgtataggtcgttttacgtgcctcccgaacacagtcttagcgtgcaacctgacctccactaccttcctcttgcttccactaccttctaacatccttcatttgcttgaaggtggtgccttgttcaaggcaaaggggtcaaaaattaatagaaaaaaggcaataaaagtaggtccgttgttaaattgtaggacaggagtttaacgtgaataccggtatgaaaaaaaaatctgaacaaaaatccacttgagaattaattttagaaataaagtgttgaccaggagagaaaagcgggtaaggatctgactttcgatcttactgatgtgttcaaacagtactcgattgtagtcgctcaagggactgtgttcggaggacccggcacgcaaaacgaaccacctattattacatgattaattaagtatttgctaatttttttaaaagtggattaatatgattttttaagcaactttcgtatagaaatttttcgcaaaaaatacaccatttagcagtttgaaaagcgtgcgcatgaaaaacgggtgagaagggttgggaactagcactcccgaatgcagcctaatctctcttcaaaaaaactagtattcctggtatcataggtggccaaaaggcccactactaccgaaatgcaaaaaaaaataacagcactatatatacagactatatatacagaaaatactaaaaccgacatcaataatgtttttctcacccaaggctggtccgcatagcgccatcggctagaacaaatacctttgtggagagatagatgtcgattttaaataaaaacatgcacctatattgttagtgccgattttttaaagaaccgacaactataatatattataggtctcaatttaaagtacaggcactaatataggtgttgttatttttttaaatttacacctatagaaaaaccggccaccgaacgactttatctgctcccttgtctagtcatccttatcaccacacctcctcttccgtctcctcctcctcctcctccctcctcctccacacttgctcccgccgcctcactcacacccgcccctactgtcgccgcacgcctacctcctcattaccacccctacccgctacatcctcccacctgtctccgccatgcctcctcggccttgccgtcgtcgtcttcgttctccatctccctctcagcatcttcgtggcgctgtggctggttaccggcaaccccgcggtgcgggatttggcccccgagctcaggacctccacagcagcgaggaggaaaggagggggttcggctaggagcggcagtggcctcccgctcgcccgtccctctcctctcatctcctgtgagatttattttgtaattttcgcctctcctctcatctcatgtgtgatttattttgtgatttctgattggattgtctcttgtcttgtgatttattttggaatgatcatgtgattttcgattggattaggatttagtttttgaattaaatttgtgatgatttcggattcagttatgagctcaaagcatcgagtcgaatcaatctaatgcatcaagctatttttcttttgcctcgcgtgcacatcaaagatgtcggttgtgaaacttacatcaatgacttggggtttcatcagtgccgcttagcaggtgccgtttgaaacaaccggcacctatagagagagctctcaatcgacaccaaaatccttttgtgtagtagtagccaggtctagctatgctggcccagtctcgacacaacatgggcacaaaggttgggggctgtatcgtggttaggctgacactttagcacggccttgtgtcacctagcacaacctactatgtccatattttcccccattttctgctatatttcctatactttcatatctttccttattttcccatgttatttttccattttcccctctcacttctttaccttttcctttctttcaactattttctcttttctccacacacaccaactcgtgcggccattggcccctcttccattcctgctattctcgctccctcagccgtggcacgtgttcacaagccgtgaccagcctataggccactatcacacccattccgggccagcaaggcctaccatctgattgggctgtgtttgggctcaggcattggcacgtgggtcggcatgtcacaaaatattttagcagccatgtcttaagggtattaacttgatgagccgtgccagatgatctatttggctctaccactatcttatattatgagatagaagtagaagtagattagtatattccttccattttaaaatatagcaacctttggaattttatgttgagattaagaagtgtgtactagaatcgaatagggatgagtgttgagatgagaaagttggttgacaaattaaacgaaagatgattgatgcgtttagaggagtgggtaggtgaagaattagttatattttaaaataaatttgaataccaaatatagctataatagtattttaagagggagggagtagatcgtagcaggtggacaaacacagctctgctccatgctatctataaatatacgtacgcgccacagacaattggagctagcttattgaaggaaactaaaggaagaggcagctactcctactcatctaggaaaataaattcctagctagttaatgttgtacaacttacatgcgtccatggcattctggctacttgcagacctgctgattcttctagcttccgccgccgagagcgtcgccggccagcctgctgccagttgccaggctaggtgcggcgacatcgacattccctacccgttcggcatcggccccaattgctctcgcggaaagggatttgagatcgcatgcaatccccgaaacgacagcggcgagatggtgccgacccttgccgccgccaatggcaccatccatgtgcagagcctgttggtagcgccgatcccggaggtcaaggtgatgctgccggtggcgtaccagtgctactactccaacaacagcatcaccgactcgttctacggcgaggtagacctcaacaacacaggcgtgtaccgcatctccgacagccgcaacatgttcgtcgtgattgggtgcaacaccctgtcctacacccagaacgggaacagcggcggcaaaggcccttacgccggcctctactacaccggctgcgtctcctactgtaacgactcgtcgagcgcgcgggacagcatgtgcgccggcgtcggctgctgccacatcgacatctcgccgggcctcagtgacaacgttgtctccttcgggccctggaagcgtggcttccaggtagacttcagcccctgcgactactccttcctcgtcgacaagaacgagtacgagttccgtagcgccgacctcaagatggacctcaaccgaaccatgccggtgtggctggactgggccatccgcgactccgttacctgccctccactggaggtgcaggagaagaaaccggctgggtacgcgtgtatgagcgacaacagcgagtgcgtcaactccaccaacggtcccggatactactgcaagtgcaagcaaggctacgatggtaacccctacgtcgacaaggaccaaggttgcaagggtaagattaatgtttttattttattactcctagttaacagttttgctaaatatatagtgccaccattttatttttacctttcgttgtgtgcaccaaccctgttggtgtttaaattcattaactaatttttttttaccaggtttcatttgatcttttcactatttgatgtaggcgcaaaaaaagtgaaaaaacgtattgtgtattttagtaagcatctatatatacacggccgtgtgttgcaagtttcacaagttgcgtaattttgcgtgtgtgtgatatataggatttgaacgggaacctgttcttcaagtagcgtccttaccatctcacctataaagaactttgtgcatgcgggagagatgcttattcttttgacttcgcccctctaaaacttgtaatatataaattgcactataaatgatatcaaaaggaaaatttatcaaccacaaacttgtagatcacattgagctctacaatttcgatatagagcacagctccatctgagttcatttaaaaacataaaagtttgtttattcaacaatagatttgagattttgtaacgaatatcaggacccgtaaaaagtctcgaatgaaaaaacattcaactatatagttgtagagctctccaattttcataaaaagattttcatcatacgacttcatatatatcaagatactactcctttcctattgtagtagtgctattatttttaagggtggtattttcaagagaaccgcctcaaaagttaatttttgcgtgcctttccatataagaattgccaaaaaatgacatttatgtaggaagcccatctgaaaaaacttgtaattctatgaaaatgtctaaactttaaagatttatggaaagttcattttaagttcaaatgaggtgaaccaaagttatatatgacccttacaatatttttttatttatatttctgttagtataattgtttacttatcatttacctctatatgagttggtatgttatctaacgtgacattagtgaatgaccatactaaaagaaatgttctaagaaaaatattaactaagttttactataagaagtactagaacgatctcggagaactttagtttacctcaataggacttaaaatgaattatctataaatttctaaaattttgatttcttaaagaactgcttatacaaaaatagatactagagcttataaagatatttactacaaagttgtagatctagttaagctctacaattttaatatagaatgtctttatccaagatcgtttgaaatactcaaaagttcgttttcaaaaatagatctgagagtttgtaaaagaaatagatctaaacgtattatccaaaatgttgaaaaaaagtttcaatgtagatttcgtgaagagcgacaatttttataggcggtttcctaagaatttgccagttaaaaaatattttatacgtggtttataatcctggacagccgaagccatcttcacacaggtgattttcattttgagttgcctgtcaagagaaaataaaaagaagcctaagcctacgatttttttttactagtgacagttgatctaacgactaatatatatgatcctttttatatgcacagacatcaacgagtgtgatgtgtccaacaagaagaaatatccctgctacggcgtctgcaacaacatcccaggggattatgagtgccactgccgtgtaggataccagtggagtggtgaaggccccaagaaacaagagtgcagcgcaaaattccctcttgcagcaaggcttgcccttggtacatatgcacctcagcatttttttaaaaaaatataaaataatatactatatatatgtcacattgagtttacaccaattcaatgatttcccattgactatgtttttaattgtttctacaatataccattcaaccaaacaaagaatttcttataatgcctaaaaatataagggttgacagttaattgaaaaaactaaagaaaaacaacaattttaaaaaattagcctcctagcacatgatataagaatataagtgtgtataagtttcatgctttttgcattttattattttttgtaaaatataatatgtctgttatttacatagactacttttctgcatcgtttgtatatttttatacaaatcatctttcatgtgctacacaaaatatttttgttattttgtttgtaagtgatttctctctaatgccacatagaatgacttttcaaaaaaaatacatgcaagaaattttgaaacataaacagaaaattgtatattgtgtaaggaaactgcactaaagattagttacagcaatatattgtgcacgccaatattaatataacattagttgttcacaataatatttatcaaataaaatgagccttcattcatactccctctacccaaaatataaggcacaaccactttttttccatgtctcacaatataaggcttgcatacattagccatcacctcttggttctttaaatttggtttattttaaatcatctaccgttaaatcctccaatcaaattgcttgcatgtatggatgtgatccaatcaagaaggtgattaaattatttcttggtctttgtgttatgagtggttgagccttatattttgggatagagggagtatttctattaaaaaataatactgcaactcatatatggatttgttatgtttgctaataagttttttttaactttcgtaggaatcactttgggattttccttcctaattgttgctgttcttttcacgctaatgatgcacaaaaagcgaaaaatgaatgaatatttcaaaaagaatggtggttcagtgctacagaaagtggacaatatcaagattttcaccaaagatgagctaaagaaaatcacaaagaataattcagaagttcttggtcaaggaagctttggtaaggtgtacaaagggactcttgaagacaatactccggttgcagtgaagacgtcaatcgaagtaaatgaagctcgaaaggatgatttcacaaatgaagtgatcatccaatcgcaaatgatgcataataacattatcaagcttttgggttgttgcttggaagtggatgttccaatgttggtgtatgagtttgccgctaaggggaatctgcaagacattctccatggtgatgccaacatccctctcccgttgggcttacgcctagacatcgcaattgaatcagctgaaggtctaaggtacatgcactcatcaacaagtcgtaccatacgacatggtgatgtcaagccggccaacatacttttaacagataagtttatccccaagatctcagattttggaacatctaagcttcttaatgtagacaaagatttcaccatgtttgttgtaggaagtatgggctacatagatccagtattccataagaccggccatttaacacaaaagagtgatgtatacagttttggagttgtactgctagagctcatatgtagaaagccaacaatatatggtgaaaattgtagcctcatcattgagttccaaaatgcctatgatcaagagaacagtgggaggataatgttcgacaaggagattgcaaatgaagaagatatcctaatcctagaagaaattggcaggttggcaatggagtgtttgaaagaaaaggttgaagagcgacctgatatgaaggaggtagcagaacgatttgttatgctgagaagatcaaggaagtgtggatagggaaattatagtgtaagtcctcaacactgtgagtagattactatcgagggaactcctaagcactttggtgccagcatcagtgcaagaagcagtgcgatgctttctgcaccagccactccacttaactagaaggtggacaataggaagataggagctacaaacaaaaatatgtattttgtggtaggcatgatataatcaatgttatcaatcggtgtcatttcatttaaagtaaattgtgtttttcaagtatgtatctcctatttatgttttctgtaatttgaatcgatttttgtgtattgtagtacaaaactgtgtaatctattgttgttgtgtggaactcaggtcatgttatatattgtctatggttgttttgattgtagcacgtggcttggaaatatttcattgatgtgcatgtactgtaacattgcttagctatatctaaagtaaaaaaagtcattatccttgcaaagattttagtgtaatcttgcatagtttacagagatagattggcttgccacctatgcattattgggttccaatatgtgccaagaaggaaatgtctaacatttgttctcaaaatattttatatttctatacataggcccatttggttgggcttaaactcctaaatttaacttcaggagttggatatagagtggagttgtggagtagcctaaacctagctcaacttttctagtttattttataagagcactctagttagctccgatcctttttttttgtcaagcagaaaccttttggttgggctccagctccaagacaagttggagcaagagctagagcaagaggtggtgccatgccaaacaggcccatacaccagcaaaaatgcccatgcattacaatgtatcaagtcaacctttcgcttattcatcttctcatacattgcaacaagaaaaactaatataataattaaaaaaatcacatgattaggttacgtttcaatgtcaatatagttttgaagatgatgcggtgaattttttggataatggaataaattcaagcctttacttcaaataagctataaccacttattacaaaattctctcaaagagagcaaacattcagaccatgtcatagcgacgggcgcatccggcaataacagatccaatatacatcgtcaccactcagaccaacaccatgtagacttctcgcagcatgactgctagcaggcaccacatgtaggcgtcagcgttaatgaaggaacgttaacatagagatcgaacgaagaaggcaggtagatcgccacaacccaccttgcagcacgggatgacttaatgttgacatccccaaccatgagtggcgttggacggttggagtctgatgatcattattggtggcactagcattatactccctctaacgttttcaatttttttctaagttaaacttatgtatatttgatcaaatctatagaaaaatatagtaacattttcaacataaaataaaccaatttaataaaaccaattatattcaatgctagatttaataaaagcaatttggtgttgtaggtgttgctatatttcgttataaatttaattaaaattaaataagcttaacatagggaaaaaaatcaaagtgtataatatggtacaacagcagcagccacagccatcagagggttcagggtatcaccgcctccgtgcatcttcatatgtgatttcctttgccttccgcggagggcggttcaaggggtgcagactcggcggcagctgttaacctttgactgcttgcctttgacaagatgatgacgggaagaggctgacggcgaaggacgtcgtggagcaccggtggttgacggggaggcgcctccctgattttagattcacaattttttcacattgttttgattagcattgtaatctgtcaaacgagactatttaaatgttgttggtcgacttaagtttatttaatcagattgattgccttcaaaattttataccaaatttgtttgtaacagaagaaattcgtccatcctattgccttacatcttggcaagcacgctacaatactcttcctggacagaggagcaatgatggggtaaaaaggagcgtcatcattcgtccaattaatggcttatcaaaacttgaattttaaaatttgattttaaagttggttttttgatttttttttcaatgtagttttatttttcagctttggcttttaaatcactaaggacacatgtagtaatttttacttgcaaatcattttttatccctaaaaataagctgttacggcttatataagcagcaaccaatgacccaaaatcacaagaagaaaaactggcaggtaggtccaactgtatgtctgcagataattctttcatcccatcggtttaccactacagacgctgccgcgaccgcgagatacaaaacttgaacacgactgttttcaattcacaagcaccacatgcatggcacataagtataactgaaagaaaacgacggtacatgtcttaggctattgcaggtgttatgctggaccagcgtctaagcttctatcttgtttcataattagttaaaaaaaatccatcgcattgcgtgatggctggatttgcggcatcaagggaatggaaatgaagagattactccctccgtctctaaatatttgacaccgttgacatttttaaacatgtttaaccatttgtcttattaaaaactcactacaccatgtaccagaattcgcgacagatatctgttgggaaatattgctattcaacgtcatatgttctgtcgagaaagcattgtgacagctggtctgtcggtagttctcagaaaaataaggacataaagtctgtcggtaatgttactgataaattaggactaactatctgtcggtaactccgtttatgcgagcgcgaggaggccaggccaaaaatcagatgtgttcgcgggctggggccaaattttcgtttccctgcgcgcgcttagtaatctccggtctttatctctcatccccttccggacaaaccctagacttctctcacctcctccgctctcgcatctcgccctcgcaaaatcaggcgtgcgccgccgctcgctctcccccggctccccctcgcccgcgtacgcccgctctcccatcgccgtgtctccactctccattcgggctccctcgtccatctagctattggcgctgccctccctcttgtgtcatcaggcgccagcgccggcgccgccgcactccattcccatagccagccgccggagctggtgtctcctccatcctcctggtcggtctaaccgccacgacattggaggggaatgggggttgtcagatccggctgttccctaccttggggcgactggatccgtccagcgccgcatggtcctcctgcagatccccattttcagtgataaacgggtattttcttttaattagtcattcttactttgtgcgcagtagctagcatgattagtttgatgcgtttatgctcaggtgcgagggccacacgtccaggggtgggcaggcttgttgtacttcccctttgcggcggtactcattctcgctgaccctcgcatctcctcaatatacaagctttacaggtttcgtatattaattatcattgctttggatcttaaataactctgacaaatctttttaacttaattattttgctgatcaaaatgcatttgttatcagttttcaagaaagatatataacttgattcaagaatttgttaatcctgtacaaagtttagattttgactatatatagtgcatcacggtcatctttgcttgcctgatcaggaaacgtagacagggatgttactccactagaagtcttgaacataccttataggtgttgagctcagcagaaaatttatatgttgaactatagaatttggataattacttactcagactactaaattaagtatataaaatttgtggattaatgttcattccaatccttttaggggcatttacaaatgcagagaatgcaagtacttcatatgttctgaatatatgcaaactaaagtattttacagaaattcggtatgagtatattaattcaagttggcatttttatacttactgatttgcacttttaccattttgtgtccttatcttcttagcctgaaataaattggactttaattaatgcaatccatctatgtacctctgaagagcatgcatccagttgagatcactgatcattaggtgcggaaaatcttagcacttcttttctctgaaataaactcctatttccgttgtcaaaattatatatatagaaaaatgctttgcaggttagttcctgtagatcttgtttcatcatgtactcagtggttttgcttcttgaacatataataattctcggtttctatactttcctttgatcactaaaaattccagaagtgatggtggcaaacgcatttggataagataaatcttaatttgggctatgatggagtgagtggtctctgttgtttagctatgttttagctgcttaatgttctgtgacaaaatactttatgttaagttcctgtattgcaatttagacggtcttgtcttaagggggcataataatctttagttcctgtatgatgaggtgatctaatcatctaaggcttcctgctgcaatattgaatagtagtgtaaaggacattgaatgtgggcaggttagtatttttgaatcttctagtatgtattcacatttttattgcactactaggccacctcagtttatagattttagtaaattagcaatatacacaatgaaaagaaaactgttgtgttaaggaaattctttatttgccatccagaatgaaaagaacatgaggttcagtgcatccagttaatgtgttgcccctttgttttttaagatcaaactagtatttcacagctgagtttaaagagggaataaattctgatttactcggtatacatacgctattttgtttggccaacctgtgctgctttttacccatgcatgctgttctagttgcggcatctgctatgctctgattaactggcacagctactctggtatgattagctattttggactttggttaggattggaggctgtgctgtttggctattggttttgcaaaccatgactattagagggcagcaaacatctgattatacactaattgcttttgtatttccttttctttaatcttatcttaacatgcactgttcaagaactaatgcatgtacctcacttgttttcagattcctcatactggatagtgtccttaaccttggtggatatggggctgtagcatatgattaggtctgaactgctaagggtggtgctactgcctctggtttttccttagttcaattttatcacctcttaatcaagtgatttatgtgaagccaaaaaggacttgccacccttaggatcgtcaatgtacaaattctttcttagcttttttttttttaattcacaatcctctgttaaaatgctgaggagaatggtcaattggtcatgtacatgatgaatgaatgaatgaaatgaatcagacatttgagggtggttgtcattgtgaatgtcattagctattgaaattggtatgctcatgtaaacaggtgtaatggacaataatgtgaaatagttttctttttaatggtagcagagcttgctgtcagacagtgtgtcggcaaatctacttttttcatcaactcgtctgtcggtaaagatgtttctgtcgctagacatgtctgtcgttgaaggtaatataggggtcagttcatctgtcggtaaagatttatctgtcggaaaagccctttgccgacaggctttcgcctgatacacgtaatctgtcggaaaactctctaccgacagacaggatgatgctaaaggtggtatttaccgatagatgagctgttgcagctttcaggtcatggtgtagtgacttttgtgaagtatgtaaaactatatgtatacataaaagtatacttaacaatgaattaaatgataggaaaagaattaataattacttaaattttttgaaaaagacgaacggtcaaacatgtcttaaaaaaatcaacggcgtcaaatatttagggacggagggagtatatggtaagacttgtttgcgactctagggcagcagagattatcttacagaacatatcccagacgaccgtcagggagcaccattggtaccatcattcgagctggtgctggtcctctaccatatatcatgggctgtaacgaaaatgtccatagagacaaatacaatgtaacagcagtggcggatgcagacaaagcatttgaaaacgaagaaatatttgtgaataaaatttttacatgtgtgttcttagaaatctaaaagcaaaggttgaaaaataaacttcaatgagaaaatttcaaaatcaactctaaatttaagattgaaaatttaaattttggctgataagcataagcgaaaagatgaggcttcaggattcctagcattggtattcggagttacttaaatcatgtttcatagaatttatataaagatgtgttaacaaccaaatttggaatcatcggtgtcaggaaagaagattagatcgaagcgaagcggaggcggagatcgagttcggaaacagagcaagaatcggctggagtccagatcggctacgattaggatcggctgggtctgagtcagactaggtaagccggtacagccgattccgacaatgcaacttgatgtatgatattgggttgaattgaggcgcttcaaggtgattgccgcacatggatagagtcctgagaaggcaattgtatctattaattaggatgttttatgtaatctccttagagatacgcttgggcaaaagtctgccgcaaagacatatggtatcttagagtttgttagagatagtagtcatgtccgttatggacatatcttgtaattctcgggtataaatagacccgagccctatgtaacttttaacacacatgttcaatacaatttcggcgcatcgccacccttttgctttagttttgtttcgacgagttcttactttcaggttgagctgcatcggtttcgatcttcaacaagaggtaaaacttgttatgacggcttgtattctcgggattagtgctttcatctttatgacactctaatcttgtttatgtaattcgtcgagttatcatatatcttacataatctctggcaatatcgctatctaacctacaatcggctaagatctatcgaagagggcagccgattaggttagattttgacgttgattcagattatataagatatctaccactctatgaaacttccagcggcttgattttctagatattgttcttcttttcatatttaatgctgcatcagttgagtttgatctattaagtcgtgcttagaatatcaatctctagcctgccttctggttgccgattagggtagcatcagagtttcagccgatcttatctgatttaactatatttgctctatatgcttcattgacatgttaaatatgccctttatgtcaagatattgttgtatctaagtacattaggcctttgtttgatatattatacctgttttaatatcctgatatagagtagtatcggagtattagccgatacatgctagatctatctaatcggctatgctataaacatacatagtcctattattaatatatatttcgatctaagtgatttatactgtctcggcatagtgaccgatctatcccaatcacttgatttaagtatatatcgatataagaactatatattggaaatatctacagccgatcgaatagatttagttctttattgtctatttacaactgccgatcgattcacatatgacatcggctcaaagataaatggtatgtcatcggcacctagtcgatcaactatcatttatagatttaaccgcggtttgtttgcttctatttcttgttgattacaggatcaaatcaactggcacgctcatacattcgaaggcgagctttggacctgcactggagttaagcagatctcccacgcttcgtgttttctgtcaacacgcttttggcacgcctggtgggacatttaagaagtcagccaacaattcttcttcatggccgagaaacaaccaccaccaccatctagcccaggctttgttaaggacaagatgctaaagctaggattgactgacgtcaatgaaggaaacgtcgtgccgatcgatccagaaaaattcacacctgagcagaagaaagagtttgaagcaatgttgcagcaagtacgggattagttcttgaactcattcatgtagacccgcaaggggacacttgtttagaagtacaaaataaaagtggttgctgatgatcctgggaccagttcttttaaggatggagatgggaaacaagctccagacggctcggctcagccgagtatcaaaggtgctactgacggctttctaggaaatcaaggcgacaattctcaaggagtccatggagtacaaggtgacggggtgcatggagttcaaggtgatggtgctcaggggctgcagggaggaaatcttaatcagaatagtgatgtggcacaggattttttcaataacttccaagatcgggttgattacgctgtgcatcatgctttgatcaatcagtctggggtgttagtcaatagcttatcaaacatgatgaagtcaatagccgatggttcaatagctgagcatcaggctgcaggcccggtttatttgcaaggaggtgtcttcccaaattatcggtctttgattaccgatgttcagccatctactcaggcggttacctccgttgcaccaacaacttagccaacggcgccggcaacaactcccctacctgcttcatcagcgatggcgccaggccagccggtgaaccctcggttgttaatgagagagcagccacagcatggcgggcaggttgtgaatcggctgacccaagatcaggttgctgccatgtttctgccacctcaatctgttgttgatccaatacatcagcagccgattcaacagacacccccaattcagcaggttgtacaaccaatccggcaacaggtcatgcaaccattcagcaaacaccaccaaggcagcagcccctacagccgattcagcagacgctgttaagacagcaaatcgttcagccgatccagcaccaaggttcaataagcgcatcggccgggtttgcaacgcctggtggtcagcctgtacaacaatttttaaaccaagttgtcccagaacatttggttcaccacgtacagccgggtggcacagtaatgcctcaagttattcctgagcacttggtacgcaatatccagccgaaccttcataattaccaagggggtaacttgaattatcaatatcagcctccttccccgcaagcccaatatcagctaggggcattggctcaacctcagtttgcgtctcaatacggtcagttcgagcccatgcaacagcagtcacaaggggcagctcagcaacaaccgtgggccaatgtgattgctgacgtaatgagggaacagtttgggcttaaaccaaaagagactggaagtttgtatcggcagccttaccctgagtggtttgagagagttcctcttcccaattggttcaaagttctagacttctccaaattttcgggacaagatggtgtgtcaacttatgagcacattagccgattcttggctcagtgtggtgaagcatcggctgtagacgctctgaaggttaggttattccggttatctttatatggatcggcttttacttggttttcctctttgttgtatgggtcgatcaatagttgggccgatttggagaagcaattccacagctatttctacggtggggttcatgagatgaaattatctgacttgatagcgattaagcagcggcatgatgaacctgtgcaggagtatattcagagattcagggagatgaggaacaaatgcttcagcttgagtttaactgatgcccagttagccgatctggcctttcagggtatgattgctccgattagggagaaattctcgtctgaagactttgatagcttgtcacaactgatacagaagctaaccttgcatgagcataggtctgcggaagttaggaaaagctctaagaaggttaatcatgtttgtctgtacatgtatgggtcggatgatgatgaggatgattctgaaatagctgcagccgaatgggtgaggagtaaaaaggtcataccatgccaatgggtaaaaagttctggaaaagaggagaagtatgactttgatattactaaagctaacaagatctttgatctgctactccgagagaagcaaattcaacttcctgctggtcatacaatcccatcggctgaagaattaggcaaaaagaggtattgcaaatggcataattctaggtctcattctactaacgattgcaaggtttttagacagcagattcaagtggccattgaggggggcaagattaggtttgattattccaaaaagccgatgaaggtcgatgataacccttttcctgttaatatggtgcatacagctggccaaatagccgatagggtccgtgcaaggggttttcaggcgaattcggctaagattatcgacaaatatcatgaagaatacgatgatggttttgatccccattggggttgtgagttctttagattctgctggaatgaaggtatgagattgccatctattgaaaactgccctgggtgcagtgatatcgttgagagctcaagccgatcatataataggggtaatcgactaaggcagacaagagtttctgttcatcaaagattgggtccagtgaatcaagatcatggccaagaggacaatgtaatcaggaagaatcaatggtgtccttctggtattttcacgaagaatcagaagaacatttaataaatctagatttggaaataaatgtggatggagaaacataagaatttctatatgaacagaattggttgtagaatggtaagctctaaaggagaagtgttgactctagggagatggtatttcatgtactctagagatgtttgggaaaggatccaaaggaaatatatcccagagcaacggttagaggctagagaaataaatggaggggttttgtaaaagtcaaaagaaataaaaaggagggttttataaagtttgaaataaagaaggattttataaaatttaaaagagagcatttaactttacaaataaaatttaggtccaaagtaaaagagattaaaagaaagtaaggttgcttcaaaggaaaagtcgagaagagcacaactaaaacttttcgcgaaaatttttccctgaaaatttgagtatattgcatcaacccttcgctcattcatcttctcatacattgcaacaagaaaaactaatattatagaaaaaatcacatgattaggttacgatttcgatgtcaatatagttttgaagatgatgcggtgatttttttggataatgaattaaattcctgcctttatctcaaataagctacaatcacttattacaaaattctctcagagagagcaaacattcagaccacttcatagcgacgggcacgtccagcaagaatagatccaatatacatcgtcaccatggagaccaataccatgtaggcttctcacagcatgactgtcggcaggcaccacatgtaggcatcagtgttaacaaaggaacgttaacatagagatcgaactaagaaggcaggtagatcgccattactcaccttgcagcacgggatgacttaatgttgacttccccaaccatgagtggtgttcgaaggttggagtccgatgatcattattggtggcactagcattatactccctctaacgttttgacttttttctaagttaaacttctatatatttgatcaaatctatagaaaaatatagtagcattttcaacacaaaataaaccaagttaataaaaccaattatattcaatgctagatttaataaaagcaatttggtgttgtaggtgttgctatatttcgttataaatttgattaaaattaaagaagtttaacataggaaaaaaaatcaaagtgtataatatggtacagcagcagcagccacagcagccatcagagggttcagggtatcgccgtgtcacaccataaagttcttctcccaagcctaaatcgtattaataaatgaccccaataaattgtttgagtaatggcaagagagaaaccctaatttaataaattcaattaataatcggaattagcatgtggaatttttcttgggttctacatgtcaaaatatgctaacaggatttttagtgaaattttcagagctctagaaataattttaaccaattaaaattgagcacaagcaattattaaacccctggaaaatccttttttctttttctttttcccctcctttttccctaaatgggccgtcggcccatttcccctcccctttctgcccagcaagtggcccagccgccgccccgcgccccctcctctctccgggacaccgacaggtggggcccacctgtcgggcccgcccccaaccttcggccggcgccgcccgcgcacgtcacccactccccgcactcgccctgcactcccctgcaaccgccgccccactttcccgcccgcgcccacgttcgagatggctaggattcaaaaacaaatcccaccactctccctctctctccacctcccccacttcgccggccactccctgcctctctcggccacgtccgacctccccagacctatataaagcaccaccgcttcctcctccacttttttccctctttcgtcatccactcccgagctctccttcgccctagcaccgtgcaccacccgccgccgccgctttagccaccttcggccgccgatcgtcgccgctagagccgtcgccgagcctcaccgtcgccgtcgtcgggttcgcaagcccgcgggccacgccgtccaccccttccccatccaattccgccgtaggagtccgctttccaccgcgcgccggtgagctcgccatggccgcggccttcggccggcgattttgcccgcctcgctctccctcactaatctctctcggttgtttccctaggttgccccggagcccgtccaactgtcgctgtcgttttccatcactcgccgtcgtcgatcgtcatcagtgagacccctccccttttcccctctctcctgcgccgcctagccacgtcgccaccgtcggccgctcgccgccggtcgcggcctcgcgccgccgccgctagcgccgcgccgccgctcgccaggaccgctgggctggcttaagccgctcgcgcatgctctcggccatgcgccgccttcgccgtcagatctactcgtgttctttttatagtaaaaacatagtgaatcttctaaatatcatagaaaattcatccgtgctccgtttaagcccattcaagtctcagtaaatcaagaaaatgcaaagaatccattaaaaatggttttgttctctgtttcagtagtgttatagcctatttgcattgtttgctttgtatgtcgcatagattccggctctcccgacgctctggtgtacttcgaaatagtcgtcgaggttcctccagccgcagagcaaggcaagtcatgcttgtcacttgaacatattgatcccatattgcaaatgctctattattttcctttaaatattgcatcgttttataatgttacaatgggatgattacctactgtctcagccatatcatttgttatcctgttgctttgctagtttgggttgtaacatgactagatgttggattagggaatgcttagccattcttagttcaactagtacacaatgggggaattacgttaatgcatagactccagatgttggattagtgccactgctgtggtgttggttaattaaaatatattaaatggtgggctgtgggtgcatggttttgatggtagcgcccatagcaattaaggaccggttcgcgggaaaccctggaagaattcctcgtacttaccacaagccagcataggcaacggctgggcttgtagtgtagcttccttctagctgacgcatccaggcaagggtgggcgtgatggagttcggatgggccctgcgacggcctatgccgctttcggattcacttaggcacgagaagggactgcccgctgccttgcgaggactgggggtgaaacctgaggtgtggtgtgcttgattagatggggttatgcgaagggtcctatcacggcctccttccggtatgtcgtggtggcatgtcgacgcacgggaacgtgtcgtggggctgtgtcttgtgggtacagttgcaaaactctgatcagagtaaaactattcgaatagccgtgcccgcggttatgggcggtcaaccagattcaccgtgattagtctcaccctagattagtttaatggaactgattagttcaggtggtggtttgggcttgtctcaacgtggtgtagcgttgagcagtgattggtttaatattggctaattattacaaatgttttactgctttcaactactgtttataaatgctagctttatacaaatgaactcttttagccctcctttggttataccttgcatcataccctctgttccggtatgacttgctgagtacagtgggtagttcttgctctatctcccaacccttagagttcgattatgcgtccgatggtggtttctccgaggagtaggcttcgtccgtgccgtcgaggatgcctgtggagtggtgttcccgctgctatccaagtcaaggcttaggtcagccgatggtattatgtggctagcaggaagttgtatatgtttctcccgaattagcaagtcaaaaattttatcagcttttgtatatgtttctctgaacctctggatgtaatcttgcgcggtttcatcatgcctctgcctaactgctgccagatcggagagcttcatctcatgggtcccactgtagaagtagctatgtaattgcttctccaaatcgacccaaccttgaacaaaattgtaaggcaatgaagaaaaccatgtgaatgctgatccggacaaagacaaaggaaacaactgaacccttaaagcgtcaaccgccgatgcctctccacactgagccaagaatcgactgacatgttcatatgtcgaaacattgttctgtcttgagaactttgagaaatcgggaactttgtatcggtttggcagtggaaccctctcaaaccgctcagggtatgggtgccgatacaaatttccggtattctttggcttaagtctaaactgttccctcatgacatctgcaatcaagtcggcccatggcctctgttgaggtactccttgcacctgttgttgtatcggctcgaactgattgagttgaggaacatattggggctgaggtaatcctccttgttggtactggatgcgaggcgaaggaggttggtattggtaattcaagttaccctcttgataattctagaaattcggctgtatattatgcatcaaatgcttaggaacaacttgggctgcaaccgattgatctggttgtacattatgtaccaagtgctcaggaataacttgagccacattctgctgtctttgccgattatcaggtgttctcaacccagttggtatcagctgcaccatctgctgctgaatcggctgaaccgtttgttgttgaatcggcgaaaccgtctactgttgaatcggctgaactgtctgctgttgagtcggcgtcgacaacactggtccggcagttggctgagttggtaggaacattgaggcaatctagtcttgggacagccgactaatattctgaccagcatgttgcggttgctctctagaaaagagacgaggattaattgtctgcctttgcaccgatgatggcgcagctgagatagccggagtcgaagctgctgccgtcgactgaactggtggtgcattggaagtactctgttggttacctatcaccaagttcctgtaatttgggaagacaccacttggcaagtagactggccctgtgttctgatgttcagctatcgtgccaaccatcacagatttgaacatatttgttagtgtattgacgatctctccagattggttgatcaaggcatgttgcaccgcataatcaacttggtcatggaaattggtgcacctaggaggttcttcttgcacttcagcaccatcttcgccaagatcttcaaccacaccatcctgaagcccgtcacctttgtcacccaaggcatctacaacacatttaccaccttgagatgagcttgagccaacttcatcagcagcaaccactttcagcttgtatttctgaacaattatcccttggcgggtttccttgaatgagttcatgaacttgtcctttacgctactcatcatctgttcaagctcatgcctctgttcggacgtcagtttgtctagtgtgattggaataatgtttgtctcattgacctcagactcaaccccagttgatggtagattagttcctggaggtttcggaagcttggttttcggaggaattggcggcttgcttgccgacgacggaagattgcttttctgttgacagtcagttggtcagattatgcgagtccccacgtcgagcgatgccagaaaagcagtgtgtgaggtcggaaaagaacacagcagctggcctgggaaagatgctgctgtaacgttcacgtgcagagtccagaaatcttgctatgttaggttgcgtgagcgtgccagcttcgatttgatcctagtaatancaacaagaaacgaaaggacaaaatgaaacccgtggtttaaatcccatgaagcgatagccgtatcggcccagtcgccgatgacatatcatttatcttcgagccgatgtcatatgtgaatcaatcggcagttataaataagcaagataagactaaatctactcaatcggctgtagatattaacactatataaaatccttctgtcgatgtatatttaaaccaagtgattgggatagatcggttgccatgccaagacagtataaatcacttagatcgaagtatacattaacataaatattataaatgcttatagcatagccgatcagatagatctagcatgtaccggctaatactctgataccactctatattaagatattaaaacagatagaatatatcagacagaagcctaatatactttattgcgataagatcttaatataaagggcagatttagcatatcaattaagcatataggataaaaagctaaatcaggtaagatcggctgataacccgatactatctctttcgatgatcataaaacaagccaaatatcataattatagatattacttaatagatcgaacctaaccgatgcagcattaagcataaagacaagtatgaaatctaggcaagatgatgaaaacctacaagagatggtagatacacgatacaatctaaattaataacaaaacataactctaccgattgcttcctaacaataaaaaccagccgataacaagttatatagcgcaactaacatagattgcaacatgcatatgataactcgatgaattacataaacatgattaaagtgtcataaagatggaagcattaaccccgagaacgcaagccgccatgacaagttttacctctagttgaagatcgaaaccgatgcagctcaacctgaaagcaagaactcgtcgaaataaacgaaagtaaaaagggtggcgatgcgcggagattgtattgaacgattgttgtttgattacatgggttcaggttctatttatacccgagattacaaaatatgtccttgctggacatgacacttatctctaacaaactctaagataccataagtctttgcggcagacttttgcccaaatatatctctaaggaaattacatgaaatatcctaattaatagatacaattgccttatccgagagctttatctccatcgtggcaatcctcatgaagcactttgaacgattctagaaacaaccttgaaaccatcttcatcggaatcggctgcatcacctctatcggttgtatcggctatcctctgtccgatccatctcagctgatgcagactccagccgatgccttcgcagccgatgcatactatgttcttcgaatcgatctctttttcgaatccgcctcgatcccaatgtcaaacctggttcacaatttaccaaatttggtcgtcaacaaatggtgtgggtttaatgttcatgcaaatgattgctctatatcgatcgcaagggtgtagagtagtatttaataatgtaagtgcggtgcttagattatcagatttcactatttgggcttatatgccacgggtcagtagaggtgggccactgatggtgacaactcaatacgggtattcctccacattcgtatataatcctaagaaattttcgtggtatgggtactcctccgtattcatttccgatcagatatccatgacttattgtcgtaaggaactcgataatcagaggtggtctctcgaaacaccaggagggcatagttagggggtattggctacatgattatatactagtaagtgtctggtggcatagttagggggtattggctacatgattgtatactagtaagtgtaaattactgatatctatatactagaagtatatgaatgattatt

SEQ ID NO: 59221 - DNA, 2199 bp, Oryza sativa
  unsure (1)..(2199): unsure at all n locations
atactggtacttgtgaaaatttgtgatttgagcgatgctatttgatttgtaattaagctagctatctcttttttcttggaccgcaatgtaacatcgtgttgctaacttttaaactataaaagtaagataaagaagtaacaaaagtgtgtgcttgctatgtaggtctattattcggagcaacaaagggaaggaatggagcaaactttggacgtacctagatcgttgaggctaccgacaccaaaggctcaacaacaaatggatgaattttggagggatcgacaaaaagagattgagacaacaaaggactttagcgagcatgcgatccctatggcccgcttgaagaagatcgcatcttctcaaaagggtaacatgatgatgtcctttgacatgccagcattcttatcgaagatgtgtgagctcttcgtacaagaacttgctgtgcgtgcatgggcatctgctcaatcccataaccgttgcatcatactagacacggatattgctgaagccattgcctccacagagtcttatgactttcttgttgatatcctccataatcaccgtgagaagcacaaatccactccttgttctacacttactacaaagcgtgtaggttagtcgatcaacctttcacatatcgcccgccctaccaacatcagctgccactgtttgcttctacatatactccagccatccctattactcctagtttaatgccaccaatttctcactatataccgntccaatatccatccttatcacaagaagtgtccacgatgatggcttccgcacccatagtgaatagatcaatgttgctcattcacaacatagcaaggggtctaggcttacaaggaaacaatatcagcacattcgccaacaataatatcccagacaatattattggttgtagtagccccgcggttcttgcaagtatgatgagtcctgctttactagacgttgcaggggcatcactaaatccgccaaactctcactccatctgcacgatgaacatgatcaactcgagtgatcccagtggatctagcattggtgacattaatgttacaaatcaagcaagtcttgctccctctgaacattttaaccctgctatccttcaagagtcctcatgtgcttcgttcttatataataacaacaatgacacgattgttggtgtaccggagggtgtagatattagtggcaccagggatgttgctggtttacttatcaatggtcaagaagaagaacatgagaggaaaacaaatgttgagcaaaatgagatatatgaaagcattgatataggaataatcaatgcaagtgttgcggatggtaataaatgcagtattaggtgggatgaattaggaacggccgatgattcattgctagataaatttttggaggagtttcaagcaagaaacgacggtgttttgcacagcgggattgtgttgcatgaagaccattcctaggtgacgtgattttagcaaacccaagtagtagcaatgccaatataagtaattgagttggcaagttttgtttatgtcttttgtaagaatgaggttgtaactctttttcttgttgaatataatgttgtttgtttggagagaagaaagttagtcggagtaaaaaaaaaaagaagaagcatatgactatgtagggtgatcggtacttgcgcatgtgtggtccaatcacgagttcattatctgtaattgggacgaagtaaacgcagtggtgatgagaatggcacacgcgtacgtggcgtgggaggggagcagggaggccagcccaccaaccacatcctcctcctgtgtgtgagtcgtctggatggatgttaccaaaataaccaagcaagataggaagggaagaggaagtttccagaagaagggaagggcaagaaaggaaatactactactacacctgtagtgggtgtgggtgggtggcaggcagaggaggagccaagaagcaacggtcacatttcctttgcttaccgtgttgtgttggtctcatcgtctgtctcgctcggcgctcgtctttctcccctccattccatttttccttctcctcttcaaccaaacgaaaccctagccgcctcctatagctaagctaagctccctcccctcctccctctcatccatcaatgggcaagctcctctgcgactcctcctccgccgccgtcgccgtcgccgaggcaccttcccctgcccctgcgcc

SEQ ID NO: 59222 - DNA, 1597 bp, Oryza sativa
ggtgagttcaagtgcctcgagctccacggctccgagacggtagatagatggtaggggtgaaaacggtacagaaacgaatggaaaccacatttatcattttcgttttcatatttttttgggaatcggaatcggaaaccccgaatactaaaatggaatcgaatattatcgaaaccgaaaacatcgcgaaaacaaaccggcgtgaatatagtaacgaaaaattatcgaaatacaaaaccccttaaactaataaatccaattcttaagtctgaacggtcaacaattcatcataaaacacaatcatataagtccaattgttaagtcttaacagtatatcacaaaacacaatctatggaataaattgtctatatttaagaaagtaatgttgttgataaatcccaatgtaggaaaaaaaatattcttacgtaacttcatatttgcataacaaatatttttaaaaaaatagcagcaaacaccatggtaatcactattcagtgcttcaaaaaagaatccagggtatttcactcacaaaattttcggaaattctgagaacattttcggaaagtttccgaccgatttcgagttccgacggaaactgcccttatcattttcgattatgtttccgagaaaatatttctgaattcgtttccatttccgaaaaaatccgaccgacaaattccgttttcgaaaataggtccggaattcggaaagtttccgtaccgttttcccccctaatagacggtggtccagtctaggtgtcacttcgccgatggtctagaccagcgacgagatggttgggaaatggtgatgggacttgggacatggcgatagcgggatggttcatcagctagatggtggggcacgacaatggtaagtgtggggctctgtcttagccttcgatgcttcgcttactcttgtcaacatcgacgggacaacgatgaagtgggtgtagcttggttgcgcttgtggattagtcgcggtaggtgaggggatgtgagaaggaggttgatgtagtggaggaagaggagttgacaccatattatggaggtggacaagaagagcgtgagagagaagggtgtgcccatgagatatgggctctatgtatttgttttatttactaaaaactctctaccacatagtcagccaaaaccgctctcaaaacagtctaagaaaggtcaattaatccgattttaatagttaaggaaatgactgatgtgacgcctacgtgactggtttgacttggtcctcgtcctactttgtcacgccccgaactagtcccgaccggaactagcccgtgacgctccaaattaacctgttaatcgataccagtcccaggaaacagtgctggtatcatagggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccataaaactcatcgtagccgacttgctcctggaagaactcctcgtcagcaggatccacttcatcttctttagcaactgg

SEQ ID NO: 59223 - DNA, 3079 bp, Oryza sativa
gctacctctgcagtgaagagctgctggaggatgttcttggaggcaaagatgccctcaatgctttccgggaatccgacctcaacggctacctcgaagtcgaggtacccttatttcttcgtgtccaacttactttatcttccaagttccaaccaatctagacatagatacatcccttgatttaacacttgtcttctcttgtaaatgatggcagactgaaggcctgaaacagctcacctccatgggcagcctcgtgctttgctgtggggatggtgctgtcatgaactcaaccaatctgtatgctgccttcacccaccattctctcatatctcacatccgccttctcatcaactcttcttatgctaattctcttagagggctactgaggcatggagtctccatttggattgatattcctctggaattggtggtgaatgatatgttgaagacacaagctacttcagaccctgattccttttctgaggttcatctgtcctcctcttgcacaatcctctttaagactgcaaccttcatagtttctcggtttttacacataatacatataactctggctacactatgtccagcaaccctttatttgttaaacaacaatcgactccagcatttgttaacaacagcctgtgaatatgtattcaagtatactcccttaataatcttttcctatgtaaaacacactgcctcccaaaatccacatcctgttgcttgatgcgttgcgagtctaggttgactccatggctggctatatttctgactttgtcgttgcattaaaatgactttattaagagccaactttgttgtcacttgactgcttaatatctgccggtcacatctgaaatgtcatgtttgcaggcaatgagcagagtccgacagcgacacgatgaactaaaagagcgctatggagtttctgatataactggttcagtacaaagtaaacagagagatgcataaacatcattttctttcataaaagtggaaaagaaaaggaaaagaaagcaaattgtgaattatatatatgggtgtggtattattgacttggtggtgaatacctttcagatgtggcatctcaactgggctacagtagcatcgactcagtgaccctagaggacatggtccttgaggtacccccaatcagttagatagataaaagtagtaaaaaagatgttgtagagctggggaagaaagaaagaaagaaatgggttttgcgaaagaaagaaatgttgacagcattatttttgtgtgtattttgaacaacagattgtgaggcaaatagagaggctgatccgagcgaagtcgatgatggaagctgctgggaagcccttctaaaagaaggaaggatccattgatgtatagactgttggtcatgtatgtacctcctgatccctgaggaattgccttagatgttccaggaccaggaagcaaaaagtgccgccacagctactgattgattaattttgtaccgaatgatcaatcattcgattgatatttttacattcccttgtgacttgtgagggagacatatgtagcagaatgaaaaagaagtcgaatttattttcaaaaaaagaagctgtgagtgtggctagaatctacacttgttcatatctatgcttgttcgtcagttgtgtttgtgtcaaatgagcaagtttgtaactgtggacaggatgacaagtgggaactcgatggacaatgcatttgctttggtgcggaggcccatcaaatgcagcccagcccagggaggtccctatcgagtagtaagtgagtagaagaaaagtctgatctccacccacgggcggagttgacatactagtagtagtagtactagtacacgaggagaagaagcaagaggaagggcatccagaatcagatccacaaggcagcagctgcagcagcatcgaccatggcgatggcgcgatccatcctcctcctcctcctcctcgccgccgccgcctccgcctccgccgacgcgcccttcctcgtcgcgcacaagaaggtttcgctctcccgccccaagcctggcgtcgagcgcctcgccgtctccctcgacctctacaaccagggatccgcgtaactactctcctctcctcctcctcctcctcctccgatctctcctctcctctcctcgttgttgcaagggaacttcacttgtctttttcttctcggatctgcatctgaggatccgtcctctatttctatagatagatccagaccccttccatgtcgtaattgccaactaatcaaccattactctgctactgctttcttttctacgcttaaaacaaacaagcaattaactagaaagccaaaagattcactgcatatgctagtatctttaaattgcatgggcttgtgctccatctcatcatctactgttatgtctttcttgccagattatgttatgctaataggattctacttgtaataaaccacacatggtttagcctatttacaatggtttcactctctgttatattcgccttattttgctgaaattacatactaggtgacttgccagcttattcaccctatgccttttttgttccctccatatgttcttacaatgcctgctatcaacatttctctctctcaagtccaaacttttccatgctgcccaaagcaccagctttgcccaaaactaacaacttaactttcttccccgagaagtaataacaatttcaagctaaagttggtagttcggacacaacaacataactgactctttttatgtacagaaatatggattattgctaaattttagcttggaattatttactggatcttggtggaaattctgttaaagattagcttagcagcccatggagaatgagaatgttttaaatattatttttgccagtgtttacctggacaccaacacaggcctcaaactctgccttgattcgcgtgtctgattcggcagaaaagaattgtacatgcaacgggtgcccgaatcctactcagactcaggatgtcagactcgacaaaaaaacatctgccattctgatatgatgtcaaagggtgttctggtttatctattcttttccctgaaagtgcattacctatagactac

SEQ ID NO: 59224 - DNA, 3198 bp, Oryza sativa
  unsure (1)..(3198): unsure at all n locations
agccgacgaggagacggcgtacgggcactacatccaggcggaggtcgacggcggcgcaagccgcgacgtgatggagttcctcctcaaggaatcccagtcccagtcccaggaggtggtggccgcgtaccgatgcgtcgccaccaaggtcatcttcgtctaccccttcaccactgccgtcggcgattcaagagggcagagccagaggatcaccgccgtcgcccaggagctcggatggtacgccccggacctactcaacgccgccaccaccgacgaccactctatcctcgactattaaccaaggccatacatatgcttgcttcattatctctagtctgtacaagtacaactcgtccaaattcattcatccatccatccatccacgacacatatacaaatactaatctattattactactaagtagtactagtagccaccgatatatatacacaacaaatgtattaatcaaaatgctaatttatttctacgccggccgacgtccttgcacttttggatgatattgggccttaattntcatcgtaggtcaccgagttagcccatgcactcgttactgtgtcatgaaataagcatgtgggcctcacaggtatttttaatttttttaactaacaccagctgacagacatgtagggtgcttttgaattttttgtcccatgtaaacatcatatgggaccaggctggatccagaaaaaaaaattgaggggcttaattacacagttttttcaccttcagccatttagggacctttagtttatcattcatggtgaaaaaaataaaggggtgctctgggggtatccatgggtcttgtgggtgtaggggggactcgagtccccacgcatccacgttggatccgcccctgtatgggactaatatcaactaaacaagccacatatagattaggactatgcttgtatcttcatatctctatttggtttattaggccactttgttccatgtattttatacttccgagacctcacagatcaaaacatggactcatccaaggcccatatgatttcgcctccccatctaattagatgtatagggctagatgtccctcttctttgtagttgtagggccctgtcctgttgacaagaaaatcgaacacatcggcctaggagatctgcttagctccagtgcaggtccaaatatgatgagatgcaggcgtgccagccagtttgatcctacaactgacaagatatgcaaatagtagatcaaattagccgatcggctaacaagccgatggagtagttccagccgatagccgataatagccgatgtcgataccagccgatagcgatagggtttaagcaatcggctatatgtcaaatatagataatgatataaaggcaatcggctgatgatgatgtaatatagcaatataatccagtagaaaccaatcggctcacaaatatgatatagtagaacaagtattgatccgaaggttaaagcacccatcggctggaggtctgatgtcatgaaatccacaagattagattaaacaatgaaacctttgttgtcatcggttaaatccaacttatatgtatatgcaatccttatgagccgatgcaacgttcagataactcaccggctgaaaccccgatgaaacccttattggcaatcaagaagcaggctagacattatggttctaagcatgacttagtagatcaaacttaactgatgcagcactaagtatgaaaagaaacataatatctagacaatcaagctgttgactgattttcagggtggtagatgcctaggctaatttaatctagcaacgcgatttagccgataccggcagaaacactaaagcgagagacagccgatagagctaaattgatatgctaagactagattaacagagacatgataaataggtaggcaaatatatcatccaaaccagagcaatccaagaggtcaaatgtactgatgcagccttgaacgacgccgacgtaaatgatacaattgcttgggccgacggaacttacccattcgctggagatcgaacactgatgcagccccgcgtcaggtgccaagtcccgccggacgataaaataaagtagaaaaggtaaaaggtggcgatgtgccgaattgtattgattgtgaggataaattacataaaccccgggtgtacatatttatacccatgggttgatacaagtccttgtcggacaagaaagaaactttcctaaagataaaaggaaaagataaagtccttataggacactaaatacactttcctaaagataaaaggaaactaacaaactattcctaattaatagataacttgccaagccgcattctctttgaactcggtctcttctagataagcttcctctagtagatcaattttcttaccgaatatagcaagaatccgacaactgacgacttgataactctcattggctaatctcaggacttcgaagccgatgctgactctaagccgatgactactccgggcttaccaaatttcactgttaacatgtcccaaatggggacatttccatcgttggcaaccacacaagtattgagatgattatatatgcaagtaaagaaatatattggagataaaatgatcgtgtatccacacttcactacctcaaaaaacttaataaaacctatggataggtgatcggtaaggaagacgttcctcattaaattatagtagagaagctatctgatttatgcacgaaaataggaaaaatagtaaatttatgtgcatacttatattcgcaaacgattgaaataaaatatgctttgaaaatgaaacaggcggagcacatgacaactggcatatcgtgccaaaccgaaccctccagaaagatgaagtcccaaagcatagaaagcactataaaagtcgacccacaatatgcactaggagcaatcgatggattgagtagcttctctagccttgacctcctagcgctcagttgttatacttaccctctaagggctactaggcctcactcatctcttcgtgtatatttagccttttatgctacccgtggatctctttcgtcattgatgggtataccgtttgtggttgataccagttttataattatctacgggcaaagatgataaatgccatatatcgaaatgacaaggtaattttatcttctccttatgagtttttcaactcaaagttttttttgcaaccaataattagtctctaatattaa

SEQ ID NO: 59225 - DNA, 898 bp, Oryza sativa
cattccaactgcgattcctttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgagaggcgtagagcgtcttctcaacaggagtacactgcactaagttgagttttctatcaacatctttcaaccaatcgtcagcctcgacgggctcgacggtctgagagaactctggcggacgagacctcagaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgtggcggggttgctcaacctctgcgttgcgggaaacagtacgatgcgaacggttgctgtggtgagactgctcattagctgattcatgattttcttctggctcaactctaccatcctcaaaaccaaagcgggctggtgcacgagctgcacggcggggacggctagccatctaaactcccagaagagcgcggggtaagagtcagataagcacttaggagggcaag

SEQ ID NO: 59226 - DNA, 2758 bp, Oryza sativa
actactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaagaattgcctgtgaagtgaagtcgcccgctgctgaagtcaagcttcccggtttagctcgcttttatcttttccgctgcatttgtaatattttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggattttttttttttaaaaaaaaaatgagctcagcctagggctttagaaaaattttagttggagtttattcgatagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttattgatttgagtcttcttttgctttgtttaatttggatttgagcatgaattggttcctatcccttgtctactttagatgtcagtcctatccctcgtttgcaagcgccgcctcgagcttcagagtcaccgcccttagctttatcgccttcttagtctgtttgcttgctagttttcgtgtttaggtttgatgcttgtgggctagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcagatggagacaaggaatggttcacgtgactcgaacaacgctagtggcagtgaaaagccgatcaatggagcacgtgccaacagtgcatttgacaacagtccgtccccaccgcccgagaacccaacaattgctcaggtgttggacaatcagactcagatgatgacaatgatgatgcaacagatgcagcaacagtaccatcaggtgttgcaacaggtgcagcagcaagcacagctgcagcagcagaacctgcagtttggttctccacctcctcagtccaaactgctagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacacaccagctgcaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctacaacaaggaaccagaacagttatagagtatttgcatgagttcaacctcctcgcgcgctacgcccctgaggacgtgcgtaccgatgccgagaggcaggagaagtttttgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacgtcacggtggaccttccaccatgattatccgacagcaccgtccctaccacccgggtagcttcaacaagaaccaccataatggcagtcacaacaacagtgagcagcacagtctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatccttagtgaagcttaagataccaatgcgagtgcatactcctggaggtggcatgaccacaactcactactgcccatctgtgacagttgaaattcaagggttgatttttccagccaacctcattcttctcgaatccaaggacctagatgtcatacttggaatggattggttaacaaggcacagaggagtgattgattgcgccagccgcaccatcaagttaaccaatgcaaaagg

SEQ ID NO: 59227 - DNA, 8491 bp, Oryza sativa
catgctggtcttcagtccttctctcagattcttttcaaaattatcataaagttcacgtaccaggtacagttgaacatatgtattgtagcttcagaagtactaacagtacagtacagtggacttgacattatcaacggtaatattgtgattgtctttaaacctaataagaacaccaatcaattctttggtttatcaaaaatgatggtgttgtagcatgggataaacaccgtccccccatgctcggccgaaaacatatgctaaggaggagaatgagttcgagtcaaattatttgctcaaatgaagtttccatgcaaagtgattttcagtccagaaattcgtgctcaccaaaaaaggcctgttccaaagggaaatgtatttgagtgagattgcttgctcgaactaacatcactaatgaagttgtgttttgagcaggtcaaagagacaaggagccagaaaggtgggaaaatgtgttcgagtcctaacatggatgttgtcttgagcatgtgaagttgaggaaaagtaccatcgaggatcgagcaaagggtatattttgggaaaatatcaaggggaccacctcaactcctctcaccaactagcaccagatgtcacctagggaccactaaaatgtaccgatatgcccctataggtcatgaactttataggggtaatataataacttcgtgtaaacctgtaatagccaacttgtaaatcttggatatacggttgagcactatttaagctaaccaagaccctatagcatggggcgagatcaatagggaaaaggcatatttattcactttggcatttgtcttttgagctcactctcaggatagacgggtgtcggtgaaatgggcccgagggtacgcacagtagagggaagccgccttcccgtatgggcacgtggctaagcggcctggatttcccccgcccccttcggggaggcggtcaggtagcgctgacgcggccaagggcctcgaggtgccacatcacgaccctcgggccctcagcgtgcgccaccccgaggccctcgcccggccaccatgtggcggggagagcgggaggtgcagggtgccccaatcgtcccacgccgcatttaatgcggtgtgggtgggcgtgtggcgccgctcgattgacccctgtcaatcgagcacgaccggcctgtgatcggtccttggcgactggacgagcgacagtgcccccacgtcccgccctgtgtcaggcggagtgggggcaggtatgccccgtcccgtcagcacactgccgagtacgccgcctacgcatggtgagtccaccgtcttcacgcatttatgaggaaatgacagggatgtcccccgtgtcaggcggagggcggcgcaaggccccgcctgaagccaggcaaccatgttgcttccggttgaagcaaaggatagcggtatgattagggccatatggcccccctcccttagaggggtaggtgcaaacgatgcatgtggtatccccttgaactataaaaggaggacttcgcccgccgagaaaaaggacgactctcagataacttgagctcgggaggaagaacagttaggtttccctccggagctcaaaacctcttataagaattcaccataatcccatacataggagtagggtattacgcccgatagcggtccaaacctgcataatccttgatctctcacacagccacgagggcgatctagcggttagacgacaagcggaagcaactccttgatcatcgcgccatttcccccaaccgaactcacaaagggggatctcacgatcacccgctagagaggatcacttctcgacagtgggaatttacttttttctcgtctatcccccaactttgtccgtgccctaaggtcacgacagtggcgccgtctatggggacgtaaagtctcccagaggcgagcttgaaaaggtaaatgcaacgtccacaacgagcgaagacagtaccagcaagatatacagatacattctcaagcgcggtaggtagcataaatgaatagtacataagcagatcccgatactggaagaactgaaaggagagaaactcaagttgaaacaatcattgaggaagtcaagaaacggcaagaacatcagctccgacgaaagtagaactagcaaaaaatggtgcaagcacaaggggttgtaacggtgaacagagaacaatatgaagggttacaaagggagttgcagcgattgcaggctttgcattatcaagcaatgagggcaaacagatcccagaggcaagaagggaaaacacaacgggctgacggaatccaatcaagccgtgcagtggagaatactcaagaggagaatgcacatgaagaaaacttgcaaagaagaattgctcgaatggaaaacactcaaccaatagaaccacgcaaggaattcctcaaatccaaaattttcaaaaccaaattccccaaacctagaatcttcaagcccgaattcctgaaacccaaattcccaaacaaagaatcctcaaacccaaattccccaaatccaaaatcttcaaacctaaatccctcaaatccaaaatctccaagctttagatccctcaaacaaaagtgcttcaaaaccaaaatcctcaagacaaaacttcaattcattccctcaagtcatttcccaataccaagtattttgcactcaacccaatcaaacaatccaagaacaccaaaaccaaacattctaacaataccaatttcaacagcaaatgccctaccaaaatacttcacaatattttggccaattccaaaatcagataagcaattttccatcaacccaacacctccaattccatccaactcgtgctacagataccaaaaaccctctaagccaaagtttacaaatggcaccatggccagcaaatttcaagttatccaacatcagcaaatacaaaggcgacgctgatccaaacgattatttgagggtgtatgaaacagcagttgtaagccaatacctcctgaaatataaatatcacattagttgcctatattttttgaaatctctcataaactattacatttcttacatctcaaaagacaagagataggcaaacaattcacgctcataaatgtaatgattttatgttttactgtttcatagcaacatgccatttagattaaaaaccaacaatgttagctctgtacatcaacatgtcacgactaaatatatattaaaaaacctgaactacaaacaatgaaacatacatgcacattactacgaataaactaactacaaacaaagaaacatacatacacattactacaaataaactgaaaaaggataatactccctccattccaaatttatctacatatttcataggtacatcaagaccacgaaaagctaataactctctcatattatatttactctagcaacaaactcgatgcatgcaccatccccactattttctagccaatagcaaatcaagatattgcatgtgtggttataaatacttatgtgcatagatgcatgcatcaatgtccatttactccaatgcacaaataatgaataggctcaatgaatgaacacaaatatatagatcatttaggaataatctcaaaaaacactatatgtagatcaatttggaatggagggagtacaaaacaaacctttgattcttatatcttcctctctttctctttcttcaactctactagtttgttaaattccaattcggatgtctgatcggaagcccataactgaatcataagaaactctaatgcccaagatttgcgaatataatgctcaagatcagactttgtcttacccaactcgatttctttatggccaagtttcgctattacctacagtgtaacaagattgttatttaaattataattgcaacaaaaatttaaaatattaagcgtaatacataaaaaaataaatacataagtttaggaaattacatctgatggaatatattcaacttcatgttcgataatgtctctaagttcatccaatagatttcttaatgttttcggtgcagattttattcttttgttgccaatccataaaggccttgtagattcaatactgtttgcatctagaaactctgtcaatgtgtatgctgactttgattcatcaagtggatgtatttgttttggtttgcaatgaatactgacatgagtccaaagaaacagaactttctcaaatttttcgcgcacagacaagaaagcactctgctgaagaatatctaaactgcaacaattaaaaaaaatagagtgttagaagtatggatatgtcaattaaagataagagtcaaatacaaattatagagataagatataatcctagagataaaatagagtactagagatggaatcctagagataaatataatcttgcttgtattgtattcctatatataccccatgagagggtcgatgtaaaccaacagaatacaattagatttttcacatggtatcagagccttagagatcaacgtcgttcgattctcgcgtcgccctagggagatgagatcaatcctataatctccatggggcgccgcatctattagctaccaaattaccgatatattagaatctttcccaatatcagcattagttaaatcctattagccaccacgttcggcaaccagttagtattagattagcttttcaagttttagaaaattgcatggcaatctcttcgtgcaggagttgaagcgcagcggcatgaatgtcgtgttaccacaccattcgcaccgacaccctcccgctcttctatgtcaggacagcagcgacggcagcaccaggacgcccaggaaggaaccatctactactgcatccatctactcaattgagaggagaagcacatggtgcacaggagaataagatcctcacgcccggtgctacaagcatcaaatcaagcgtcaagccaccaagccatctgcgtcgatcatcttcgccaagttcctacgaccggcagcgacgtaagccgcggctgctacctcctctacaccagccatacatttgtcttcgccgacactacattaccggtggtcttcattaacacgtcgtcgccgcatcgtccacaagtatggacacatgcgcgtcctctaacagatacatttgcagtatgcttcatcagtgacatcgaccgtgtcctctacgacggcaacgaccgcatcaccgatgacggcatcgatcacgtcatctacgatgacaacgactgcatcaactcggcatcactattgtgatgaccgctacacggtgcagaaggaccaaccaaagtggtggcctcatcgccaatgacgtcctctgacattcgtaagacgtcttcaacggcatcctctgacatctacaaggtgcaagatgctaacaattgcagtgccatcttaacaccatgtcgtaaatattttttttccgcctttggctattcgcggctatatcaactactatgatcaccacgaccacgactactacatgattggctacatcgatgaacgtctacaacaacaatcatctacgaaaactccagctaaagtgtttgtgtcatcactatcatccataacactcccgctatggctgcgggaggaaatagaggagagaagggacgacacagaaggggacgcaagcaccaggtgtagagtgagtcaaagaagatgaagaaatagatttcaaatccggtcgcaatcgatcgcttcactcccgttacgactaaggggaatgttaggaatatatatatgttagttagagataagagtcaaatacaaattatacagataagatataatcctaaaaacagaatcctagagataaaatagaatcttagagatagaatcttaaagataaatatactcttgcttatattgtactccaactctctatctcctatgtactcttatatatacccgatgagagggttgatgtaatacaacagaatacagcaaataaatttttcacagagacatcactaaaatctaaataattaattagtataaaacatttcattgagattaaaaaacaataaatgattatttcaacttaccctcttatctgaccttttgaaatctggtagcatacatagtgtatctctagcgaatcactagaattagcgaaatttctctcagctactacgcgaagcatatctcccaatcttttccaatccatatttttcttgacatcttagtttaagaagagacaaataatacagacaaatggcaattacaaagttagagaacagaaaattataatgttatcaatatcagcaatttcaattatttgaattttacctgaagtacaaacagtaaaattccagatttttgcatctatggagttattgttcatcttaattgctatgtctgcccctttcaaatttggacagaagaaaccattatcgtgaagtgcttgcaaacctttgacaatttgactgaaagaaaagtaacagaaaacattagcacgcctgaagggagatggaattcagtcaaaaaaaatatcaatgtttttgtgcagctcatccatatcatcaaaatttagtgacacggtgtattttttagtttttgctacaatatgaagtttgtttgattagagttgtcatataaacctactgtttgccattgttctagtgcttgtgtgcaaaagaacctttagctggtcttggtgcacacaactggctagatggatgcactgatctataggcagtagtgtagccgggatttagacttgaggggggccaactgaagctatgtactgagcgacaatgaacgggaaaaaaatatccatcagaattcatgctcatttcgagcacttgatatagatgatacttcaaatcaacatatatttatatgttttgagcataaaaaatgttttagtgtctattacttacatacaatagttgcatatgaggaatcaccagaaaactgcagctattggaacagcctagcagtccaatcgttgttaccgttccttcattagcctgttgcagaattactactatacgtgctagcatgcaaagacaggatgaaataatcatcataagcctgtttgggcctgaacctagctagtagtggaggcctgaatagagccagtacaccaaaatgcttagcctagtgtcctaattaaatgattaattattggcagttcctagggaaaacacattaaatggcaggctacctgtgcatctgcgctaacatcaatttattaaatttggtgagaactgaacaataggttgcaagatgacacaaataacagtaggtggtgcagcgtaatatactcatcaaaacattgaaagtgcagttataccttactgcttcagtaaaaacttccgtgaatcttcccatttcaacagctctgctacccttggcaattaaatcactgaaggttaaatggaacatcggaaaggccacaaacccatactttgagtgatgacggctgccccaagaacaccccaaagatttcattacagagggatgatcaaatgatgaccatttcttgtgcattgcaggcatctcatcagcatcacattgaaaagcaaagatagtggcttttattggttgagagtccgttgagcccaacttgatagtaccatcataacatatgatataagttccccccctaccaatattcttgtgtttcatgtctgtaattatcatctctgatacgccttcaaccttcaataaaagagagataaccagcagtatttcccaatcagtattactagctataaatcatgaatataatagcattttgtattaatatgcaggttcaagaaaagcactccattccaaatgtccaatattagcatgcgttgttatgttttactccctccgttccattttgatcatcgtattgcaaaaaaataataattccattttgatcgtcgcattacggtggggaggagatgaaaatcccgggaaggatgttaatgacacttcctaacgaacactgcatgcatctgattggtcaggctatgcggcatgcaaaactgattaggagccgctgcatgcatcgatttaatacgctcacaactgattggccagccatacagcatgcaaaattgatggcgttacattcacggatacgaaacgctgttttcgatgctgattaagtgctccacatgattgtcttggtattgatgcacaaagcatatatgaagatcaattaggaatggagggagtatttctatatcagagcagtagcaatgatactcaaatcaataaagaagaaaacatgtgtttgtcacatgccggttacaagcaaacaaggaagcaatgttattcatttttctagagaggaacacgcactcattatgttaacattcggctttgttatccattaccgaaaaactttatcacgcagtgagatcgatataaccgcaagtatcaagtcccaggcatcaaaatcggttaattctgaagggcatgttcctaaaccgaaactacacagtggcaagtctgtcaagagacaagtttatgatggcatgtaattaattgggtcttactgattgagattatggacctcaatgcatacctcgctcttgacag

SEQ ID NO: 59228 - DNA, 1177 bp, Oryza sativa
taatgatttacctggctctgcatacaatggtatgcatcttcacaaagaagataaagagcattgttatctgacttcggctcgagggttaagcattgtacaatctttggaagtatatcatcttgaacaaaatatagaagttcatcattgtgcgtagcaatagcaagttggatcaaactatgacaaaatggtgcagctataatccttgcttcaccatccttccaatagccaaagatataattgattaaccttagtattgaagatctaatgttatcatggcataaaagatacctacatgtgaaataattcaagtgttatttatattctaaaatacaataaaataactgcacaaaatctcaaaatatactattgtcgttgtaagctgcagttgatccatcttacccaacaagcgagcttgaagtagattccaaatctgctgtgctgacaatagatccattttgttctggcagtgccattgcagcaagcaaatatgatgcttcacgagtcaactcagaaagaagtccctttcccgctttctcaaccatttcttttgagaaagattcacagaatttatcaggaaccgacactatatccttatacagaagactgcaccatgaactgtatagtgtctcttcacagtagtgaaacactggtggtagaagcatatctatccactccacccaaagatcaggaggacaactttttaccaatggaacaattgtatatttaatcagcatggtcaaatgacgaaagtccattgattctacatcttttagtaaggtgccacaaacagaaaagctatccaaaagtttacaaaatgctccctcaagactcgcacacatacctataacattgtacctacaaagtaaaataaacatttatgtgaacacaaaattacaaaaaaaacataacgtagacaatcaaagtatttctttactttgaactttcaaagttttcctcgaaccaacattataacacaatgttcaaatgaagctataacttacaaaatgcattggaaagggatattacgccttaccaccacatcttgatatccttaaattattgtgtgttagaatatgagatgaagcttcacattatatttcgtgaatacattgctaaggtactatggatcggactagagttttaagtggaggaatggtgctaactaaagcaggaaggg

SEQ ID NO: 59229 - DNA, 55744 bp, Oryza sativa
cgagacctaatatgcttttgcagttaatctattagctagatatagtgcaaccccaaccagaagacattgggttggtgtcaaaactatcctcaagtaccttcgaggtactcaagatcttgggttatggttcccaaagaaccaagatccatccatggtgggatatgtggatgctggctatatgtcgaatcctcgtaatgccagatctcagactaggttgatttctttgtggtaatactgccatttcctggcggtttgtaaagcagaccctggttgcaacgtcaaccaaccactcagaaataattgctctatatgaggccacacgagaatatgtggggcttatgcggatgatcggtcacatccagaagtcatgtggcctaaacattgataacacccccaccatcatctatgaggataatgctacttgtgttgcacaaatacatatgggctatgtgaaaagcaatttcacaaagcatattactctcaaattcttttatccccatgagctccagaagagcggggaaataaatgtcctgcaaactaagtcatgcgaaaatctcgcagatttatttacaaagtctctgccagcatcaagttttcatagatgtgttcgtggcatcggcatgagacgacttagtgaattgcaagaatcagggggagcaaacaattaagagaatagcccatgattatgatcctgaagaatcacaaacaagtcctgaagacttgatcaactgttgtactctttttcccttggtgagttttttttccattgggtttttctcacgcaaggtttttaacgaggcaacaggtgcaacacaatattcaaagtgccatgtactcttttctcctaccattttttcccactaggtttttgggatgagtttttatgaggcatgcgcataattcaaattcgtccaagggggagtgttatgaaacctatcttattgtggacgaattaaattataagtgggaagcttactacagaagaaagcttacgctagaagccagcttaaagaggaagccagcttacggcacaagtcagcttacagaggaagccagcttacaggagaagccagcttacggcgtaagccggcttacgacgcaagccagaaggtccaaggcttacgacgtaagcctccaccctcctccgcctataaatagggcccagaaggtccaaggcgaggacaatcgatcttcggtctcctgcttctcctcttgtagcttgtactcaaatccagaagaaataaagcttccactcgctcatactttctgtgttccacaactctgtgtttggtttgcttgtgtgctgatcagtagaatcgacaggtttctcaacaattttaaccattctgtggtcacaactgaaagattatcagcagatatacatttgctattctgacgccccatatatatataatcaaggaacacatgcgtaaaaagaaaatccaattttattgcaggctaaatgttcaattcagccacaacatgcacatgcagagggacagccagtagttgcacttgagcattagataacaaaggagtccagttacattcctccaaatgcaattgaaataagttcactttgggtccctgcctagtccgattttcatcccctcgtcacaaaaccggatacgatgggtcccccaacttacgaaaccgtttaaatgaggtccctcggcggtatttagtccagttttagctgaggtggtacctacgtggcttcttttgactaggtctttatccaaagtgtcgttgatggggtgtttatgtggcaattagattcgaaaaaataataaaacacgtgggacccacatgtcagtttcacacacaaataacaaaaaaaattgtgggcccatgtggatccacacgtcatgctcactacctcttctctctatcccctctctctctatcctctctctctccctcttttctctctccagccggcgaagcagggagggcggctcttgccgacaccgaagtccctgatgagcaggatcttgaagctgcacccgtcctcaccaccgccgctgctccccgcccccggtggcgcggcccacaacgccggccgttggtcgaaaattccccattccaaaatcccaatcgcgtcgaattgagtgaagccatgaacagtgtgggtgcagcgtccaggctaggtggcgagcctctgcagactgcaggccggcgcggcggtgcttgcccgctcctagtgccgcggtgccacctggcctgcacggctgtgcgcctgcgtgtagcagcccagctctaagccgagcaggcagcaacaccaacaagtcagcaagggcaaggcagcaaagcaactagcccgattcagcacaaatggatagaaaggggaaaggaaaggctttggcatcataaaaatgtaacatttgttgagtatttgacaaatgacaagtgaaaacattgcaatttgcaaaagtataatgaacaatttgtcattgattcacatgtctgtaattttccgtaattttgtttgtagatttgaagagctatttcaccaggtagtccagtagttgccgagcagtatgctttcattccacagcgcggcggggggagaagtcgcacgacctcgacggcaccgtcgtcggcgggcccaacggcaacaacgtgttcaccgaccaccggggcgcgtacctacagacggaggcctgcacgtacaacacggcggccatggttggcgtcttctctaagctcatggaggtcgaagccgagcgcggcgcctctgcccgctccgcttacgtcgccggcgacgcgcaggccaacctcaagaccctggtcgatggcctcgtcgccaacggcaacaccaacatcaaggtggacgccggcacgcacccgcagacggccacaggccacgggcggctcctctgctcccaacggtcggcgccccgcgcccctccggccaccgccgcgctgcgacttctcccccgtcggccggccgctccgcccacgacgcgccgcttcacccctcgtctccgcccctctctgcctctgcccctctgctctgccgtcgcccactccgcccgccgcccactccactccgtcggttggagagagagatggatagagaggatagagagagagggggatagagatatggtggtgaggatgacgtgtgggtccacatgggcccacccattttttattatttgtgtgcgaaactgatacgtgggtcccacgtgttttattattttttcatctaattgccacataagcgccacgtcaacgacacgttggacgaaaacctggtcaaaaggagccacgtaggcaccacctcagccaaaaccgaagacagtaccgccgaaggaccttatttaaacggttttgttaagttgggggacccatcgtacccggttttgcgaccggggacgaaaatcggactaggtgataaatagagggacccaaagtgaacttataccaatgcaatttcatatcaaacagtcacggatgggctttaggaaagcagaactgggcccggcccagtagatcacatagcccaacaagatctaaaccgcatgctctcgtttcaacaaattatcacaccgattgcatttgcatctgctgcacaggctaaatcaaacacgtagccatgaaccattcacctcacaagtcacaagcattgcatttctatggttaccagtgcaggacgaaatgctcaactagcccaagcaagaatggagcatgacaacctcaggcaccaaaagctctataaatatttgcattgcacaaatcaaaagtttccaagttttaatcagagaagttcaagatatcagaaagaacaacacataccaggatgtctcagctcaagtcttctagcctggctgcactgctgatcttcctcctggcagtgttcaccactgcagcagcagcggcaggtacagaatgccagaacgatgtcgaggtgctgaagacaacctgctacaagttcgttgagaaggacgggccgaagctgcagccatcacctgactgctgcacctccatgaagggcgtcaacgtgccctgcgtctgcacctacctgggcagcccaggcgtcagggacaacatcaacatggataaggtgttctatgtcaccaagcagtgtggcatcgccatccccgggaactgcggaggtgagcaggcttcacttgattggccacactgatcacctgggtaagaactgacaataacacgccggctcctctggattgcgacttccagtggggcccaggtgtcggtgtcagctgggtaagttggtgtcatctggtatgggaaactttgatgttttgtacatgtggtggtgctcttgtcaacattatatagataaggagagaataggacaaacatgacgcttgaatagcagaagagaagttctatccagcaatatcaaaagtacagctgtcattttcaaaaaatgtaaaacaaaaataaaacgaaaaacccactatactagtgccaataaaagaagaaacaaaagagaactacattattgtcaatgccatttgttgatgttattattacttttgtttataagaataacaattgtacttataaggcctacgatttattacaggatccaaggtctaaaacaagaactgattgacttggtgaagttggctgacaaaagcaaggcacctagcagttgcacggctgatataggtaaataatgttggtcaacttttagagtacacggattgtacgtcaaccttcagcatgttgtgataacaaaatatgtatcaatgatggttgtctatatacactgaaaatgcaagagtatttttaaatcacatgttgtattgagtattgacccagctatcaactgtttgttgatgtgccctgttccttagtctgataaatgctaatatagcacattgctaaaagcataaataaatatctagacatattggacagggtgaacgatgaagaaatgtccaaactccaaatatgagtaggataagtttgaaaaataacaaagtagcaatatataaaaacaatctagggatgctctgcaacattaaaatcaatcacatattcagcaatctgcatctgccaatacaaaacaatcaaaattaattttcatacgcaatatgtagggcaccatgatatgcaagatccttcttaaaacaattttcttggagttcccatgcttctaaaaattgtagatgagcagttgacttatatgctagtgttttgattttgagtaaatttcccagaactacaggtattttgaccaaactatcgcgaaactatagatttaaggtgttctgtcacaaaactacatatttagcacaaaatttatcacaaaactacagatttaaggttaacatcacaaaactgaatatttaatattgaagttatcacaaaactacagcttttagagtttaaatccctagaaccgttgttatgttggagctatacacattattattttgttcctaaattggttctaagcctatagttttatgataatttagttactaaacatgtagttttgtgacacttcattttaaatgtgtagttttgtgataaatttggtattaaatgtgtagttttcttttgtttttgaagctgaataatgtgaaattgcttaaaagttataaatagcctggtcaggaaccaaagcttcagaatcccactcttgcaatccaactagacagaagtaacaagaaaaacaatcagctaaatttttggccaactttacaggtacacatataatctgtttaaaatgcctcttgaattacaattcaataatcccaaccaattttactgacagattgattgctagagatttgtacaacctacggagaacaaaactccgatagaacaatcatgaacaacagaaaaaaaaaatctactctaattacacattgcagcaaagaaattactaacccatgtctgctggtcttgctgccaaaatcacctggaggctctggactggaagagttccagccttcccttggcatctggaagtagtgcatcgacacgcatgtcctgtatcatgtgagcctgttttgatgcccagagaagcacagcaagcacaccagcttgagccagctcctcactttctggcacgtgcaatgcaatgaaacagagcagtatcagtgcctctatctgcacctcatcaccgagatacaccagctggacaaggtggcgagcaccaccgctgtccacgatggccttgcagtggtttacatgcaggtggttttcattgcatgcgaacttggtgagcgcaagcacggcctccttaatgactggtggctcacgctcatcgagcagctccacaaggggagcgatgacgcggttctcactcgctgtgaaagtgcgtgcaaggcagccaagagcagtaatgcaagggagcaagagatcatcgtagtctcccttgctgacaatgtgaagcagctggtcgacgacagccttggctgctggagagctaggcttgaaagccgactgtcgcagggcaaggctgtgctcagcgacacgggaaatttccatgattgccattgctgagaagtactgtacgctagtacccatgccaccatcacccttctcaagaagcaccgcgaagcagagcagtgcacgcgaatcagtaatgctcttgcagacacctagatgaccgcgggcaagcttccacagagctctcgctgccatggcctttagccgtgccttggtctccggatcctccacctcccggacagcaccacggccactagaaccactcgtgcccagctgtggcctgaagggtggaaccaacgacccattcgtcttagtcttagcagccatcgcggattgcacgaccgactgcatctgattccttttcgtgtcttgctcattggacacccttgggggctcatcggtggaggaggaggtgccacggtcaccaccgtggcgcatgctgagcgtcttggcaagcacgacagagtgcagcgacgtcatgtgctgaggtgcagcagcgctgttcttggagctgctggagccgacggagtacctgctgtgctcctggatggtccctgaggcgaggtgaccgacgagatagcggacggcgttgttctgcgcaaagagctcctggcacgtagcgctccggtcagcgagagtaccaatggcatcggcaacggcagcctgcacgcgcatgggtggatccttgagcgccgcggcgaagacggagcacaccccggcctggacgagcttatcgatgctctcgtcgtcgcagccgagcaagccgagcgcgcgggcggcggcctcctggccgtcgtcggtgccttccttgagcagcctaagcagcggcggcacgccgtcctcctcgatgatgagcttggcgaagtgctggctgtcgcgggcgagggaggcgaggttggcggcggagtcggcgcgcgcggcgagcccgccggtgtggaggcgcgcgacgtggtcccagatgaggaacagtatgggctcgttctgcgcgatgttggggagccccctcaggtcgccgtcgtcgccgtccccgtcgtcgtcgccgccgccaccaccaccaccaccaccaccaccggagcgaggcgaggagatgcgcagcagccacgcgacgtcctcgagcgcggtgtcgaggagggcgacggtgcgggggaaccccgcggcggggctgagcgtgaagagccgcctgaggcgcgggtggccgctggcgcagcgcgcggcgagggaggaggccttgaggagcgcctgctgcgccccggccatgatgcgcgcggcggggcggtcgtacaggtcggcgcgcgccgcctgtcggagcaacgccgcgagcttgtccgcccgcgccttgagctcgccgcactccgcgcggaagcaccgcgccgcgccgcactgcttggcgacctcgtcggccagctggatcggccgcgccagcatcgccttcaccccctcccccatcccaaaagaaaaaccaaacgattctccgcctgctccgcctccgggaaccagaattccttcgagaatcgcgtctccgcggggctgaatcggcgggcggcgagggatttgggggggaattccgaattcggggtgggggatttggggtttttggtttgcttggtggagttgcgagttggtggagaggtgggtcgtcgagtcgagtcgagtggagaagagagaggggagaggggaggtggggcccacgggcggtgaccgtgtcgtcggccgcgtgtgtttgctgttcttgttttcgccgtggtttctctggagattcccggaagatagggtgggcgttatcctggccgtccgattcgggccggttgcaaagtaccccttctttggagtatgatccttctttttttttatttctttattattatattgttttcttcggcgagggggattacgaccgttgactcgttgaccatgaatatgagctagtacttttttatttttttaatatttctggtgacagttgtttgttttttttttctttttgggtttggattgtagttatccagggggaatgtacaactgtatttggtcctgttctggaaactgataaattctagtaacaaggaataactggggtgtggccaatgagattttggaaattatgggtttccatggttatggctttttagtgtgatacaaccatatattctcataatttgagtaaaaatcttaaacatcgtttaaggagctaaagattttgaaaaaaaacagtagatagtaaaaactccttccaaacatagcctttatagtacgatatgtatcaaatatagcggtcttaaaacgagttacaccacgagataactaaaaggggacacatttatccatgctaaggaatttcatggctttggagaaaaaaattatcggttgcaagagccaggggctttctgttttggcaaaaattttctttcgcggttttggattgatgcataatatatagagcctatagttcctcatggtggggagcacaaagttgtcccctagtaggagcataagagcatcaaccggatatctccctaaaaatggccaaacatgcatgtcactatattacatttgactagctctatatggtcttatggcacaaggaatatgcccattatttttaccttattctgaataggagatgattctttttttaccatatatttgatcaatatatattataggtcccgtttgagatggatgatggttatgatgaagtaagtgcacacgaaaaaaattagcttatgattaattaagttttaattagtataaacttgaaaaatggatttacttgtcgaagtaatttttctatataggaagtttagttgtttagcaccatttagctgttttaaaaacgtgctaacgaaaattgatgtagaatctgaatctcataataaatgaacggagcctcagaattgatagaatcaacaaaatgaactggccaaatctatattttttaaatgtgaccaattcttaatagtctgatctagtttgatccgatttgtcagctgccatgtcctgttctcatctactactactgatgttatcatctcaactaaagaggagttgaacaaacaaatttttagttctgaaaagaaactattttcgatgcatcattaagcttggagaaaccactaatccaattaattaacttgcacgtttcttatatgtcaataaataacaccccgcatgcatttgatcttccatccaagatcgagaggctcacgtacacaatctgacagaggccatatcgcaatcatttataactaatgattccctagtctttatcaatgtatagttatgtcagaagagagacgtgagtcacacaaacacgccaatccaaccatgctgcatgcataccaggtgctgaactctacgcttctcacgttttaacgcgggaattactaattcttaatatattttcttaacatattaataaatatattaaatattataaaaataatatattgatttgttaaaatattgtgcaaatggtgtgaggggtgatgatgggatatgcttgcatgttgatttgtagaattaaataaattgtagataatgttgtatgcttgcatgaggttaactatgtaactattaccagctagtagttgatgatgtgataagattgtatgtcgagttttaggcttagtagattataactttatataaagtatagattatttttctgttattttcagggcaatcgatcatatcataccttggaaattaataccatcaatatatacttactgttatcataataaattatcataataaatgattaaattgccgttgcaacgcatagagtttcactcagtatatagtactagtacattgcacgtggtgactaaaaaaagaatctgccagtaccaatttgccaacacacaaagtagaagtgaagcctagcattaagccaataacaaattggttaaacacagcaaaaaatccgctttactttggagagccagctggaaaaagtgataataatctccgagggccagctggtgtggaaaaaaaggagggaaaaattcccaggccaccaattcttgtcctcagctttttgtgcatcgcacttgcaggaataatagaatttaataccacaggaataatggactagtggtcacctgagcgttaatatcgtcattctgtcactgtaattgtgttaccatggagtcgtagtaaatacatcataatgactataaatgtgtttcatagcactaacattatgtatatattcactttacacatttgtgcatttttattctaatatttgaaaaaaactaaaaataaaattatgaaattgaaagtaccttttgagacatctacacatgatattcaagcagccaaaccaagtatttaaaaatacattttgtgttcaaagtttccttaaaaaaatatacgaagtatatcccaaaatgtgttttgcaatccgatagagtagtttttggttaagcagtgtattttacctcgatttagttagtatcaaataataatatgcgcaatatttcatatcaatattccatgaattgaatatgatgtttttcttagaaggcgttattaatctcaaaaacgcatattgcttttcaaggtagtactccctccgtaatttaattcatgacgccgttgactttttaatcaacgtttgaccattcgttttattcaaattttttatgcaaatataaaaatacttatgtcatcttgatgataaatcaagtgacaataaaataaataataattatataatttttttaataagacgaaggtcaaacgtttgtcaaaaagtcaacagcgtcatacattaaaatacggagggagtataaaataggacgtgactacacagcaagtggtagctggtttgtctaaaccagctaccactcaatctataagaggcactatccacctatacttcaaatacaattttctcttaaactacttatccgatctacgatccgattacaccgttgtattcataacaattaaatctttataacaagatctcacatgattatattttgatgaaaaataataatttacttttataatatatctaaattacttttagattttactaaattacttcttagacatataaaagtaattcaataaagcctaaaagtaatttacatatattatagaagtaacttataacaaaaagaaagtaactctaattaatacatttttttcattggacgtgactacacagctagtggtagctagtttgtactctatctagcatctcctttcaacttgaaccatgcaaaagttacttccaattaacattgaagttacttttaaaaattgttaaacttacgtgtgttgatctgtgctgattaaatttaatttctagataaagtatatttttatccctacaacgaatttacttctaatgtcgtgacaaagttacttacgttttgttttaagttacttttataatatatgtaaattacttgcagactttattgaatttacttttatatgtctaagaagtaatttagtgaaatctataagtaacttatatatatgataaaagtaacttacgtatataataaaagtaatttacaaatataaatattttttcatcgtaatataatcatgtaagatcttgttgtgaagatttaattataacaaacacaatggtgtaatcaaattgtagatcggataaataatttgagagaaaactttgtttgaagagaaaaatgacatgggagagaaaactgtagcctttctctctgtgactctctttgaagcaggaattgcgtgtgcgtgtggttggagatcggacggctctgccagcatcgcgcaatagcgctaaaacgagaggggctctcgaattagattttacgtataaaatagtggcgagaggagtcgttttcgcacagacatgcaacttaaagaagtcgctcgcgcatgagcccacaagcataggctggtttctcacgtggcccgctaggcttttgtgaggctaaaagtgtaccaaacgaagatgtggagtcttgatttttaatctctaaatacttttaactaaaaaattaaaattttctgttcaacttttcaaacttccaactcaaatcctaaacttttaactttacatataaaactctcaacacgagaatgatgaaattacctggaagttcacgagtcatggagaatactcggcatccttagcctacaaggtgcagttcttggggtcgctaaaaacaaactttgacaccttaatttggaaagcttgggcccacgcaagtataaaaccttcgcatggctaataatctaaaattgggtctggacctcggaccggctggcgatcaggggctggcaaaacaacggcgtttgtcccctttgccggtgcacagatgagacatccctacatctgctggcggattgcagatatacaaggaaaatctgggatgccattgctacttgggttgcctgtgaacccatcatgctgataaactgagcgcaattgaccacaacacatcactggtgggaatcacttgaaacacgtcaagaagcacccaagcatgggactcgattcttaatcctcataatctcttgggaagtttggaaggagcgaaaccaacgaattttccaaaacaaggagctaaccacggtggccctaatcgcgaagataaaggaagaggcgaaatcttgggctatggctggagccaaacacctagcagagattcccgaccgtgatgctgtaaatatttttttccttacctgtaaaaagaaaatttcgaacgaaaggcaaagcttgcctattctttttaaatatactatatccgattttgaaaactttcagcttaaacttgaaaactttcaaattacgacattttcaactcgaatatgaaaatattcaagtcaaatttgaaaactttcaactcaaattacaaaaattttcaactgatatttaaattttaactttcaattcatgatttaaaattttcaactcaaatatttttaattattaaaaatatgtctatcgctaattgccattagcattaagcatgctgggaggcgattaacgttacacgcgtcggagatgccgcgttggcggtgcacaccatcgatcctctcttggcgcaggtgcgcgcgcttcgaaagtgccagcgatgtacaaacccaatgggctcagtgctcaacgagaggcattttagactgggctatagcccatcgaatgaagctagccaaatcctggcccggtaatgcccggcccaacaatccgaaatatccagtgaaaggcaggcacctgctcgccggccgtttgcttaagagtgaaaattaagtctgaacatttctctttaagtgccaagagagccattcaagatcattttgtcatatattatttttttgattcgatttgctctccaattttctactctgttcggaccattccagcaaaagtgtgtcattctggtccaagatagctatggaccattttagcttgctacgtggcgttgatgtgacatgccatacaaatgcgagattttggactatttgccactctattgaatggcacattctcaaatgctatccatctttcccagtaaatttgattgtttgtcatcgtgattcaccaaattgtttctattttatcacttttgacggccaacatactaaaagaaacagaaaatgacctcactgcccctctcatatcttctcttcttcctctccggcgtgggaatcccaggtacagttgcagttggatggatgacacaagcctccggtatttttgacggtgaggtcgttgatgagcgaggatatgtcgaggccaccttgaccacaagcgagatactcgtgctggtgagagagcatacaacttgacagcttgacccacgctggctcctgccctcctgtcgacgtttgatgtcgcgattccggtattcgcatggtatggggatcattggtactaggatatacacgagactgaggtaaaagagatggagatagggatttttatacaggttcgggcccctgaattgtcaggtaataaccctacatcctgttggctgatgccggtcattgctcttattcatcataatcacactagtacaatatttggggtagtctatctaactgttgtcgatatggcggtctgaaggtctgactcgtagttgacaacagggtagccttcctcctcgagttcgtgcccggcgagatcaaagatagcgctttcgtctctcctgacagtatctggagacaccgtaggggactagccgtgcttatccctgaaatcgatatccggcatcttgtcttggcgtatgttggcttgtatgttgatcttgtgtcttgatatattgttttgtgtcttctatggtgggtgtgtgttgatcgtctgtatcccctctccttttagggggccttgtatttatacccataggtgtccccttgtccaagtagaactagggaaaccaatatggatacaatccgagtagtccttatcgtttccatgtagaactctggttgtcttttcttatccggaactcctcctatatccgcaggttgtttccgtataggacatggtaagtggtgggtcatgccgagatttagtcaactactattaggtatgtggtatccataaccctgacacctcccccccgggtgccccacctccatttgcgttgcttctctcaagttcacaagatttatgcgaggtagagggcctgcaaccgagatgtattgccttcgccccgacgacccaacggcgaaccatcaagcatcgtcacatccattgctcgtcctgctgccccagctcattcatggcaatagttgtccctactgcttggcttgtcccatgttggagactggttcatgccatgtcggagaggaagatggtagaaggaagatgaatgagaggggcaatgtggtcattttctcatcgttttgctgagttgttagttaaaaaatggtaaaatagaaacaacttggtaggtcacaatggcaaataatcaaagttaatgggaatgatggcatttgagaatgcaccatcgaagagagtgataaataatccaaaatccccacaaatgctgacgtggcaccagcaatatctctatattgactgacaactggggcccacttggaaaagttttctttccttttctcctttttcttttttccattttcctctcttctttccctttcttctctctctttttttccctcttctttagttggacaagcagaagtggcatgccacatcagcatccgtgtggtatgccacaccagtgtcacatagcatgctataatggtccgtagccatcttggaccagaatgacacactttagcaagttatgggacctgaattagcatttttagagttcggggatctagatgacacagtgacacaagttctagatgacacgtgatacaagctaagtgaccggtcgtacactttacttaaaaataaagaaaatcaaagcgtcttataatatgaaacgaggaagtaaatatttgtatggaaaaaatgcaagattttagtatgcatccaataaaattaattaagctagctaagctagtagctaggtatccattcaatccggcaaacatgtaatcacatcatagagaacagaagcttttatttatatctgaatagttaagctagcaggcaggcaacagaccaagcttcaacaacgctagaagggcagtaattaactagctcgagtagccggtgtgaaaaacacacaaagaaacgaagcaattaaaccagctagtactcatgtttcctcgcttcgatcgatcgatcatggcgccgcggcgaagccggcgaccatctatggctttgcctccacctccacaggcgggagcttggggaacttgaggaatggattcttcttgatcaatggcagcagcttcttgaacagctcggggtcagcctccgcgtcgtcctgcatcgccaccttcttctcctccgccggcgggtggtagatcggcggcgacggcgtcggcagcggctgcttgtacaccggcgtcgggtgagagtacgccggcgtcgggtaggagtacaccggcggcgccgggtgcgtgtacgacggcggcggcttgtggtacgccgccggcgctggcggcgacgggttcttgtagtggaagaagaagtccttcttgtggaacgggtcgcagaggaacgccgacgcgcactccgacgacgggaagtgggtgtcgccggcgacggcgacgaaggtcttcttcttgtcggcggcggcgttgacgatccacgacggctcctgcccggggcatggctggttcgacgccgcgctgtgcagctgcgcgaagcattgctgcctcagctcgccgtcgtcgccgaggaggtccgccgcgaggggcacggcgaacgcgccagacttgccgacctcgccggtggccttcgtctcgtactcgccgttgctgttcttgcacttgatcgccacgcgaacacctgaacaaaatcaagaataaaaatgcagcagcattttcaacacaaaatatatacacaatataaaagaatatattcaatgatagatttaatgaaattaatttggtgtcataaatattgcgatatatatttttaatataaatttggtttaatttaaaaaaaattgacttaggacaaccaaaaacgtcttgcatttatgagaacttagaacaagcatttttcaggtagtagtttaaataaatgacaatgattaattggaccatattgcgtgattatttatgatatcaacatacccttgaaaacggcctcagctttcatgttcttcctggtgcagtcggcgcacttggccaatccgacgaccatggacgccgccgccgcggcgtcgccgtcggcggcaacggcgagcacgttcaccagcaagacggcggcgcaaacgccgaggactagagcccttggcagagcccccattgctgaagctcacaagagatatatgatgatcagcaagaagtagtggattgggagatgagcaagaagagaggcagtgatgggtttatatagtgatcaagaagagcatatgcatgcaaagctacatgcaatattatgttcatatccatgcaagtgcaacagaagcatttggcatatgcaggagagagtaaattaaattgcaactaggtagatggtgtgttaaattaaactgcgactagctaggtagtagatagtagtgatcagctgagctaccagttcaatcaggcaccggctttgcagattgttagtaaatgtgccgttaaaagttgatgattgttctctctgttttctcagatctgcaattcttgccattgtgcatctggcactgggcaacttaattatctttcctttagggcaatgcatgcagagatgcatgaacaattaactgcaagtttgcaacaacaattggctgcattgaaagaacagttattgttgagattgtgttggaagtacaaggggtgtatttgcagcatggccggagattttaatttggtcccaggtttaacttgaattgttcaagttgaataactgttacatctgtggcactgctacatctgtgccacattctgtaggtcaccatagagaaagaaaggtattcatgtcttcagttcagcagtatatgtaggtactattaaagagatgtggtggattctgggtattcatgtatatattgttttttaacctcaaatttgactgctagatccaacagtttataatgaaaatttaaccaaaatgttatcaattgatcctgcttggttttgggccctctgtcctgttgccctgttggtcctcttgctgttaatattttaaaactaacctttatttattgtgtcgctgtcaaaaagagggttattgtaacatttcagtttaattcaattatattaattcagatattccaaatgaacttctcagtggtttactgaatttctggaaagtgttttcctactttaacaatctgctatatatgttgaaggaacaactatactgttgactttaatggaatctcattgcagtttagatgtgtttaatggcaaactttaaaagttttcgatattaatgtccttttaaatatttagaatgaattaaaaaaaatactgttagtataattttatcagcatttttaaataccttgcaatagaaattgacggtgaaacttttatcttgaagaccatatatactaatatatatccaaatcaacagtttcttttcccaaggagtttagatggtaacgtgtaacaaaatttgaaacagctaaaatcttttttcaaaattttatcatgctggtatttattgggttttcttttcctgttcctgttgtgccattgccaaaatagtttaaaaaggaattaaagtcaaatataaaatttcaaataacatttcataaagaaaatgatctgcaataagaagttaatttacaagtcttttgcagcaatagtctacccaccagttgagctggccgatggaactgcctgtccatttgttgggttattttacctagatttttttctaccatggctcgtttaacggtccatcctctagaaccgaacccagcctagcccatctgacagtgtgttcagggcagggttggaaatttcggaccgaaatttcggtcacttccgatacgatattattttggctgaaattttttattttttaaatttttttcataaatttaggtaatatttgtttaaattcaactaaattttactcaaaatttcggaaattttagaccgaaatttttaaaatttccgaaatttcggaatttcggtgacccccgatataaacggctcaaccgatagagtgaaccctgttcaggggatggtgggcttgcggctcgtgtgacgccgcttggacaatgcaccgtacgtgctccgtgcggaggaggacgtacggcggccccgccgacccggttgatgatatcccacggcagttgcgttggtcatcgccggcaaagtcgccggccagggcccatcgcaaccgcaccgtaccttgtaattttattgtccgcaccgcactggacgtgtgtaactgtgcgtgtacacatggtactcctaattattttactcatgtgatgtgattcaatgaaacaatatataattatatatagtattccctccgttttaaaatagttgacaccattgactttttagcacatatttgaccgttcatcttattcaaaaatatttgtgaaatatgtaaaactatatgtgtatatgaaagtatatttaacaatgaatcaaatgatataaaaaaaataaataattacttaaattttttaaataagacgaatggtcaagcacgttataaaaagtcaatggtgtcaaatattttgaaacggagggagtactaagtaaacaatatactcctactatcattttgcccctgcaaaagagaaagcatatgctcgatcttttgtgattcaattaaaccgtacgtgagtaaaaataccagagtcctacgaggacttgagtacaacattactagtggatcatattgtaattgtagtgcatataatggaagtaatctttttatcgaccagatctcgtagtaatttagttactaacttatcaaatgagattggcaagaataatggatagtaatatttttatgaagtactaacactactacgtacaaatcaggtttttgctagcgtccaaatcaggtttttgctggttttcattggccttgccgaccgccagcaaaaattgactttcgcaggtggccaagctaagaaggccgctagcgaaaaaaactagtttcactgtacaataggtaaagagacccgccaacgaaaatattcttataggaggaaaaaaattaaaatggaaaaaaaattaaaatcaggatccacaattaatgtcccaaatccttatcccaaattcacatgcatcaacacaagcttcccaaatttgttattgccgagcagtaggaagcaggaacccaagctgaagttgtcgtcgtcgccaccatcaccgagctggccgcaaccctagccaccgagggtaaccattgccgaactacgcgtggagccatcgccaccgagggccaccgtcaccgagcttacacgtggagccgtcgtcgccgagggcagccatctccttggactaccaccgccaccagatatagctagacatctggcggtcccaagcaccgccaccgctagatctggtggtccggtctcgattaccgttgtcttcgttgtccaagatgcacatgcatgatgttgatggagctcttgaggttctgcgtggcagagtaggcagagaagacgaaccatcgccgtggtagccattgtcgtcccggccttgccaactcgagccgtcatggtcatcagggccatcctcaacctgaagcagtcgtgtcccctacgctttgccaccgcctctccccttcaccgagtagccatcgcccccaccctttgctgcaaaccggccgccaccccttccccgccacttattcttcgcgaggtgtgcaccgtaggacggcgaggagttcgcgcagtcctgggcctcctagccaccccttccccgtgctgcaacaaacatcaagagagagaagggagaggagaggataatacgatgcaactgttggttcagtagtaggttttgcaggtggtgttcattactccgccattaaaaaatcaattcttaatggcagggtgttaagagcaccactcacaaagatagaggtatttttacaagcggtgctcttattaaaatcccacctgcaaaaattatttttactggcagggctaggtttttagaccactcttccattttcaggggcaaagctttttagatccaccactggaaataaaactcaattgtcataaaaatcgctttttggtagtgtcactgctacaaaactcctcataggtatcaactcataggtaccgccatcctctcctctctctcgcaaccgctcctccccgtctgtagtcgcacatcccctcctccttgtcatctctctctctctctctctctcgcacaaccctacccctcccccttcgtccctcgctccctccctcttcttcccccacctggccgggaggctgccaacggaggagaaataggtcaaaggaggtacctctgcacccaacgctagggcgaggccgcgtcagagatgagttgcccatcggtggagtgaggaggaggggagaaggtgcctagggtgaatggtggtggtgtttatggtagggtgagggcgtgttgagcggtcgggcggagcatgccactggtgagaagtcggaggtggcgtcgatcacgaccacgaccacggggcccgaggggaagacggtcaagaagtgtgccaacgtgtccggcgagctcaggcatgccaagcgggacaagtgtgagaaggcggggcacgatggtaggtgtgacgtacagtagcgggggcggagcatagcggtcagcggcgccgcatgttctcccgatttgtgtgtaaggcatcccaaatttctcccgatcttgattggttcatgtttttgggatatattggttggtgtttctagggatggattagttgattattggttaaaatttctcgccgatatatgtctattattggttgattggttgttgttggatgcaaagatgctgctctttttatagggatggattggttaacagatccacccgcgaaatatatttttgcatgtgggtcttttaaggagccgtacgaaaaaaatgcatgccgggttttgcaggcacaactagttacgatgatccgcctgcaacctacggggggctcttgtccagaaaaatcatttttttagtagtgtgcataatatgagatgttagacctatgacagtttgaagtcactttacagctcaaagaaggatctaaacgtttctaaaaaaaggaagcatctaaacagaatattggacgataaagacgcatttgccaactttactcatatattctgttgttttaagcatatatgctgatacgcgactggttcccttccactctacctatatgccatacgtttttctcctttgtacaaatcttcagttcacaattgcttttcatacctagatttcaaataatttaagtgaaacatataaaactttttaactcctcaaactttcaactgagatcacaaacattataccaaaatctaaaacatctttatattcaaaatctttaacttcttccaattgaatctctgagtttttgctcaaatcttgaactttcaaccggttgcagagctcatcaccggagaagatataaagtaagggggtgcagagaaagaaggcaatggtcgtctcgctaggaaaaggaccccaagattgctactagcacaacttggggaagaaagaagggcctcgcacttgccgcaactacaacaaaagttttatataaagacacttttgtagaggcattttgcaaattgcctcttagatcgggagttttatagtgtagagacattttatagaggcactttaaaaatttcctagaaaacttttactctatgaacactttagaaatattttcagcacattttattagattttatcttgtagaggcattctttcggtactttaaactgtgcctgatatataaagacattttcttgagacattttaaactctgtaaagacacttcttacaataaaaatatatactaaatgactaaatataagtaactcaaggcaacaacatataagtaatgacttggggttgagttggttagtaccttgaagataagaatgatttgtgcaattgatcataagtttcgaggattggcaaaaacaagggaaaatattttattgtttttttcattggtttcatatgattgtggtacaatctaatgtctctagaaaatatctctaccatcttatagacattttgtaaaatgtctcttcgtttatagagataattcaccataagacacttattagacatttttttgaatgcctatgtaaaggtattttttgaaaagtgtctctatagtattagaaaaatgtctctacaaaatatttttcttgtaatacgccgtgtcactagggaggaggaggaagggtagctatggtgtcttgctatggtgaggaacaggaacatgtgacgtgatggcttgtgtaaaggcacgaggtggtgtcaagccatgcgaagcaagtaaggaagtgatgaactaatgtacttgacagatagagagaaaataaggtgtttgctatttctgtttgcacatggatgttcatcaaataggggctctttggcatatgggccaataagtactttctagatataagttctcaatcagctttctttatgacagatggcaattacagtttagaagatgacaaatacacaatatcagttgtagtacatgaacaatgattaaaatgattcatgattatgattgtagatattgtttcggctaatagtactttatctgttgtctgatttttgtatgtcaccgaggtgagcggcgcaccgagcggcccatgcacgcatgcactcgctcagtcactcttagatgctgccggccgtgctatgcgtacgcgatcctcacttggttgttagagtttgtatcgaatatatatacgtagtcggttacagtttaagacttagagttgtattaggtgtatgactagagtatgagtcggactctatcctaggatctctcatgaatagaggggcgtgcctgttgtaaccgcatggcgacatagcatagcgagagggagcggctgccggcgacgaccggtcgtgagtcgttgtaactatgatacgctgtaatatgctggatcggggaggagcgtccgtaatcagtgccctagagatgtaggcctcggctgaactccgttatcaaatatcgtgccttggtgtcgtcatcgtgtttagatctcctacggtgttttctttcgcgtttagctaccgatgtcgatttcggggctggttttataacaagtggtatcagagcctacgggagatccatggtagaggtacgagggaggtgctccacgccgcgacgactacacagggtgtccagggacggacatggatgcaaggtggagcacggcggcgatcaacggaatttgatcggtggaatcggacacttcaggcggcggtttgaaccgtttgatggctgcaatcaacaaggagatgaccagacgtggtgctcgggttgatggcggcggaagcgattggcaatccaatcggtgggtcggacacttcaagcgggtggctcgaactttccggtgagctactctcaacagggagacgtgtggccacacgctcggggttgattgaaactggaggcgatcggcgttctcggtcggtggaatcgaacactcttggtggggtggccggggcctttcgatgagttgcgttcgacagggagatggctagacatagcactcgggttgttcggcgactgggaagacggcatgtgatttgtcggcttcggctcgcgactggattgaggggtggtcaattggaagtcggagcagatggatccttggtgctgatgtggaggtgttgataacgaggcagtgcgtgatggattgctacagtgacgacgtacgcacgacaagcattgcattgtggcaggcactggttattgatcggcggcattcgctgtcaatggaattgacccgaagtgtttggtggcggtgtaggaagtcgtggaggcgtacatgaagcttggagatggtcagggccgcggcggtgtgagcgatcctcgcgttgtggtcaagccggcggcgtagaccaaagcggcgtcattggtagcaggctcggtttgagcggtgattacgcggtatcttttctgatggggttcgcggcgcagtagcggatgcggactcggagtccggtcacagcgcgtgcggcacaattgtagaagacgaagccaagtcgaacacgagaagaggcggcgatgcggactctgatttgaagaaatcggatgcaattggcctcatgaagtcagcaaaggagttccatgggattgctttgcaatcgaacaaatcaccaaggcaaaaggagatcggattgggacctcttggcggcggtgatttgggacgacgagcgtcgagtggtaggagcacggcttggtgtagtcgtcgtgcaggtgccggcgaagttcgtcgggccagctccggtcggaggaggcggcagcggcacgcgcaggaacatcacacaatatagaacgagcagaagttgtctggaactcgtgcaatgagtcatagccagtcatgtacaggagcaaatccaaagtgcattggttaaattaattgcatgtatatgcaaggtatcaattatgatgcaggagcttgttggcttggtaatcttacggtggctatgatgggaaggatgcatgagacgtacagataaaagaagtttttgcatggtgtgcagggctacggactaatctacaggcgacagagcggcactagtgcattagcactcggattagtgcatgtcgcgggcgtggtgggcagacgtggtggtgcaaggtgctaagatcaggagtgggccaagagaagaggctgatggtgcggatagatgttggagcgagatgaacacggagactggtaggagggactccgaacccgagtccatgatttttgccagccgagtcagtgtctgtgatggatgccgaggccgtggaaaagcaacaacacctagacattagcacttcggggagcccttcgatcaattgtggccaagctatcagtgcaaaaggtgcagctcgggtgtaggtgtgtgacaacaagcgtgcgtgaagaacgtcccgggcaacagcgggtgaaaatcgtttggcagtacagaatatatccataatctgcagggtttgcatgatggggatatatagaatctgcgtcactgaaggagaagagcaagcgctatggtggtaatttcttcgaatgattcaaagcaacggtgattttctcaaattatcaggaattcagtctacggatgcgaaaaagtgtggatgttggatttattagctcggttcataagatgataaggaagaaagggttttctccatgtctggtgagtttgatttatctatttggttatgacatcggttatctagccatggattatatcaagtcatacttaagacggtagatagaggtgaacatggtcttcgagaagtctatgatgtgacagctaggaagaattcaattcgcttggcaagatgactgtggtgatatgagagaaggtggagcattgttgcgggtggagtcagaaggaagaaattacagggatactggagtatcttgttacgatgagcctggtggaggcttgtcagggcggctcggtgtgagcggcgaaaaaggatcaactcaagtcctggtacactgaaattcgagcaagtaacgaatttggattggcgtggcatattcgccaaggtggagtttgttagagtttgtgtcgaatatgtgtacgtagtcggttagagtttaggacttggagttgtattaggtgtaggactagagtatgagtcggactctattctaggatctctcataaatagaagggcgtgcctgttgtaaccgcatggcgacatagcatagcgagagggagcggctgccggcggtgaccggtcgtgagtcgttgtcactctgatacgttgtaatatgctggatcggggaggagcgcccgtaatcagtgcttcggagatgtaagcctcggctgaactccgttatcaaatatagtgccttggtgtcgtcatcgtgtttggatctactacggtgttttcttccacatttagctaccgatgtcgatttcggtgctggttttataacattggttgcctctatacatcggatatgtatatagaggagtaacaatccttgctgtacctgcattaatagagcggcacagttctattacccgcaacacatgcagcatcgtcgtatgcatcaggaatatatagcttgttcacgcctgcaggatgggctttttatgctttagcaacatggatttctcacgcggaggcgccacaatagcttctcctgactactgagtgggtactgcgacaagtaggcgagatagatgcacgtacagaggtgacgagtcacccgaccaactgcaagcaccacatgcacaaatttagtctgaaaggaggaagtagagtcttcacaaagcaatgtcgttactctgctaaaacctggtagatttgattaattttatcaacccatgcatttttcatgcgatgtttgtattgtgcatttttttcactaaagcattttcaatgaattttttcactgattcacccaaaatagattttattataagtgataggaataatacatatataacttagatatccatggatattttttttgaaatattttcatgttatatctagatgacatagtataatgaatgttatttttatataggcatattataggatatatataagctatcaagatatcttttagaattgcaaaatctaaatcgtgcgtgctctcgtttcgtcttatagcgcgacgcgtctaccagccatccatccgtgcgagtcaacaagtaatgtgcacactattttgtctttatccagcgacggatgcatttaaggttgacattaagtactgtcacggcgtgcgccctttcacctgctacgtattgaggccaccaccaaccaacaagattagttatactagtctatctttcttatagaacttttgatgatttatatcttttaaaccacacattacttttaaaattcgtttgaaccatcctactacactcaaaatatcgaatatattcaaatatttaaaagtaatttacttaaattttagaagtaacttagttattcaatagaaataactctccatagtaatagaactaattacgtagcaggtcagttgtaataactatgtgaagtaaattcacaagtaaaatgtacgaagatttttaagtaaatacaaatattttctttatttgaagtaaccactatatttttttttcaaaaaatgtaattttgcaacatatggaaggtaactcttcaaggtattagaagtaatacattgttagagggaagaaattatgaaaaacagaagtaactcttcatgatactagaagcaactagactgctagagagaaataactcaaaaaatagaagtaacttttcatggtattagaagtaacttaagtaccacttgatgctagagggaagtaactaaaaaatagaagtaactcttcacattattagaagtagctatactactagagaaaggtaactcttcgcagtattagaagtaactatgttcttagaggagttaaaaataatgataaaatttatgtcgatttgacagttttatggtacagtttgttttgtttatatgtcttttgcattatttggcacatgtttaaaggatgtgggataattttgcatgattctaaatataactacttataattacttttagatttgaataaattacttcttagatatttatgaaagtaaattcaataaagcctgaaaataattcacacaaattataaaagtaacttaacacaaaataaaagtaagttatcatggtattaaaatttaaagtaaatcagttgtggtggtaaaaacatgtgtctatctagaaattaaattgaatcaacataaattatagaactaactaaaaacaacaataaaagtaacatattcacaatattatgagaatgtctaagaagtaatctaatccaatctaaaagtaatttatagatacacaaaagtaatttactacacatattcttcttccattaaaatataattatgtgagatcttgttataaaaattaagttgcaatgaacataatgatacaatctgattgtatatcagattagtaatttaagagaaaattttatttgaagtttaggtgttaggaagtaggtgggctctttggccaaggcaacacatgaaattggtaggttggaaaacttcaaaagcatgatctgttcatgagcggtattatttttagagagtgaaaggtgcagtggtactattttttagggccgtctctagaaatttggggccctagggtgaaatgcaaatgccctataatttaaaaagttatgtctaatataaataaaacatattttcgctcaattatatagatgtaatatgtgttgtaatgtacaatacaagtaattttattcaaacattgtaatttgatttaatggatcattcaaattataaactacaatcatgaactcatggtaatttgatgcatattatgaatttacaatctatcatatatgtactcaatcactgtctaatcttaccggtccgaggtcaagctgtcaagagtcgagtcgaggatgatgagcggacgaggagggggaaggcaggagccgaggcgaggcagctgttttgccgtcaccgttgccgctcggagcctcggaatcacaagcagcaagttgtgtcgccgcctcgccagtcactgtgcatggaattgggatggacgtctcagcagttgtcacggcgcggaatcagaatcgcagagcagccagctagcagcagggccaagttaggccatcgcacagtccaatagtgccccacccctggcaatctagcatgaccttgctgatcgatctgcctaattgggctattggcagttgcaagctatagctgggcaattggaagtgggcctcatgtttatatgggaaaaaaattggaggccctatgcaatcgcttatttggcacgtacccatcgacatgcctgctatttttagtaacaaggtcgctgattaggacaattcagcgcacaccatttgatatagtctcctcctattagaatgtatgctaataaacagaaggcatcatttactcttctctctctctctcttatctacactagaaaaaatatccgtgcgttgcaacggaaaggttattttaatcatattattattttttagataagttaatcatcttattattatacggtttagttaaggtgaaatttactatgggaattcacttggatttgtttcttttacaaaattatgagctgtaattagaagtttgattatctcaagtaattatcatgtatgtttttttaaagagatttcttatacgactctttttgtattttcaaaagcgaacgaacttaaaaaaacgactcaaacacagatctgtatttccaaaagcgagtgatttaaaaaccgactcaaacacgaatgacgtaccaaaacaccggcaaaaatatctttaatttttgtaaaagtaaagtgcatatgtggtccttaaactcgtaaggttgtgtcatctaggtctccaaagtctcaaaatacagattcaggtcccagaacttgtcaaagtgtatcatttaggtcccaaatcgatatagcccctttaggatcctacgcggcgctgatgtgtcacaccacatgaacgtgacgtgtcattttctcttttttcttcttcttttctttttctttttctttttcctttttgttttcttgtcattcttcggtttttctttcctttcttatgctccggtcgcagagaaaggagaagaaagaaaaaaaaaggagaagaaaaatagaagaacagaagaaaaaggaaaaaggaaaatttttaaatgggttccgtttgtcacgttatgtccgtgtggcatgccacatcagcgccatgtagaaaggggctgtggtgaattgggacttatatgacacactatgacaagttctagaatttggatatacattttaagagtttaaggatctagatgacacaccattattagtttaaggactacctgtgcactttactctttttataatagtagggatatacaattaaaagaatatgtttgatattttttctaaatgataacgtcacgccattgttcatatctaaaataagaagatacaaaatcagaaaagaatacgatcgatcatggcttggatttgttcttgtagtcgtatcgctgcgcaaggtagacgaacacggccacctccagagcggcgagcgcggcgagcaaccagtagaagtagtccaggtgcgcgcggttgaggtcgtcggcgaaccagctctctccgccgccgctcctcgccgccgtcgcccagtcgatcgccgccacgagcgcgccgctggcgtagctcccgacgcccatcacgccctgggacacggcgagccccacgctgtggagctcgccggccacctggtcgtagaagaactcctccagcccgatcacggcgagcacctccgcgacgccgatcagcacgtgctgcggcaccagccaccacacccccatcggcaccgtcgcgcccggccggttgaccaggccggcgtcgcgggccacgcggagccgcctcgcctcgacgagcgccgccacggccatggcgaggcagcccgtcgccatgccggcgccgatgcgctggagcattgtgatgccgccgccgccgccggtgaggcgcctcgcgagcggcaccaccatgcggtcgtacaccggcagcaccgcgatgtaggtgaagctgacgaggcactgcagccccgccgacggcaagacgaggccgccgccgccgccgctgccgacgcgccgatccattgtgctgctctgcttggtgaacagggtggacacctgcgagacgacgacggcgaacactatgctgctcagccagatcggaagaagcttcacaaggaagaatcccctgccgccatcgccatggccatccaccaccaccaccacctcctcttgtggttctagaagctgttcggcggcatcctttcggtttcgggagaagaagaagaagaacctcgccgtccacgcacgacgcgccgcggcggcgccgtcgatggcaggtcgctcggcgcggcggtacgtccccgtgccgagcaagaagacggcgaggtagagcaccatggtggcccagcacgcggcgaacccgacggtccagccgacgttctcgtcgacgtagctgagcaaggtggtggagatgacgtagccccaggatatggagaagtggtaccagttgaagtatgagctccgcgacgcaggccgccgcgcgccgccgccgccgccgccatcgtcgtcaccctctctctcgaactggtcggcgccgaacgcctcggcgcacggcgtgtggaagccctgcgccagagctagcaggtagagcgcggcgtagaagacgacgacgacggcgccgccggcggacgacgacggcggcgacgtggctcgctgcgccgccatggacgacgacgacgccgtgagcatccccaagctgagcaggtagagcgcgctggcgacgatgacggcgcggtaccggccgaggccggaggagtcggcggcgaggccgccggcgagcgtgagcaccagcaccgtcccgccccaggcgttcgccgcggtggccgccgccgccgtggacatggccatcgggccggtgaggtacagcatcaggttgccttgcacgccgaagaacccaatccgctccaagaacccgacgactgcgccatggccatgcatgcacacgtcagcaacaaattaagcctggctgagagagatgatgtcatcactaaagcctgagaagccgccacttaccgacgaggaagaaggcggcgcgccaaccgccgcggcgggcgtcgccgtcgtcggggtcggcggcggcggcgcatggctcgggacgacgtgcaaggaagccgccggactccatggctaatggcgcaacgtgcagctgtgtcaagattatattttatcgtgctagctgtgcactgtgcagcatgggctagtacatttcaaggccagaatatcagtattaggcctggttaacaaaaaaaacattacatccaatctttagatatatacatgaagcattaaatatagataaaaacaaaatctaattaattaattgtacagtttgcatgaaaattgcgagacaaatcttttgagcataattagtccatgattagctataagtgctgcactaaattaggcttaacagattcgtctcgcggttttcagacgagttatgaaattattttttttcattcgtgtattaccttctgacattcggtcaaacgtccgatgtgacactcaaatattttcttttcgcgaactaggccttagcaatgcttctttttccttttttccttttacaatatgtctagatcagaataccaatgatgcctagagccgagtgaataagacataaagaaatagttaatatatgtcactgtatttagctatcagtactgacaagtactaccaccacctaatatctggagtggctgtctttgtactgaaattagttgggcccgccaccaagggtctactccttccgtctcaaaatataagaagttttggttaaatggagtacattttactactataaatctggactgtctgtagggatggcaacggggcagggcggggccgggttgggctggaacggccccgctcccgacccccgacttcaccccctgcccccgcccccggtcccgactggagatgcggggctaaatctagccccgtccccgacccctccgtggccccgcaccctgactggggcccgcattgaataaaatctccatcccatcagcataagaaatacaagacagctatcaattcggcaagaacaaaaatggtacaaaattcacacaccatcaaaaatagcataattgtacataattgactctccgaacggtggccgcgcctgtgcgccgtgcggctcgccggccgccgtgcctgtcccctcgcggctcgccggccacagcgcttcccctcgcggctcgccgaccacagcgcctgtgcgttgcgccgaccgccgcgcggctcgtcggccaccgtgccctgcgcaccgcccgtgcgacgtgcgtcgtcggcactcggtagaccggagggagagcgggagagggtaaccggagaggggagaggaggggaggaaagaggaggggagctggggatgggagaggccgagagggcgaccgccgtgccctggcgacctgcattgtgaagcgccgccgccgtcgcctatgtgtgagacgggaggggagatggggttggggagagactagagagagagctagggttttgtttatatatgtcactattttgttgtattgggttctattgggccttttatgcgctacattttaagagtttaatatacatcccccggggccctgcgggtgaaatgtctctcccgtcccctccccgcccaaatacagggcccggccccaactccccgcaggggacccggccccgcgggggaaattgccatccctaactgtcttactgtctagatacataggactaggatctggacggaccgagtatttgataaggcttcaacttctaaatttttcttcaggatttatgtctagagtgaagttgtggagcataaactcagctccagctctctagttcattttctagagtactccagcctatttcactccctttttgacggagctgaaaccgtttggctgtgcttcattggagctgagaccgtaccctcactttattaaactaggaaatgaattttaaactcccaatgggatattgttaaatattttttttaaatgttagcaggatagacaaatatttgatatattatttcacaaacatacaagttaaatttgacttctacatattacattaaataaataacacattaaagtatagcttagtcaaatttgtcttacagttaaatttaaatttacatatcggtagtgatttatcagatattaatttaaattgttttattattatttggatgatatataaacaatgaatgatgtggtctgaaaagtttagaatcatcccgtataattgacacgtgactgacatatcccatctgttttctgatcatttcatttactgttcactgttcaataattataaccaaaccaaaccgaccatgaatagttgcatagatatagtttaaatcaaaaactcaaccaaaggaccgtaaaaactcacaccatctctccacaaggcaaatttaaaaagttgtgctcccggtgacacgatcgagagggtggtgagcagcggacgatcgattacttctctttcacgtaccagatacttcctccgttttaccatctaaattattcttatattttccatatttatattgatgttaatgaatctagacatccgtatatctgtatagattcattaacatcaatataaatgtcagaaatgctagaataacttacattataaaacggaggaagtaacatgaaaaaaaattctcacaatttattaaatataactggtaaagattgttctataataaacacgctcaatgatttgagatgagctcttcgacctgtatcacaagagatcacgaccagaataagggtgtgtttgaaaaggaggggatcgagaagattggaaagatacgtaaaacgaggtgagccttagcacataattaattaagtattagctattttaaacttcaaaaatggattaatatgattttttaaagcaactttcctacataaattttttgaaaaaaacataccgtttagtagtttaagaagcgtgcacgtgaaaaacgaaacaatctttctctctttctcctgcgctcgaatgcagcctaagagtagtaacacgtggtttcgggaatacatatactattatatcacatcactgctcactctctgtcattactgcttgatgttagaggatacgaacccgcacaaaagatacggggacacgacgaactcaaacctgacatatcctattaataattaattatgaattaatatcgcctgagggcaactcattacccactcgacaaaatcgaaaagcacaaaacgaactgtgaactaatttattaggtaagggctagaccaattatgcaagtcatatcaattccaaccaccgatcgacatgcaacacatcaaaaaataataaaccagtatatatatatatatatatatatacggctctaatgctactaattgccttgactaattaagcacctcacaaaaaaataataataaacagatgcggcttctttgctataatttccgcactaacgatctttgctaatcatacatatttttaaaatatgggtgatatgatcttaaattgtttagttaattacaaatagaataacaacggaaacaaaaaaaatcacatgttgttgccttaagtttatgggtccatggaattttttatttttatacatatatacgaggtttgtatgtatacttaccgagttttttttaacaacgtagtcactcacagcacacgcacactcacccctatgaacgcacgcacgtaaaccctacccctatgagcatctttgaatactgggccggcaaatccttaagattgacgaagttaccaagttaccacaggcgcctcgctgtcgacggataaatcctagaaaattcgctctgtacacatacatataaatcttttttacatttaaagtgtatacatacttatataaagtttatacatatgcaaagatttttataagtgtatatacaaagtttatattgtatattaatgtaaagttcaaatcaccctctacattatgcagtagtacaatttaccctttcgtagcccagtcgtcttcatcggcgtcgtcgcactctagctatgctagtacgtagtaggagcggatctacagttaaagggctctagctatgctagtacgtagtaggggtggatctacagtaaaaagaccggtgttaagtaataccgatgactttatgttagagttcgcagctcggcccaccaaccgtggaccacccagatcacattgggcttgctccaccccagattcaaccggagccacaattttaggtcctggacctacacaacccaacagactagtctcttgggtgaggattgctcccaccttttaagtcatactccccatcatcaattaccgatcactggtggagaaaccatctttggtcggtcggccgaaatccacaatagtctcggttccactaaaaaccggttcaaaagatgatctttagtcccggttcaaaaggttagagctactttttgatctttagtcccggttggtaacatcaaccgggactaaagattatttttagtcccggtttaaaagacggcaggtggtgtcagacccctctttatctttagtcacggttggtgacaccaaccgggaggtgtgtgtaaataaaataacttattaataaaataagataaaataaaataacttataaaacaaaataagttatttaaaataacttatttaaataaaataagttattaacttattttacaccaacctaacaccaatcgacatgcaccgtgcgagatcgagaggaccaaggcgcacgggaggatcagttaataagttctgacatttatctccttctctcctcactcaccccatctcttcctcttcctcctcctcccatctcttcctcttcctctttctcctcccatctcttcctctacctcctctggatccgcctccttccctctcctccccacttctcaacctcctctggatccgccccctcccgtctcttccccacttctcaggcggcggcggccgggcggccgcggaggcggcctcgcgcggccgggaagcgcggaggcgccctcacgcagcggccaggcggcgacggaggtggcctcgcgtgccctcacgcagtggccgggcggcgaggcacagcgcgcggcgggcggtggggtagcgcgcggcgcgcgcggcggggacgcgccggctctcctttctttttttttttataatttgtgattgagagatgtataatttcttttttagaatttgtgattcattgcatggatctgagatgtataatcgatctgtgatgcatttgatttgtgtgtaatttttttaagatttgtgatgtatttgatttgtgtgtaagtaacttaggatttgtatttgtgatgtgaatgatttgtgatgttactttgaatttggagatttggggtttgatttaggtatatgcatgacactcgatttggggatttgttgtttgatctgggtatatacatcccacttgggagaaaataaaaagaaaatagaccaaccgggactgcccctatcctctctttagtcccggttggtagcattaaccgggactaaagatccctctctttatatcgatctttactcctggttatttcacccgggactaaagatagcgatctttagtcccggattcgtagtcccagttttccaccagtggatgtgggactaaacccaacacttttggtaaaacctatagtgaaactctttatccatatgttataacattatgatctaagcataattagcatattaagacatcgatagatatgttatatgacaccaacgaatcgattttctggatccgccactggcacgtagcattgcaacgagctttaccaatgaagaagaagaagatttatgatgatgactagcatgcatgcaagtagttgatttaattagctgctatgtccgtcttgtgcttttttcttcacgacgactgtctctgtccgaatccgtctcgtgcatgctccccgtgtgattgaggcatgcgacgccggagacgccatcgtggccagccgtcgcctggggattacctccttgtcggctatatatcgcgtagtcaccgctgcctcgtcttcccatcctgggttcctgtactggcagctgtggcttgcaaattactccctctgttctaaatattttacaccgttgattttttaacacatagtggatcgttcatcttattcaaaaacttttgtgaaatatgtaaaactatatgtatccatataagtatatttaacaatgaatcaaatgataggaaaagaattaataattacttaaattttttttaataagatgaatggttaaacatatttaaaaaagtcaatggcatcgaatatttagaaacggaggaagtaacggtcagatatctagcctcctctgtcccggcatagagagaggtggcagctacctcgccgccgcaacgggagcactgccttcgttattgctgaagccttggtgaggtggaatcgtcctgctcctctagcttctactcccgcccgcactcgcggccccaattatcgtccgttgaggctgaggataaacacgcatcactgacaattgggcctcaccgattttttatttgtatttactgactagattgcaacttgtacacgtaggtcgaaaaccactctcgaatgagttaggagataattcgtttagagttaagagttcagggtgtgaaatattggtattttaattagtttagggggtaaatcgtacgacataagtttagagaggcaacttgaactttcaccttctttatataatatatgtataaattttatatatacacatctacgtatagggcagaaagatgaccgtgcactcgcttgtggtgccacgcaagggagggggacgataggtgggtcccaacatgtgagtgaggcttgatcgggtttgaagggtagtatcgtactttcataactgtttcactcttaaatttattcggatataataaaataatattacgggtgtctagtaaataattactacttttttgcagtgccctagcacagaaacgtgttcttgcggtgtcccctagatagttacattttttttatatcatgtagcaaattttgcacatattagtttgagctattgacttagaagaaagatttattggttgaaatcgatggttagatttgtttcgtcaaaatttatagtagttttttctagtttattagagggactctcgcccagcatgaccctgtcgacccctgatccagatcaatacacaggacattatacaacaagagatatttgccagtaattagacttgcatacttgaatgttaattattatcacgtactgcattgttaaaatcaacatcaattcagcgcatgcaaagcacattcccaaatgccgtaaacacgcaagaagccatgaacacgcacgcgtggctttgcatccattaatttctccgataaatgaaatgcacgccagtagttgcgagatacagtagctacatcatcaacttatttggtggaaatggagatcgagcagtgaactcgatcgatcgatcagtggctccccgggggacggtagatcggagtcggcgatggcgtgccgtacgccggcgagacagggggccagaaaggcgacggcgatccgtatcccggcgccgtgggaggtgggcatgccgtcgccggcgttccgtattccggcgtggatggtgggcactccggcgccggcgttccgtatgccggcgtggaaggaggatattccggcgccggctggccgcattccggtgccggcgtgggaggaggagggcactccggcgctggctggccgtaacccgggtcggcaggggggcattccggcgccggctggccgtatcccggcggcgtgctgggaggggagcatgagcatcccggcgccggcgtgccgtacaccggcgagggaggcggctggtactccggcatgggcttcctgtggaacatgcgatggcgcctgtggcaggggaagcagatggccaccgacgagcactccggcgaggacgacgtcgacgacgggaggtgcgtcttgccggcgacggcgacgaaggtgcccgtctcgccctccgacgacagcggctcgatcttggatggctcctggccggggcacggcgcgtcggtcgccgcgctgtgcagctgcgcgacgcagtcggcgccgcggaggtcggcggcgagcggcacggcgaacgcgcccgcgccgtcgagctcgccgacggccttgctctcgtactcctcgctgctgccgttcttgcacttgatcgccaccttaagtcctgtcaacaaaatgaacaaaaataaacacaacatttttgtgcatttaatagttgctttgattggtgatcatgcaaatgcacagttagatgacacagtttcttttaatcaaagcgaatcggttacagtgactgatccaagaattttcttgagcctaggtaaagcataatcctatggcctgctagtaagtttttggcccaagcaatatcatctgtgataacaggcccacacatgtcaataggtgtctgttacaacatctgtcgttatggtagaggatgtgcgcacttttagatctaaacataacaatgtttatataatcgactcgatggttattttgtacccaaatatcgcgtatattctacttttaatttatgagaggtgtcaattgtaatctttgtcaaataccactgtcccatcatcaagagtgtactccgtatatactccctccgtttcgaaatgtttgacgccgttgactttttatcacatgtttgactattcgtcttattcaaaaaattaagtaattattaattcttttcctatcatttgattctcatataattttacatatctcacaaaagtttttgaataagacgaacggttaaacatgtgctaaaaagtcaacggtgtacatgtgctaaaaagtcaacggtgtcaaacatttcgaaacggagcgagtagttgcttgcattcgtacttacccttgaaagcggtctcggcgtccatgttcttcctgccgcagccggcgcacttggccgcgccgacgacgaccgacgccgtcgccgtcgtctcaccggcggccgccgccgccatcagtatcatcagcgccgcgccatggaggagcagccagcttgctcccatggcgaagctacagttgtgtgtggctctcaatagtagttgcactgtttgcaggtgaagagcaagggcgtccaatgaactgcttatataggcgatcattgcatatataattgcattactggatgttaataattcagcactgattatttattttatctatttatttacagctcgatcgatatgatgatccatggagttaagatgtgccacgaaaagagttaatgtcaaacgtacgtatagcgtaggagtgctacagtaagctacattttgtttagttaatttaccagcgaattaaatctcactggcagtgatgaaatggtagatagtatagagtatagagtataaatatacgtatgcatactagtagtatgtactttggctatgtataattaaatgccggctcaattcaatatgttgtcgccgttgtcatgatctcttatatcgtgagctacgcttctatgtaataagtagaactctagttctagtttgtgttcatctcagtttcgggggaaaatccagcagtacccactatacatataaaaatctcatcgggagaaattcaaattgttaaaaaatatttcccgaaattgaagcagttcaaaagagctttaatagttccaagaaattttagttgtcactacattgttgattataagctgtaacggtttaccaacaaacaaaaataatttataaataaaacttatatatatatatatatatatatatatatatagatatacattcttagctgtttaaatacaaatgttgtaaaataaactaccgttaacccaaaaatctgtcccaaaattaaattttgaagtttaaattttggtttataagctaaaggatgaacaataggagtgcttatttttttttccttggaccagaaaaatctcaagagggcccgagatagcaagatcctgcagagaatcttgcatgaccacacataggagagtagaggatgtagttatgttggatgcatgatcgaagcacatgcaacgatgatcgacgacgtcgtggggttgactgtcatcttcaatatgttcatgtgtgtgcattcaaccaagttggtgtaaatgtacgcattgtacagtcttgatctccaataatacagatctacggctgtgtttagttcagcgcaaagtttggattttgattgaaattagagatgatgtgactgaaaagttatgtgtgtatgacaggttgatgtgatggaaaaggactgaagtttggatccaaactttagatctaaacacagcctacatttatttaaacccttctaatccataattccctttaagcttcaggtccagaagtacatgttcccaaagggaaaaagattgaatttaagtacgaccgatacctataagattgaattgaagtactatgcctatattaataactattcctagtaggtaaaacgtactagccttaattaattagacaatgtcgtctcaaatgaaaccacagttcaaattaaagaatgaccaatcttcatacagtgataataatcaaggctcaaagccaactcaacctttagaaaagaaaactccttttttgcaatttaaagaacttccaaataaacttttgtgaggcaaggaagtttatattaagaatcatatcaaaatgtttcctttgattattgctagatcataaagtttaggaaatcacaacattagtatgtcccgaccttgcacattccataaagcgtcccaacaacaaaaaaaaccccaccaattcaaccatcatccagcaaatcattgtttaaaaacattctggaattttaaatgtatgtaaactacaacgagcaaagagtttccttaaaacattccaacaataaaaacccaccagttcaaccatcatccaggaaatcattgtttaaaatattctcacattttaaatgtatgtaagctcaaacgagcaaaggatttccttcacagctatgcccggaagacatcaatttcacgtcttaataataagaaataaggatgggatcattgatcatcctgcacttccctgtggcctcctctggcaccttacacttctcaacaatgatcctctgcaatctggagctgcctccagctagggctgccacgcctgctggagttacctgagagcagcggaacaccccacacgcctccagctgcaagcatcctcttgcaatatcttctaggccaacgtcgctaatcgcatcacagcgaagcatcatgagatgtttcaattttcggaatccttcaccaacctttgctagtgtggtgtcaccaattttctgaagaacagtgcaggaccatgaggggaaaaatcaatgctttaattgctatgcatgaaggtaggaaaacaaacatgacgaattctataaacaatttctgaaattaactaagactagaggtcattttagaacaagaaaatcaatatcttctatcttatgatgttgagagagagaggggagaccttggtatcacttatattcagatggactagatcatggcactctcttataatggtagtaagcccataatcagtaatttgattgcacccacatatatctaacctctcaaggaaacgacattgatcaaccgtagcaagcccggtatcatttaacctgtaaatgaaagccaaatgttagcagatctttgtcataatagatagaacaaaagtttttatactcaacaaaaaaaatgtttagaacagaatgatgtcagaatgctttgaagaaaatgttataaaatggaaaaattaatgacatgcaactcaactgtatacctttcactttgaactcaggaagtcaatttaacttttgattggaactatcatctaagaaaggctaacgaattaaagttatctttgattagaacatgtaaaaaagtgaatcatggattcaagtacttacctcccaagaccatggagggtcaactctctaagttctttacaattctcacctacagatagtaatgcttcatccccgatctgcagagtaaaacttcaacttaatatatacaagcaaagttacaatgaaataaaataaaaacattttctcattccgtattccggtttgggagcagccgagcagcaaactctggtgtcggcttgccacatgttggtcttgggataaacattagcctaattggcaaatatgaaagacaactgtaacctggcaaatgccagagttgacaaagcaggagaacattaccacatcgaatgagggagaagggatgtggttaagactcaggaaaagattctactcagagtcatgtgctaaatcctcatcaacaaagccgttatgagaccatgatgactcagcattccttcatcgctctttggatctctcccttcaacaggaggggggctcaggaaatacttgtgcttgtggacagaaaagttgctacttgctacaaactgccagggaatgtggagtcggcatgtgacagttttgcctcgccaaagggattctttgattcatcagcaaggatgacaaaaatcctcgtccatgagatcggtggcatagtctatgacatcaagggccctacccagcaatgacttttgatggtggctccatggacacaatggcagggtcatccccacgacaatggcagggtctattctcacaacagatggtgccaacaatccaatactgagaaattcaaaatttcaaataaagggagactgacttcagttactcccttggaaatgttgagactacaatgaaactttgttacaggaaatttatgtaaaaaaaaggacttcaggatcctccccttggaggtgtttatggcttccatatgtatagcctctaaagggacaaataggcacctttcatcaacatgcatcttttgttcaatgggcatgtctcttgagattgaacccgtattccacatgtactgtattattattttgtataataataacaacaaaaataaggatttttattcttattatatacttcctccgatccaaaatgtagctacctagtatagaatgggacattacctagtactatgaatctggacaggctctccagattcatagtactagataatgtcccatcctgtactaggtagctatattttgggacggaggaagtattgattaacaatgtaaattataatactgggacaagtcgttgatgatcactattcagataaatatagtgatcgtacaaaagctgtgatatgcagaatcactatgtgaagacacaaggtgctctgcaagatcaccctaagacaaactatcatagtgatctgtatgacttagtgataacgtatcatcattcgtatgatcaaaacaagtgactggagaaagcatgcattattcctcgctagccatgcccatttccctatactggtacaaatccatcaccttgaagtgattggagacaaagtcttgaacatcgcaccaaaagaaaaggaaaattgggcggggagatggaagtaaaattttggtggtattaaaatgtaccacaaacttttagtgttataaatctgaaggtaaattttgatggtatagatcatttttttcttaaatgtaaaatcaatcttcataaatgtagattaatacaaactagaaatgtacctgaggacaagagatgatagaaagctctctcaagttcttgcagccttgagctatgtgagatatggcctcatcgcttattttacaacagttggccaaacagacagacttgagaaggaagcaacatcgaccaaatccgagaaatgcattattgtcaatccacagactgtttagagtgagccctagaagatttctgcgtttaacatgtacaaacacaaaagaaaaaaaatcaacagtatattgtgaagtctagcttgacagtaggacaaaggcaaaagtaattgcttagagtagtagcatgtatcgcccaaaacctatataatttagaatgacaaaagcagctgagaacccagttcttcaaaatttgcccataagaaaataacagaggcatagtattatgatattataaattactaatatattcaaaaagagtgaaggttctagtttagagaatacgtgtcatgtgcatgctatgggaattaggcctgatgtgctaatctcgtcacaccaaaccaggtaaaaaaaaatcgtttttagactactccgttgctatctaagttaaacaaggtaaaattacactacttcataaaattgtttttactaaaaaactgtctgttccttaaccacgagactaataagtttaggtttcgacagcacttcaatcattataccagtatattgcacacactgacatttgttagacatgttgataatttgggaaagagtgaatttcacaaaaccacacaccttttgacacttggcacttaactacatatattttgatattgaagtctcacaaaactatactattaacaaatgggcctacctgtgagatgacatggatgtttatctatacatatttaggccgcgaacgtggcattgttgttgttccacctaggatgaagttcccaagtctgcatcctaggtggaacaaccgcgccatctcgcgaatggcccatttcgttgatagtgtagttttgtgaaactttaataccaaaatatatgtagttaagtgccaaatgtcaaagtatgtgtagttttctgcaacttggaccataaaatatgtagttatgtaaaatttactcattgggaaacatttgtggaacacttaacaggggaaacaagtccaatacatgtctgggaattgttgattttgttccaactttttatttctctaatcatagctggattcaagagaatacgaacaattggactaacattaaccttccattttgagcaaacatttgatatgcaacttagattacagctgttgtacaaacatcaaaataacaagtggattgaataggaaatgttgaaactttcaggcttattaattatttgttaccgcatattagcacaccttcagttttcctaatctccaatttaatttatcacaaaacaacgtgcatattttgtcaaaaggaatacatttagtccaaacctcaacggactagcaaataataaaagaaatcctgtttatatatgtataaattgaaaagtacaaggtaggaagtatgttaacaaaaacaaactttgtaccatgtcaaaataaaaattgcgcgagttgcaatatgttaagtaatcaagaagaaacatacatgcatcgctgtccaatatgctccaatgcagcactttccataatatggcacatgttaatttccatgtgttgtagcattttacagttctgggaaacacgttcaatacttctatctgtgaatttgaccgacgatttgataattagacttttcagctgcttgcatccatttgctatggaaaaaaggctcctgcagtagcaaatgattagcagttgaataaagccctaggacatcgctccaaagataaggggcattactgaaaagaacaacagaagtcaaagaatggtcaatgcttgcaataagagaaaaagggaactgaagtgaaaataagtagccatatattcctagaaaatatactacaacaaggtaagaagtgcaagcagtaggcaactagtcattgataaatatttcacatgtataactttcatcatttacagatcagtagatgccaaccattcaaatttgctataaggttttaaacctcagtaaccagtactccttgtttgattaccttgtagcaaagcatacttgaatcaggcttgtacttagccttataagcagtataattacattttgggtttctatattggcaaatctaaaatttggtttatggttttttgatatttcatagagaattacagttgaaaaacataataattttaagcaactatttcacaatttgcttaacctttaagaaatagtatctaaatctagagaaacttgtcacaaataaaaggaacacgcatataaggaaataaacacaacttagaaagaaacaaattattctagtcccgtctatggttcttcccaactaacattgcactgtggcgggataaacggtgtcaagtaacacagtactactacagcacagtcatgcattagaagatgcatacataaaatgtcttgaccaatatatccactttgaatggaccgtttcaggagattactcttaatatgctgatttttagagagaactaacttgcaaatatacataccaattaaaaaatttaacaacatattgtgtgccatgttcatgtaggtataaatcttaaagtaagtggacatgagaaaactatagaaaagaaacttcgcatatagcagatttcttgatgttttgatggggattgcttgactttccatatataggaaaggataaactataaatgatacagtagttcaccaaagtagttgttgttctaacggtgtcttacaagtaagacccatgtgctgatagtttgttcagcacaattataggagtaattccactatttcacaatatatgtttttttctcgaaaacgcaagagaattgagtttcatttcattaaggggaagaaaataaaagaaaaatacaaagtagaagagaccaatgccctcctaccgcaaaaaacacacccacaccccggtcaaccccggctatctagctgcctaggtttgccgaaccactaaaaaacttttggcggggcagatgctcccactagacaccaaagattaccctcattccctaccacctgcaagactgtcgcaggtggaaaaattttcaatagctacatcttgatctcctcaatggagaaataccttcttaagcaatgcacaaatattgtaggtggcttctacctgcaagattaccctcattccctaccacctgccttccaccgtccttaatcaaagtttttgaaagttaggtggccgtattatgaatttattagggagcagccatggtttcttactctcttaccaactttttcttagattttgtgcttctagctggcttgtgcgaactgtgggcattacaaatattttgaaacagaaggaacaattggattggtacttatactagtaaccacctttatgctggttggacattgaaagtgttccaaaaactctccaaaaaagtggatattggagcatttgctgaacacatgtacgcccgcaaaattatggggacaaatgctgtcaaaccaggaaaagttacttatgaagtttactctttttttttgtcataaataatatccacgatgatcatgaaaatttgaaaccaaacagggcaaatatgccccacaagtgatttttcccatattttcagtatattattcacaacccaactacaataatatatacaattactcctaaaagtgagaaatctacaggtgcattattgaacttctttttttacaaaaaagaagtgcatatttctctgaaagtttgggaaggtcctaaaaaaaggcataaattgcaccctcaatttatcaatttcatatttacgctgatttcatttttatgtaaaacatttattgatgttaaccttgtaccattatcttggcctaagaattctaatcgcacaaaaaattaactttcctgtagtctgctttaaatatcctatggtgccaaagttctcaaggtgcagtacttagagaaaacataattctttatttactacttaacatgcaaacttatactcaggtggttcactactgaaattaagaaaagagcatgtgttcaaatcaatataaaaaaattataaaacaattgttaacaaatggttcagcatttctactcttcaattctataagcatcacaatgcagtatcagtataagctatatcaaatttctaagagaaatgagacaccgatacttccatccctgtaaaaatgcaacagtagatttaataattggacctattacctgtctgagcacttattaaggttgtcaagtgacaaattttctaaagcagagcaagatgaaccaatagcttctaaagcttcatcgccgacaccaagccataccatctttaaggatttcaaatattggcatccttttgcaacagagatcattcctttgttttcattaacatgcttggactccacggataggacttccaagttatggcagtaggtaccaattgcatacagggatctgtatgttatgcaaccattgcagaaagaaatatcaagagagaccaatgatttactacgtatctttacaaattcaaccagtccttcgtccgtcaactcttgaacaccacacagctttaattcactaagattgcatccctctgccagagtaatcaacccatggttttgaacatagccaccctgtaagaaatgttgtcaataaaaaatgaaactcaggggaatacaacactaaatatcagcatgaaatgaaacctcaatgcgaagtttacaacgtgaactgctgacttggacaatgataaacctcaaaaaggagaccattaccacaacggaactcactattgctacaatatgatcctcaagtttcattcgacaaaatagttaaaataaaagaggcatctatgatcaccattcaccataaggaagcattaacttcttcatagttccaaagatttgcccgcattggaaatgaaagcagatcatgctacgtgtgaaacaatattgaatgcacgaaagaaaacagaacaagtacaactaacaagaaattaccgaaagcgctaacgattgcagattccggcaacgatttgcaattcccaccagccccttttcagaaatgtgcaaaaaccagtttagagtcagcttttcaagccctttgcaaccctcaatgagatgaagtagcccagcatcagtaaatgaggttgggttgacaccatcactgccattttctttttgcgtatcttcgcttagtgtggaacactgcatatgttgctcatctaacttggggttttcgttatcccaaccctgtgcctgtgacaaaaatagtgcattagtgacttgcaaaattgatagacaaaccacatcaagaaaatagtttccagagatctaaattatatgcagctctggcaaaatgctaatttctcagggagaccaagaaaacaaaatcttaaccacggatttagttgttgaaccaataaaacatcggatcattcattcaattccacaggggaacacaagagatgcgagaatttcgcgcgattcccgaactgcagccagagaaggactcaccctgctccgctccgcggcggcggcggaggcgccggcggcaatgtagaggccgtggtcgaggaagacatcggcgaggcccgggaaccggtcggcgacgcagcggacgacggcgtcgccgtcgggcccgtcgacggggaccctggcggcgcggcgggacgcgcgctcgacgccgcgccagcggcggcacacgagcgcgcagctgtcaaggtcggccttgccccccgcggcggcgacgcggcggaacacctccgcgagcaggtcgtccgggagggcggcgttgacgaggccggaagcggaggccatcgcccgaggcggcggcggcggctatcaccggaggtagggttccatggaatccctaagattggaatgaaatggaattgaagcggaaggaagaggggggttttagagcccaagcctttgcaactgccgttacaactttgggttaattagacacatgccattactaatttgaaggtttagaaaaatatcattactatttgacaaattgtaaagatgccattacaaatcccacgatactggaaacatgccacgttctacgcctgatccgcgattgtactcgtttttatgcgtaccgtatttacgtatggaccataatgcccttgtgtatgagtatgtagggaccgagtggaatcagtttgaccaagtgcattcacagtgaaccgtaaacctaacactaggcttctccggcggcggcgggatttggaggcggcgtcggcggcgtcagcgatggcatcgggctttggcggcagtgtcggcggcagcggcgggctttggcggcaatggcggggagaggcagcccgattcgttcgacgggctcgagcggttgtagctttcagcgcacacgggccgcagcgtcgtcggcaccatggttgagatgtgcttgcggcaaagccgctgcagtgaacaaatccaacacctcgaggaatctagggcggcggtggattcagtgtgggaaagaggtaaaccccattgtttttcattttcttttgttgaaattcctttcttttttgtttcgttttcttgattgatgccattgatttgagatgtgttgtgcagccaaagtgttgctcgttgtgaatatgggaggatctgttgaacgaatatgtggaggaaatggttgcttattcccatgctggtgaggacgatggtcaaagagacatgttgcgacagcttgcagaagagcataaggaagagaggtcgaggatgcagggtttggttgaggcaaaccataggcagatgcaatccatatatcagcagctgaatgattctaagaaaaagtgtgagcagctaaagaagatgttgaaagaagagaagtgtagtcgtagtagacaactttatgtgatgttgttcttgttggccataattatgtatttctatgtatgttctgtaaattttgtggccatatttggtacaagtaggtaaatcagtgccattttgtgtaatgttaatcactgtctataaattatgtggattcaatttctgagtaatgacataggtgtgttaattatatggatttaatttcccactctgggtgctctgttaaggataagtctggcagctcaaggtacaagctgatattgtgtgtttgcagcaagagctaactgctgactcctgcactaaaactatgctaatatatgttcacttggtgtaaaaaaaaaaggaaggtataggacattgaaatatcttttggtgtgaagtatataaagaactgaaagttctgtgtttttatttcctctttgaaaagactgcccatcattgagacaaatgaaaaagaagtacaggaaaatgagttcacaggaaatttgtgcattcagatggtattagttgagatgatcagcaacaaatatttcacatggtataagttgagatgatcagcaacaaatatttcacatggcatgtgttcaaatgatcagcaatatttcacaatatggactgcatgttcacaggtttggactaatttcagcatactgcatgttcacatgttgcacacagtgcatatcacagtgccaggcaacataggcctcaaaatacaggttcaagacagtggcaggtaacatgaaggcctcaaaatacaatatagagtgcatatcactacagcaagtcaggaaggcctcaaaatacaatatatagtgcatatcacagtggcatgttagcaaggcctcaaaacacacaaacttcaggattgtaaatattgtgacaggcttctaacaactttagctgggccttctgaggcagctcgagcatccttcttcttctggggtgtcttctttttcttgggcgtcttctttttcttgggtgtcttcttcttcttagcaggccttgatgaactttcatcttgagttttcttcctgcaaacagtgatatggatatgttagttagcaaatgcaacatatgtaaaagaattcaaaataaatagtcaaccatgcagcatattacctcttcttggggaaagcagtaggcacttcatcagtgtcttctggtgcttcagcctctttgcaagtcttggcaaagtgcccaaaaccatggcatctcctgcatcgcacccttcttgcccctggttcaagtgcacccctgatcctagtgactctaggcctccctgcacccctcttgagtctaggtggacagactttgaagcctaaattcaccacaggccattgtgatttgtctggcatagttggcactctccctgcataagctgctctgaacatgccaacagaaaagtactctaaaacaaatctttaatctcaactcctctgttggaacatatccatgccaaggcatgattgcaaggttttcctgaaacctgcctctttctgcatgaacatgtttggttgatcaaatgcacagtgtgccttctggtattgttgtcactctcaaccaatgtgatctcagccatgtcatcatcactcctagcaacctttacaactttcaggttggttgttgctgcattgagctgtttaatcacactgggcaggattccatcagtcaacttctcaccaacttgtctcctcaaatacatcttctccatgaataactctctaggagaatcaactagctcatggagatgtagacccttcagagatttaatctgattattgaaactttcagatgcattgttggtcaagtaatcacacttgcaagtttccttgaaaccagacctataccatatccttgaatgatgtttgtctaggtaatcaatggcttcaggaaataaattataaatctgctgcatatgatctctaaaaccatcctctgtgaagcatcttgcagcaggatacaagtgcagtgtgaaaataggacccctaaacttcttcataaaattaccataaaggtgtctcatgcactccctatgttcagctttctcaaatacagcacctacagctttctctagccctttgcatgcatctgttgatatgactaacccttcaggagcacctatagctccatgcaactgtttcataaaccacaaccagttgtcatctgtctctgagtcaaaaattgcaaatgcaacataaaacaaccaattgtgtccatcaacagatgtggctgaggctagctgaccagtgtatttaccagttagtctagttgaatctacacctatatatggcctacaaccattaacaaatccatctacacatgctttgaaagcaataaacatccttttgaaacacatat

SEQ ID NO: 59230 - DNA, 1979 bp, Oryza sativa
gttcttaagtgtagatattctgttcttgtttttgttgtagcaccaataaacatctctaaccaattgcactttagtgcttgattcccacaatccaggttcccacaccaaatcttcatacctgtaccgttgttccatatcaacttggatacagtgctaaaaaaaatacttacactacttctgtaagggagtgttacttactttactgattctttcccgagctcttctgaaagatggctcaattctatgtgcagcttgaggtctttatggagctttttaagaaattgtcccaaaccattccagttcgcagttttaacgtcatcaacagttggtactcctaaaaaaacacttcaagattattcacaagttgggctgctaaagtatgttacacaaattcacttgtgaataactgataactttcataacactccatgttttgtgacaaatctaatgcaaaactccatttctgtactttgttgaaaggaaatcttagattttagggcaaaatatttcagtttttttttggaatataggcaaaacccaactcatttcattgataaataagagtataaacagttaaacaccaaactcaaaagaataggggaaacactgaacaaaacattttagattaatcctggttcacatgcattcaatgtcttggcatatacctgtgctagaaactttgcccttggctctccggttctttctcacattgcccgttggtgaaatttccatcttgatgtcagttaataggacatgataatcccccttagccttcgactgataaaagattttactttcatccaaatccagtgccttcaatggaattttctcctcgtcatacagcacattgatatatctgactgccatacaaatctctctgcaaaaagataaaaacattatctaattttataactcaaagagcaggcaacaacccaaattttaattatgtgtccattaaatacttgcatgtttaaaagctcatgatatgttcaagcaaattaactcattcacctgcatggtcttgacatgtttgatactcctatttgcatattcttggcacttttgactaaaattttcttccataaatgcttggcactatactattcctaatgcactttctcattttaccattctggttgtctagagaataatctgtccatcctgggtgccaaacatttattcaactcaaaatttaaactcatgctaatggctgccaaatgttgcatctagatctgtcgctattaccagaggttgttacaagggatattttgggcattcacttatcaagaagatcaagcttaattatatgtgcactggtcagaagtgccaagtaaatgcaaaagaagcaagtattgtcgtaatctatacacattcatcaattgcagtcagaagggaaggaaagaaaattggggaaagaaacaggcctgcatgtatgagtagagtcatgcatggctaaaaatataaatcaagctaactgaatcagacatgaatgcagattcctgttatgcaaacactacttgtttctaatgaatatatgtgtttctatagtgtctcaacaatcaacatgcctttgttatgtgaatggctcagatggttattttctattgattaatgtcataatttctagctattttcaattaatacagtaatttctagtcaatagtattaatacgggggcttcttgtcacaccctaattccaaaatccacgttagctgagctcttcgaggagcgggcccacatacacaacaccttacttacactttcgtgcttgcttcatgtaaaaagactgaccagcaggtgctatggttggagagccaatgcttataagttgaccctcatccagctaaatttctaatgtggacggtacaaaccccatcaactacagcttggcacacatggcctcaattacatcacaaagaacagggcagtaaacccaccaactacaactacaccttaagccacattagcctcaatttgt

SEQ ID NO: 59231 - DNA, 1234 bp, Oryza sativa
tttggagagccaaatgcttataagttgaccctcatccagctaaatttctaatgtggacggtacaaaccccatcaactacagcttggcacacatggcctcaattagatcacaaagaacagggcagtaaaccctccaactcaacctacaccttaagccacattagcttcaattgtactaacaagctgctaacagctggagtgttaatctccacactagcctccaagtactataaaagttcataattttgtacttggaaaacaattcagtattgatacatgatacttacctaaagatcctgcaaccttggtcactgaaaccaaatgtataagattcagcatttgtagcatcttccacatcaaataaagcttcttttggaattgaagtcacaactccatcagagcaagggaaaacaataaatgccaggttcgtctccatttcttcccagactcccataggctgtatgatgtttctgtgagagcaatttcgaaggatttcataaagagtatgggcgtgttctgatcttcgtcgtactgctagacatttctcttgttgaccctctgaatataacaacatagcattatatgccacgctgccaggaattttgatagcataaacagtcaagtttctgactcggctttgtatctcaatctgcacaaattaaaatcttaattaggatttaagcttttatcttactattttatttgcattaaataatttaaaggttgcatatatgttagattcaccttagagtttccaggaactataactggatagctgaaaacaaaacattgattttgtaagataatttccattacagtaagaaagtactttagtaaggatgataatatccttaattagtaaagggagagaaataactaacaatgaatcatccgaagttaaattagccacagatagcttgttcactttcttttctgtagccattggtaactctgcagttgattaacttgatgtcagactacatatgtggaacaaattagaacacactaagtgtgggcaacacatagatataaatttgagacaaaaatggcatgttatcaagaggtagtgtttgattaactcgatgtgagaaatgctcagtgaaacataaagtgatataagctcaggtagctaagttggagtggttattccagcactatcagttccattaatcaaaagcattgagaaataaatacacaacaatagtgttaatgaattatgctaaattgaccaaaat

SEQ ID NO: 59232 - DNA, 11508 bp, Oryza sativa
ccatttctgggataagttttttcagggctctatttgcgaaataagtttttcaaaaggaccaaaatgtgaaaaatccaggttataagactttctagtatagtccacgttaatatagatgttaataaatctaaacacatatataaatatctagatttattaacttctatataaatgtggactatgctagaaagtcttgtaacctgaaacggaggaagtataagttaatttattggtttatatgcttaaacttaagtataatggtggagtcgtactttcactcacatcaacgttctctaatgtataagtcaatttgttgatttatatgcttacttaagtttaatggtggagtcgtactttcacttcatcacttcacaacaacgttctttaacaattcatgaccccgaacactgacaaaatcgtggtgttcctacccttcttctagttcagcctcgccttgcccaccgacgatttcctccaatatctgcttcacttctatgatatcaacatccatcatctcaaccccaactctatcctccaaattgctatcttcattcatctatgtgaggcgtactgcggcatacccccacactttgcgttcttccattatctctaccaactcaagccgcagcaggagaagaagaatcccatggtggtttgatgcagggagtagcatccagatccggtccgaccagaagccggagttctttgatctcccactcagatccaacaacaagggctagcgctccaagtagttttattgctccaacctgctgcccggtctgcccccttacatcggtcatgaaaccgagtagcttactcgacggtacgccgaaggtacacttgtcggggttgagtttcgtcttgaaggcgcaaaagctgttgaaggtttcttccaagtcggtgatgaggtcttctttcattcgggtcttgatgacggcgtcgtctacataggcctccacgttgcgtgagttggttgtgtaggcacctctgcattgttcgttggtattatgactctgacgttcttgagcccgaagggcatggtgatgtagctgtaggcgccgaattgagtgatgaatgaggtcttgaggcagttgtcttctttaagggcaatttgatgacagcccgagtagacgtcgaggaaggagaggagcttgcagccagctgtggagtcgactacctagtcgatgcggggtagacaatattcctgatattagaaatcatctctctgctagatctagtgagccccataaacaatattgccgatattagaaatcgacaattggcgcatcaggtaggggccgctcgatcatttttctttaggaggagatggcaacccgtggagtcacctgcgcgacaaccgccacattttttgccaccaccctcattgcgctaggttccttcatgttgtcaccaacgacgtcggcaaactggtccagatgacccccggtgtgatcggatgcacccaagcactccgctttcctgcaggtgcggcatttcgcttcgactcctcaagcccgcatcatcatgcgtcctgccgtagatcacgccacctcagctaccctttggcatcagcaacttcatcaccatcattgccaaaaccgtcgccgccaagatccccgttaaggacagcagggaaggcgcaccacttccacatctacctcgtgaactcaagtcccgctaggttgggttcctcgacgaattcgtgcgcctcttcacgagaactcttcatgagttcgggccccgctaggttgggttcctcgacgagttccgggagcatcccgacgtcacaccgcccttcacaagacatcttcgttgtgatcctcctggaaacgaaggccgagaagcaggagcgtgaagaggaggaacgccgcatcaagtaacaacaggaagatcttagctggcacatagaagaactgcgccagcgcggccgtttccaaaaaccgtttccaaaaccatttagggagtcaatttgcattggttttaaagttaggggagatgttatatccggttttgttgtttatagggatgtgattcaacaaggcacatgaggtatgcaaatagactaaggctgtgtttgctggccatggtggggaaccttaccctcccacacggaaaacggaatgatccgttagcgcatgattaattaagtattagctattttttttaaaaatggattaatttgatttttttaagcaattttcgtatagaaattttttttacaaaaaaacatactatttagcagtttcaaaagcgtacatgcggaaaaggagaggggttgggaaaaggggcatccgatcacaccctaattcctttctcgtgttcgttcgcttgccgttatgccacgcgtacgagtcccgtgacgtgctggcccgctacatgccggccatggtgcggctgggctgggccttggacagtaaggtggccttgcgtgaaaagatgtggcccccataatggcccaattaccttctccccaccgcggagggattcacgtcatcgtcttcgagacttcgactctcgactctcccggcgacggcgacggcgccgccgccgccgccgccgcgtacgagtcccgtgacgtgctgagcccccccctccggctcgatcggctctcttccccgacccgatccacagggggagtccggcgtgagagagggggaaacccggacgcgacccggcctcgccgccaatcgtggccaggaattagggttgggtccgtgtcgggctcgggactcctgccgtgccgctgtctgacaagtgacaaccccaacaccgtcccggctgcggtctcctatcctcccctctccctctaaaacatgcctcgcaagaagccaacttcgctttcgccgggaacatcccggtttcctccaagccctggaatctacaagtttcgaccggctatcctttgggactccgcgaggcacaacagattcagcgcacgcaacagattcagcgtactagaagccatcagcgacgaggacgacgattcgttgacggagcgagactccaccacttcagacagctgtggcgaggacaattcgcggaaagacccaccgctggtttgccattacttcttctctgcatcaacttatttatctaggatttacaaattgtttgtggatgtggccttattgtgtgattttagtgaatgaattgctagcttgtgataatagtaatgttcttttttttttccttttccttatgccagaattctctacttcttttggtggcatatcatcaattttaatataatgaataataaataatatggatgttttcaattgtcacagatggaggatggagagattgtgaatcccttggtgaggacattgctcgagctgttcagcgaggaacaaatttctgaaatcccactcatggaaacatatattcgcagatgtgtaagtaacaagttttatgctagattgtgatgggtaatggaatcttctaaatcttgttccacaaccgtgatggaaacatatattcaatcttcaaaacctgtgatgttgtttaattatttttttagtttttaagctggtagatatatttaaacttgcacattgacatgttatatccatgtatggatttcatctttaatgtattatgtttgttatgttatccatgtatgactttcatctctaatgtatgtaatgtattatgtttgttctccagggtatcagtgaaggaatgggatctcatcttattgaagagaataactttctctttggagctttcacttctatagtggcttgtccatggtacttgacaatgacatcatttttttctttcataacatggttttaagtttgctaaatattatattttgtcacaggattaaaaaagatacaatactgctttccagcatacttctccgtttatcagaaatatggaaccaatcagaatgggtgacaaatctattggacttttttgaagatgctcagttcaggacatctgtgtacaatgttgttgcatttttcgaggatcagctcacaatgtccacgacagaaaattctaatggaatcgaccataaggagaaattaagctattcaactttgtttgcccttcttccactgttacttcccttactcttaaaggttaaaaaaactaaataccatacttttctaaaattgagattatagcataccggaagaatttagttatttgtagtaatttcatatttattacaactgttcttttttttttgcagcttcttcagtatgtgcattcactttggacggatgaagttgcttctaacgtatcagaaaaacttgaaggagctaaatttattatacaagctgagaagccatttggtattattgaagaaactactgaaatgctagatatgaatgaggaagagttgctggaaaatgagataaggaagtggctaaaaaagatccgccaaactgggtatgttttttgctagcaatattcactgtttatagcattcttaatgagtaggttcaataaatatcatgctgggctatttaatgttaccactttaaaactctagtctgaatgcatattacttggcaatagatccacaaaatctaaagtgaagcttcacttttgattctaatatataataatagtttaaggttacattaagatgtgatgggaagaagtaatatccctttccaatatattttggaagttatagcttcatttgaacattgtgctataatatcggttcagcgaaaacttctatgatttttaaagtaaagagatgttttgcttgtctatgttatgtttattttttttaatttttttgtgtttacataaatattaattttattatattctgtaggtataatgtcataggtatgtgtgtgtgtcttgagggagcattttataaacttttggacaacatttctgtttgtggtgccttactgaaggacctagaagtaatggagttccgtcatttgactatgcttattaaacatacaattgttccgttggtgaaaaattgtcctgctgaactttggccgaagtggatagatatgattttacagccagtgtttcactactgtgatgatacattagatggttcatggtgcagttttttgtacaaggaaacaatgctcgttcctgataaattctgtcatatttctttcacggaagaaaagattgaggaattaggaaaggatcatctttttgaggtgactcgtgaaatatcatatatgcttgctgtaatggcactgcctgaattaaatggtggaatagcaaatgagcatcaatctattgtcagcatagtagaaacatctgcagatttggaatctacttgttcaagctcccttgttgggtaagatggtttaacagtagcttataattatatattttgagatgttatgtagttattctgttgtattttggaagttaaaagacaatgaaattgtttattttgcaggtatctcttataccatgatgatcttagaccttcaatactaaggctaatcaataatattattggctattggaaagatagtgaagcaaggattaaagttgtgtcattttgtcatatgctgatccaacttgctatttctacgcacaatgataaacttatatcttttgttcaagataatttaattccaatggttgtccgatgcttaatatttgagccaatatcaaacaataatgatcttcttcttctttgtgaagatgcataccgctgcatacaaagagaggtaattcattagcttcttgtagtccctccattttggcaggtgccattattcgttatcttggttgatacatgagaattctgtgcttattttatgagcaatgctatataaatataattattattagtattgtgcaatattttgactgctccgattggcacaatggtttttcccttttcttttttggacaaaaatgaacccttttattggactcaagtatttgtttatttcaggaatcagtaagtgaaggtcaacatgatggaaatagtgcagaaatatttgaaaactggttgtcaaagcaaatgatagtggctcattatgaacactcacctcctgatgaactcgaagactttgtgtgcatctgggaggtattttgcctcttttttttttttttttttggggggggggggtctatgttaatccttgtgattttaattttgtatgaaatgttttccttacttgaacaatatttttccccctcaaatcagattgaagaagaatttactgcttatcttcacacctatactgaaatgttgcataaagtggatggaatcggtgatacaatagaggtaaattatttatttatccactcccccataaaaaaaaaattctttcaagtgaagaaatgaaaaagtgagttgcatttataatgttggtgcagtggcagatgtggaatttcagttgggaaattaacagttgttgctacgcaatgctttaaatcacttccagcctattttcttttcttaatatttaagcgactgtttcccacaaaatttgaaaataaactaatgatatccgcgttataaatttatgtacatgtttctttggcacacgagaaatcttaaacttgcgtatgtctgatgtaactatatatttcttatttttgggagggagaattgaagtctgtttacctgtttgcaggatgtttatcttaggtgtcctatcccatttgtgtccaagcatgacaataattgttgtccaatttctaattcatgggccatgtcatctatgctgtcagtaagtatattgatgtacttgcaagtatatctgtgggctgcatactgattatttattttggctctttctgaagcgtaaaataacttcaatgtattgcaagagagagactgaacaaaaattcaagtttctttgtaaacttatcacatttaaaccctacattaaggtatgtgtattatccattatccttagcaaattaagatggtactacacctagcagaaacaccataatgtatacgtatttggacattttacagtgttctggttatgatgagagtgtgcaagagcttgtggatgacgattcagaggtttggtctgcacttcctggatgttgtaggcaggagacacttgaggtaggcattttgtcatgtatgtgctaatgcttaaatgcactctgttgaatattggccaaattactctccgctttcagctcttttgtagaatattagatccctgggagcctcaattccatcctctgatacgtgaggtaatgatgaaaatttacatgttctctttctatttattcttgagtttatcaaattaaatgtgtcttcattgtgtaggatgacaaggaaatgctacgtgaaatagcttacctattaacttcccgggaagatattcattgtgtgcaggtatctttacctttgagtttttacgttctcaggaacatattcattttgtgcaggtatgctttacctttgagttctcatgctcttgagtacttaatgaaactagtgttcttctctgcagtccttccagcctgtctccagcgactttttgctgcatttacaaccttatgcccagaattatattgaggtcaagaacgcaagttctggggtatgctatacaatcatactaatactaatgtcaagcatatttgtgcttttcatcagaaaataaacaattctgcttagatgctattcactgtatatgttgttatcctactagcttgtagctcatgggtatattttttttttgttgttgccggcttctctagaagcattaagatgatcatagcagtggtagcttcaatgttatttgctggcagatagtttgtagttaataattaaaaatcaccatatatgaccatctgctcaagtaccatgttcggttattggttactcccccagtatgacagggtaaaagaacaaataaggttgcatgaagcatttgatacacatttggcctctggtgcattggatgatcatgttcgtcagattagttcttcaaaggtaggaaatatattatgaacttattgtgcgtacaaaaacagggctaccacattttgctcaactgcttattaattgttgtacctatggttctcaggataatttcgtgaagattatgcttgatgatgatactttgcatagtcagtttatagatctggattatgatctcctgaaattgtcacatgaggtgctattttcctgacatattttccttattcacaaattatttcctaagtattttcatgataactttgtgcccttttacagcgacgagctaaacttcttagtaaacaagatcaattatgcttatattacaaacacatgaaatgtgctgtcgtaaatttgcaggtatgtgatctatatgtcctgcttgtccttaatgttcactaaagttacctcaaagttttttttcccctcaaattactagcattcttgttgttacttaatcacggagtgaagttaatttgttaatttgtatcgctctatgtatttaacatgctatagcatcctatctatatgtttcattctcattttttttacttgatactgcaatatcacatgactatgtcgaaagctaaaagctgttccaaatgagttaccagctatatcatttgccaagtaggctatgcatttcacttttgctaacaaaagagtcaatgtaaaatttgtggttgccattttccatatagtttttgaaccaagattcaaggatctagtggatagtttggcatatttttgtttatttttttatttgtacgatgttttctatttttttaattattttggtgtaataacgaaacaaattgtctgttgatgcccattgcttccaggtttaacacttgaaaaacgtgttgaagccaacatgcattaatttatgaagtgacaactatatgagcttggatatggtttcttagctaattgtgattgtataaattttcagcatagagatagacttgaaagtttgatatgtgagctcgagtcagaaggtttcttccgtgtggatgatgattctattgaatgggtacttatggcactaatagtgttttacttttgctttatagtgcatgcaaaatcaataagcgctttatctaattctatgttttattttttatatgcttgcatttgtaggaaaaggaacacttttcagaacttgtggacgaattcaatgagcatatttttgctgggattcaccttccaaaatattatgttattcgtggagttatggtctgatcttttctcatgcctcaccatcgtttgtctgttaactaaaatagtgaaacctgattcaatgtgttaaatatcaggattatcgggaaatgttacatatgaaggatagcacttgggatgatgctttcacagtggtaggatatgccatctctttgaattggtggattttccttgtgaaacaagtccatattatcatttattggtccatattatcatttattggtttgtttcaggttgttggtggagcattctgtagatggatggaagatcgtgatctggtattgaaatatgctcacaatttgcctattggttctattgtatttctttatattttattcatgttcgttcattttgttagttttggatggagacaagatactataggcatcgttactatgacatcattcaagagccagtaaaaatggtattgacccatattacctccatcttctttcttgctccagagaacctggagacaccattctaaatactggcaggttttggtcaatataattgctttgtcaatgaacttattttcatgctaaggaaacatccaaattctagaaaaaatgaaaacattcaaaaagttaaacgaaactaagaaatcatgcagcatggtctaccaggaaacaaggcacatatagtttcctagtcagttctcatattttattttaattcatctaaaatttttatccttgctcagattcctactagctactccctacattcccaaatataaagcatttctagattcaaaatttgtatgtaatataagcatttcccacacttcaattcctgctaaacaatctagaaatgcttatatttgggaacggactcctcactgttcagaaatgctgccaatgaaaatgtcctactagtttctattcacatatagatgctataatattactctgcagcaagtcatacatagtgtttcatacctttgttgggctagatgttaggcagagagtgatctggtattgaaatgtgcctttgctgtgcaaatccttcctgcttgactacttgttgacctttaatttagaggcaatctagcttaaatacgtactactacatgtgtatcctaagttcctaacatcacgtcacattgttttctattagatatggaggactacaggtgatgagaatgagatgacagttggacacactacaaggtagtttgtgttttattactttccttctttattattgttactattgtataataataaagactaccgatccatctgtaagaagttgccaatttccatgtacatcttgattcaggttctgcccttttctattgatctaaccaaacaatctactatatagacatgacatatttgtatgcaaagtcttcaatttatttatattataatttcccgtcgtttgttttcgtgtcgtagcaggattatagatggcaacggagaattcaccgccggaatgaactagacttggctcaagactgctgcaacacgaaatcaaggagtacctgtctgtcaatcttctaggactctagggcgacaatagtaggcatacaaagttatcaaccaaacctccatggttccagtctcgcacaccaagttttgtgatcacctggaattaagcagagctggatgcttttgattaatcaagtccacctgtaccacaaacacacttgcacatgtgtatatatcctaattttcatcatgttaccaggctacattttgacatatacagacacacccacaacgtgcaaaaaagttcaagcaacagacattgccatgatgttttctcttacttctttcgtttttagggtttgcttggactttgccatcacagaaaaatactcactctattcatttataaatggcaccagacactactcatatttaaatttgaactccttgtttttttccaaaaaaataaatcataaacgctaaaaataatgctatattattgaaatgtgttacatcctaaatataagcattaagcttttgcttatcttacgataactatttaaaaactatttctggtctaagtttaaaaagtgttggtcaattgtgccatctataaatggatggagtatttaatattttttagacaaatggtccaacagcctggcttttgtactacatttttacagcggttgtttgatagggtgctaaacttcatattttgggtgactgagactatattttttgcaattttctattaaaaaggtattatttctaaataaatcctcaaagttaaccgacagttctaaatatcctatttcgatccaactgcaatgaatatgcagggtgaggtcttaccagctctacaggtcacaggccatgaatattactggaattataattcatcccagctattccttcatgtcagtagat

SEQ ID NO: 59233 - DNA, 643 bp, Oryza sativa
agtttgaagggggggggggggggtagaaaaaatagccttccaagcagatattacaaatctatcttctggcttcaaaatatctgcccaaagggcagcctcgcttacacagcattgcaggcatgattggagcgacggctccatccctctgaatacaacatcatgtcggtgattccagattgcccagaaacatagcaggtaaaacactttgaaatgtagctccggcatcgcttgggttgtctttattcgatgcaattgcgccacatcctgaactgaaggaagcactgcaattttgtgccagaaacttgtcgcaaatgtgcaagagaagaagagatgtgaacccgtttctggcccgctattacagatgctgcaagtgtctgattgaacaatcttcttcttcaggagattgtgctttgtggataggcgatctctggcaagaagccaagcaaacagtttaactttcataggcgctttgcaatcccaaatccaaatccagttcggagaagctgttccaggaggcagcctggcttgatagatctccttagatgtcaagtttgtccccaggcttttcgaatttcttcgaatgtccagttcatcagtacgagtaaaatgctgaagtagttcctctagttcaatcaattgaagt

SEQ ID NO: 59234 - DNA, 682 bp, Oryza sativa
ttccgtcacatcgttccaattttcaattttagagtggaacgggttgtgtttagttcacactgaaatttagaagtttggttgaaattggtacgatgtgatagaaaagttgtgtgtgtatgaaagattcgatctgatggaaagttggaagtttgaaaaaaaaaactttggaactaaaaacagggccaaacagtcataatgtgcagcttgtcctgtcactagtgcgcagttaattcatctggacaaattgctctccatttcgctcagatccccaccaagacacgcacaaaaacacggagcacctgcaatacaagaaggaccaggagttttgcgagagaaggatccaaggcacggacattggacagtggacaggccgaaggaccacagaaacgtgccggtttccacctgcgccaacgaaccaaggccattaactcccctacccaccggccaccgccacacgccgccgccgccgcccgacggccaacctgagctacctggtatatccaccggacggaaagccttccagattaatttcaggtctcatttggaacgaacggaatttacataaagggattaaactgatcccatacaaatatgagtgaatagcaagccagcttggctcgtttgaacttgttaccttaacgaatcacggctcgttaatcttaacaggctaaaaatcctagct

SEQ ID NO: 59235 - DNA, 664 bp, Oryza sativa
agatacagatcaacaaaccaaatacttatggcctgttcactttgataaaaaaaaaccttaccaaattttggtattatcaaaattttaacatagttgtcaaaattttgacaacttaccaaaattttggcaggatttcttatatagttgccaaaatttagcagcaaactaaatgtaactattttttttggcaactttatcaaaatttagtaaggttgaaaatggcatcaaagtgaacagtcccttatttaagcattttaaaccttacaagtatgctttatatgattatattgttagttagcacttgccaatatcaaacgagaagtacatccgcacaatttcatgctgatgatatcatgccttctctgatcctacttcgacaggatccacattaaccgtccataaagggtttaagggctttactccgtactccattttcttgagagtgcttggaagttggaaccccctcagcaaatcgcacggaccctcggaaacatgctgaaatttaaaccgtgtggctaatcaaaatcaccagtaaacctgaccaaccctagctatcaactggttatttttttctattacacgaaagacacttacatagtacatactcccttcgtcccacgaaaaattaatctagaatagaatgtgatatatcttaggataatgt

SEQ ID NO: 59236 - DNA, 684 bp, Oryza sativa
tttactgaagtttaatcaatcggcatgcagtaacaacacatgactccatctgcagcagtcgctctctcaaactgtcaaacagccaaccaattcaaaccaagccaagcaggccaacgaaacgcaacgcatgcgcgcgcgcgcgtgcccaataaatggcgggaagcgccgcacaccagccatcgccgtcgtcccgcgcgcgtccggccggccgtccgtccacccattccatcctccgcctgcaatgcagctagtagctagctagccaccgatcggtcgagagagaggtaggtgccggttggtcggtttcgcgctcgatcatatcgacgcattacataattctgcagttggtgacgggtcaaactgctggcccgatcgagcatcatgcactgcattgcaattggctctcgagctctctcgtcttgtagggtttgtagttgccgttgccgcccccttgcaggtggatggatgcatgtttgctgagctgcagaaaacgagagcagaagaatcatggcgattgatgactgcacaacaaccagagagaaacactactcacaaccgcacacacacgtacgggagaagagaagagagtatatatattgctacattagcatccacttgctatgaagatggctgagtgctcgcggacggcaagtactgcacaatgcaggcagatatacagttgga

SEQ ID NO: 59237 - DNA, 560 bp, Oryza sativa
attaccttggcgatggttgtttcggcacagttgcagggtggttttgagccatccccggtggcatgcttcatcgcagggtaaggcgaaagaccattgccagcaaggcgaaattcttgcataccccattttgtgcgctctgcggtccgtgaattcccaaagtaaaatgttagggtgcgcctcattcccaccagcatgcagtcgctgccacctccctggttgtagtagactggcttttctgagcctgccgacctccagaaccctttacttgtgatacggttgctacggcgactactagggcactttatctccttctgcataaagaagtacttccctttctccctctatgtcagtgctcctatgtccatgatcaccatcatggaacaagagagagaaaaagacaaaaacaaaaccaacaacaaatcggacattaggccatgcaatcaatcaagcctggtagacatagattaatcaattcgagatgtatctggatgtgctaacaatttttatgggagcaagatgatatggcagcataaagtaaaatatacttaccttggacgatg

SEQ ID NO: 59238 - DNA, 1869 bp, Oryza sativa
ccaaactttaggggctaaatgcaattttttgcagacggcgccgtcgagccgccgtctgctacgtcagcttgccgccctccattaggacggcagggtctatttttgtaattttttgcgccaatagattatttctgtaaatattaaaagaaaaaaaattaaaaatgaaaaaaattctatcttcgtgagactcggccctctacctgcgttcagcttcgtcggcccaaattccaggcccattagcccagttgcatactccatgttgcaagttgcaacagttgtgtggggcacgagtcctcgtcacgtaacgttgttcctatcttatttccgcccgcaccccgccccacgcgagacgcgacggacaaaccgcttccccgccgcgatgtgccgatgatgcagcagacgagactagacgagacgaggcgggccaccactgagccgggacgcacccggtatctgggaaaaccaacgcgcgcggccacctgattcagcccgcaccacctgatgaccccctccccctcccttcaagtataaatcccacctccactccccaccagattctcatcaaacatagcaccaatcaccaatcacctatcagtagtacttcactgctcgctactagtcccctgaattcagcgatcagtataacagcgggaagctcaagaagagatcgtcgatcgatggcgggtgcagcgaaggcgtcgtggatggtggcgatgagcgtgggcgcggtggaggcgctcaaggaccaggcggggctctgccgctggaactacgcgctgcggtccatccaccgcgccgccaaggccaacgcgcgcgccggcgtctcgcggggcaagaagctgcctgcctccgcggcggcggtggcggagaggaggagagcggagaaggccgaggaagggttgaggacggtcatgtacatcagctgctggagtaccaattagtatagctgtgccttctactcttctactactagctttgctataggagtcaggttggaacttggaagtggcaaccatggctgagacttgccggttgcttgttaatttcctccgggttgtatataccacgatgatgatgatgaaaacttctgttacttgagtatacttgatgtctcgatgtctcatgggttatcaatgcttttgccttgagagattttgacaggcatttttcatggttgtacatgatttggattttgacggggaagaaccactagtatttatcttgacaaaaatgatacgacagtatgaaccctgcactttgattacaacaataaacatccacgttgaaagttgaattgctgatgagatcatgatcagagatcagtcatcaggttgtcaatacattaccacgcacgaaaatcaggcagtggcgccatcaatttatccagtcctatgaatactcctatctgaataattccttcttgtttccttcgttataccactcaaccaatcctaatttctgccattcttttttttaccaaattaaactgatgtagcaaaatcacaatacagtttctttcccagtttgtgctaaacgatattgagtcggaggaattggatcagagtcatcagactggtgcggaaaagcacaggtgtcttctgtctattgcatacccagaatgcaatgcatcaataaattaagctggaacgagaagtattatgcaattattaagcccctgacatcttggaaaaccatgtgctccagcctctggtttcccctgtccagcagcctcccacaactccgctctcaccatcacccgaagaaaacgtcgtcgggcgatgcgagttggtgcgtgaaaagaaatgctcacttgtttactcgctcaccaaagaatgcaagtacaggatccagaatcatattatactccct

SEQ ID NO: 59239 - DNA, 24201 bp, Oryza sativa
cggcggcagcggttggagcttcggctccagcggccggaggtgggagacgaccgacaggtggggcccacctgtcggcgtcccgagagaggagggaggggcggcttgggccggcccacaaggaggaggggccgcgggagagggatgggccgacggcccaacaaagaaaaaggagggaaaagaaaagaaaaagagaaaaaggattttcctgggattaaaatattgcgcttgctcatttttaattggttaaaattatttccaaggctctgaaaattccactataaatcctgttaatatattgtgacatgtggaacccaagaaaaatcccacaatgccaattccgattattatttgcatttattaattagggaattagctctaggttaattaagataatttcttcggacgatttatttagccaatttttaaagcaagcaaaggggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcaagctggtaagcaacttcacccctgcgttccaaaatccgatatggtcccacaaagcgtggtgccaactttcctttggtttggaagcggtgtactcccctgagcggagtgacacggagatacacataatcccctacttggaaaacgagctcccttcggcggttgtctgcatagcttttctgccgagattgcgcgattctcaatctttccctaacagctctgactttctcttctgcctcatttaaaacttctgtaccaaacaactggcgttcccctgtctgatcccagaagagcggagtacgacacctccgtccatacagtgcttcaaacggtgccatctgtagactagcttggtaactgttgttgtaagaaaactcagcatacggcaagcttttgtcccatgctccaccaaagtcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaactcagctatttcccttctcatgctgacccaccagaacttttctttgaggtcttggtacatcttagtactaccgggatgaatggaatattgagtttgatgagcctcggttagtatcaggtcttttaattccttgttttcgggtacacacaatctttctcccatccagattgttccttgttcatccttaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcatgttgaacctcacagcatagttcctctacccatgcgacgttgcagtaactcttcctgctcaaggcatctgctaccacattagccttgccgggatgatagtgtattcccatatcataatctttgattagctcaaaccatcttcgttgtcggagattcagatcaggttgggtgaagatgtactttagacttttgtgatctgtatatacctcacaacggttaccgatgagacagtgccgccagatctttaaagcatgaacgactgcggccaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcgttagtgagtccgaaagacataactgtgcattcgaacaacccgtaccgagtgatgaatgctgtctttggaatatcctcttcgcggatcctcaactggtgatagcctgaccgaaggtctatcttagagaacacagtagctcctttcagctgatcgaacagatcatcaatccttggcaaagggtacttgttcttaatagtgacctcattgagtgtgcggtagtccacgcacatcctcttggttttgtctttcttttccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccgaaaaaacctctggatactctctgaccatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacggacctgaacgaacttgggtccggcacgtcttggcttcgggcactttccaaccgtgtgtccgggtttgttacaattgaagcagagttcgggtttttctcccaacctcttgggctgttctggcagagctggctgaactgattgggctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccattgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacagaaacttctcctgcctctcggcatcggtacgcacgtcctcaggggcgtagcgcgcgaggcggttgaactcatgcaaatactctataactgttctggttccttgttgcagggaatggaactctctcttcttttgtgccacaattccctcgggaacctgtgctttattgaaactatgacgaaactctgtccaagtaacctctgccccagctggacgggtcaccatgtagttgtcccaccaaacagaagcgggaccttgcagctggtgtgtagcaaaagcaaccttctcttgctcgttgcattgcaaaaggttcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgcagctgtgcttgctgctgcacctgctgcatcacctgatggtactgttgctgcatctgttgcatcatcattgtcatcatctgagtctgattgtccaacacctgagcaattgttgggttctcgggcggtggggacagactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagagggctcagaaactaatcttgcttatgaatttaagtgcaattatcttaatcttgattaaaacactgaaaaagaggcacgcaactcctaattgaggcagtcataccactgacacataatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcaggatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctaattttttttttttaaaaaaaaaatccgatccgaaagaacgaccaagatttttcccgcaaaccaaagaggcaaaactccaaattttcccgaaacaattccaggtgcaaaaaggcatatgcagatgaaaaaggggttcagagggctcttagggtttccagttggcttgtcctacggtcaaggtcggctctgataccaacttgtcacgcccagaaattctcaaaccagaatttctaagctgaatgtgcattaaatccctgtccaggaccagccagggtacacaaacgacaattgttgacatacagatccacgtcttacaaaaatagaaaagattacaaatgcagcggaaaagaataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccacaggaggctagaggttcttttgcataaagctagcatttaaaagcagtagttgaaagcagtagaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcggtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaaccgccatgggtgcgaccagcaaaaccatgcacccacagcccaccattcagtgtattttaattaactcacaccattgcggtggcaccaatctaaagctatgccaatagacaaagtctatgtaataatgtgatccccatttgtgtactagttgaactaagcatggctaagcatttcctaaaccaacatctaatcattttgatacccaggttatcaatggcatatggtaaacaataaatggctgagtaataggacccatcccacatgatattgtaaaagaatgcaacatttaatagaaatgcgggatatttgtaaattgggtacaatatgatcaaacgtattgcatgacttgccttgctctcgaactgatgagacctcagcaacgtcttcgaggaactgcggatcgacgaaacggccgaaatctacgcgacaaacaaagcacacaagcaaaacaggctataagactactgaagcaggaaacaaaactatttttaatggattctttgcatttttcttgatttactgagacttgaatggacttaaacggagctcggatgaattacttatgaattttagaagataaactgtgtttttactaataaagaaaagtccttaatcaatttattgcgcaataaagccccagggctgacgtcatccaagggggggcggcgccgacatgcgggccccactggtcagcggcactacgagagggagagggggcggctggcaagcgggccccactggcagcggcacaaggggagagggaggggtggtccaccggctggtgggccccaccgggcagcggcacagggcgggagaggggcgtggctgttggcttggcacggctcaagccggccggccagccatggggcggcggcggcggcacgcgcggtcaccggcggtgaccggcagcgcgggagacggcggcggccggcgcgaaggcggcggcggcggccgaagacgacggcgcacgcgcggaggacggcggcgctcatgggagagagaggaaaggaaggaggagaggggattcctcaccttcgagcacggcggccggcgcgaaggaagaaagcggcggcggcgaccggtgatgcggaggcacggacgggcggcggcgacaccctaggagaagatggagaggcgttaggagaggagacgacgaccacggcggcttgaattgccggccggagatggaggggagggaaaaactcaccggctcgcgaggggagaggtgctccggtgggattccggcgacgcgaggcggcggccgggaaagctcttgcggcggcgaagctaacggcggcggcggtttggcgcggcggcgactctagcggcggcggctcgcggccgaaggcggcggcaagcggcggagctcgggtgtgacggcgtgggcgcggtagggggcgtgggagaggacggcaaatgggggaaacgagggaggggactcaggggagggtttttatgggcgagggaggggcggaaacggccggggatggcccctatttggccggcaacgtggagaggtggaggagagagagagggcgttggggatttcaaatcccccaccacttgcgggcgcgcgcgcgcgggagatgcggggagagggcggcgacgtgggcgcgaggtgcgggcgcggagtggaggcgcgacgtggacgcgggaggaacgaagaagacggcggcgcggcggtttcggcggcagcggttggagcttcggctccagcggccggaggtgggagacgactgacaggtggggcccacctgtcggcgtcccgagagaggagggaggggcggcttgggccggcccacaaggaggaggggccgcgggagagggatgggccgacggcccaacaaagaaaaaggagggaaaagaaaagaaaaagagaaaaaggattttcctgggattaaaatattgcgcttgctcatttttaattggttaaaattatttccaaggctctgaaaattccactataaatcctgttaatatattgtgacatgtggaacccaagaaaaatcccacaatgccaattccgattattatttgcatttattaattagggaattagctctaggttaattaagataatttcttcggacgatttatttagccaatttttaaagcaagcaaaggggggaaaacttcagggcgtgacaaccacaggcaatactagggaactaggacgaaaccttaatcttcacttcacttcaacttcaccttcagagctggcagaactatatatatatagagcaagggtgagtacttatgtactcagcaagccagggggacttagatggttaattcaagcttcaaggaaagtgtcggtgatatgggaccgggagtatcgtgaccagaggcttgaggcagacgcagtcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttacaccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatcccctttaaatataaaaggaggaccttgcccatagagaggggggttgattcttttggagattgagagcctagaacaggggagaagtcggctcacactttgtagctccttcatacacagatccaacaaaacacaggagtagggtattacgcttctcagcggcccgaacctgtatacatcgccggtgtctcgcgtttcttctggcgaggagacgatctttccacatacagagagagcttgagatctcaccctaagcccccggccgaaccggcaaaggggggcctgcgcggtctcccggtgaggagccacgagctccgtcatctggcgcgccaggtagggggctcagtgtgtgttttctgagctctcagactcttccgtgtgcgccaagtttttcttgttcagcctaatggccgagcaaggaaaagcgcacgatctctctccgagtgtgagcggcgacgacgtggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcgtcaaggcggagggcgcggcgagcggcggctgctgcgcgccattcggccgccactccctcgtcgacacctccaactcgggagggtcagcatggagagccggatgcccgcatcgacatcgagcgccggcgtaataaccggcgtactccccgcgcaacggagggcgcctcttcgtccagagtgtcacctcgacatggacgtgaggatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacctgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgttgagggcgctccgcgggccacccgaaaggggaggcctgcgagcgacaaaaagaaagaggctggtactcccatccgggagcgcccagccagcaagtggtgctccgtccacaacacctccctccacgatctcgcggattgtcgcgcagtcaaaaacttggctgagcgaacgaagaagtgggaggaggacaggaggcaggaacgccgtgagggcaagtccgcggcagttccctccggtaaacggcgaagtgaggccaaacagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcaccttcgaccagaccgaccacccaccgtgcattgcccggggagggcaggttgcgatggtagtttcccccaccatctgcaatgtgaagttgggtcgtgtcctcatagatggaggagcggctctcaacatcctttcccccgcggcctttgatgctatcaaggccccggggatggtgctccagccgtttcaaccgatcattggtgtgacgccggggcacacatggccgttaggtcacatcgacctaccggtcacctttggtggatcagccaacttccgcacggagcgggtgaacttcgatgtggcggacctcagtctgccctacaacgcggtcctagggaggcccgcgttggtgaagtttatggcggcggtccactacgcctacctccagatgaagatgccgggccccagtggccccatctctgtccgtggcgaccttaaagtcgcgctcgcctgcatggagcagcgcgcggaccacctcgctgctgcgaccaagcccgagggtggtgacgagaggcttggcgcctccgcccccaccgccccgaggcagcggattgccacatgcgacgaggtcccggtcaaggaggttgccttgggcgacggcccatccaagaccacacggatcggtggtcttctggatggcaaataggaagacgcgctcgtttccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttttagatgcatactctggttatcatcagattcgcatggctagggaggatgaggagaaaactgcgttcattacccccgtaggaacctattgttatacatcaatgcccttcgggttaaagaatgcaggtcctacttttcaacgagctactcgaatttctttgggtagtcaaataggacgtaatgttgaggcttatgtcgatgacttggttgtaaaaacgcgcaaccaagaaactttactttcagatctagcggaaacttttgagaacctccgctctgcccgcataaagctgaaccccgataagtgtgtgtttggtgtacctgcgggcaagcttctcgggttcttggtctctgcccgaggcattgaggccaaccccgagaagattcgagctatcgagcgggtgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccttgctactttacttagcggcgaccccccaagtagttagtgcagcgttggttgtggagcgcgatgaagacaatcctcatttcgtgcacccccattctgtgctaacttggcccgggagcgagcggggaggaggggcccccgagtcggacggtggcctacggcccctgacgactggagtcggccctctgcccgcttgtcagacggtgctaggtgcccccgacccccaggagggccccgaggccactgcgggaaggccgcacttaacgccctttgaccccgaggctaaccctgtgctgactcgacccgggaaagagcagggagaagaggcccccgagccgaacggaggccagaggcccctgacgaccggagttggccctttgcccgcttgtccgacgataccaggagcccccgaccctcaggacggccccgaggccactgagggaaggccgcccctttcatcctccgaccccgaggtcatcggcacagaagacaagtgcgccccgaaaggccacttgaacgaagaacgccccggggatacggcccctagcagagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacagggcgggtggtaaaatgggcaatcgagctttctgaattcgatctgcactttgaaccacgccacgctatcaagagccaggccctcgctgattttgtggcagaatggaccccggctccagagaccgtctcaatccccgaggccagcacgaactcctcgcagctgcctcacaccacccactgggtgatgcagttcgatggttctctgtccctccagggtgccggtgcgggggtcactttgacctccccgaccggagacgtccttagatatctggtccgccttgactttcgagcgaccaataatatggcagagtacgagggactccttgccggactcagggtggcagccggactggggatccgccgtctcctggtgttaggcgattcccagctggtcgttaaccaggtctgtaaggagtaccggtgctctgacccgcaaatggacgcctatgtacgccaagtgcggcgtatggagcgtcattttgacgggatagagcttcggcatgtgcccagacgggataacatgatagccgacgaactctcgcggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctacgtgttggtagaagggaccctctatcggcgcgcggctaacggaatcctcctgaagtgcattcctaaggaacaaggcgttgagcttcttgcggacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgcctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgaattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttaccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgtacggctggccacgggcgacggcactgagctgccaaacccgtggaacatcgaacaccttcgtcgcttctacccctgagggggggtcgggtgtcaggtttcgggctcgggctaaccccgcacccccctcgggtgtgcagggttagccgggggctatcacacatgcacagccttacttttcttatttcagcatttcaataaaagcagtttcaatttcctaaaggttgtgtctgtgccgtttttccttctgaagaatcttaacttgaaataaggtcactcgttctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaagatgcaaaaggaccacggcacaaatcatcctcaactcatatgcatagcaaaataaagttaacataagaaatttttcatcatttttgattgcagattaagttgatctatacaaaaagaagaaagaaaaagaaaaaattggagattggcgggggcctgggggctcattctgacgcgcccgggtcgccggcctcgttgccaccgtcgcttgcactgctggcgttcccctcctcgtcggagttgggggcgaacgcgagccgaggggccgagccctcgaagccgttgacgatgtggtcggcagcatccccgacccgcgcgcgcgcgtcgtcctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccagattggtggggggcaccgtcgtctggcctttccagaggcccgcttgccgaccggcgcgcttcaggcgggagaccgcatcccaaagcatgtcgggcccaatctcgcccgccaagcgaagggcctcggcctccccggtggaggagtccagcgctcgctgcatatcggcgacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcgtgcgccgccagcgtcgcctcccggagagtagcggcggcctcgcggcccgtcaagcctttctccacggcgccggcgtgttcttccagcgccatagcacgggcctcaagggactcctcgcgccgccgggacgccgcctcagtctctgttacccgccgctctcgggcagcggcggagtcaaggactccctgggcggcgtcaagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctaaacccatccagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgcgagcctccccggaggctgtcgcccgagggttgcccgaaggagtgggcccagttgacgcgccagcagcagctgttgcctcagcctggcgagcccgggcggcctcctccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctccgcggccgcaggatcttcggcctcggactggccggacttggggtggcgggaggaatgcgacgggacatcgctgaagcagaagaaaaaaccagaagacgaacaaaatgagtaagaaaaagcttccttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccaacttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattacgctcgccgaccgaagcggcgttaccgtatctccgggcgagaccaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcgtgaccagaggcttgaggcagacgcagtcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttacaccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgaaatataaaaggaggaccttgcccatagagaggggggttgattcttttggagattgagagcctagaacaggggagaagtcggctcacactttgtagctccttcatacacagatccaccaaaacacaggagtagggtattacgcttctcagcggcccgaacctgtatacatcgccggtgtctcgcgtttcttctggcgaggagacgatctttccacatacagagagagcttgagatctcaccctaagcccccggccgaaccggcaaaggggggcctgcgcggtctcccggtgaggagccacgagctccgtcagaaaggctgttattttagcaatcaaatttgttttcaagttttcaacaatctaagtgtgtgctttccacaaacagagcgagacaagtctcagcttggttgggggcgagacgtaaccaaatttgatttgcaagatttacacaactcccagagttggcctcaaagttggtttcccaaaccaaaccaattttccaatctttcagagttttggttgtctccaaacaaccagtcattctcagggactccctgtcccgctgtctccctgacatccgcttgctttatccaaacatcaggtttcccaaacctcaacatcttttcacaaagctgggtaaaacaaaaactacgctaaggaatcacctcacatccgcccatgaccgtgggcatggctgttcgaacagtttgttaacctctgcagagggggtacactttacctacatgacgttactagccttggtcacctagcccgtgcggatcaaacacgtctggtgacttggggctttcacgacaaggcatttccaaagccaacacagggttgccatatgccaacgagaggggtcccggaccaacaacaggttaggtcccagaccatactgtgccatgaagcccaggggtcctccccgacaccaccccggcgaatccacttgtctcttggcatcaaggcttccctggcctagcttgttactcagccaggggtgtcccattccacccatgtggtcgcacttgttatatgctcggatgtaattccaaaggaatcggtccttaaatgtgaccgcacaagcattccgcccaggaatggccttgtgtcgcgagttttatttttaaaactcattttctttcacaaggcaccgacccaggcgtcgggttttccaatcctttcgtaaaccaagttttacccaagatgtttctcagattttaagttttaaaggcgaccgtcgatactcgcacagagtgtatgaataccgaggcgcaaccaggtggttacaagggagcatgatatagcaattaacaatggaaggatcaaatgcaacaagttaggtaggcccaccaatctgcctcgcaggcggggcaaacatattaagtgcaatcctatcaatgaataatattttacaatcaatataattaagttcaaatataggctcaagatgttcaaaggtggcttgccttgctcagggtcttcacgaatcttcgagaaatccgcttgacgaaaaatatccggtaaccgcaactaggcgcatacaatcaaaaatctaaacaaggaccaaatagaaaaggatcctatttagactaaaataatagtgccattagatagatcacaattttacggaattactggaagtggaacgaggtcaatcggagtcacggatcgggagatatgaatttttggaggctttaaatgaatgtctggacaaggaaatgatttatttgattctttggagcggggaaaacaatttgtggaaattttgtggacaagggaggatatgtacttatccgatgggaataagagaaattatttacgaaggttgtttgaattttctgggaggaaggaaaatatttgtggaacaacggaaaaaggatttattgaattttctggattaaagaaatgatttattgaatttgtggaaaagaatattctttttagtcactcattgacgtgtggggccaacatatggtgagagaggagtgaatagggagggagcaattatggacttttggccactgtgtttggggaagggagtaaagatagactttccttgttttttaggccgaggaggaaggttggccaatgggccaagcccacgagcagggagagagaggagggggcggctgactgggcaccatggactgggtcaaacgccacatgggcagccacggtggcaaggcgagaggggaggaggaggcgcctggatcggacggctcacagcggcgcaacgccgccggcgagcggcggcaagccggaggggccggcaggcaccggaagcgagaggggctcaaggcggttccatccatcggctcggatgagggagaggcggcgcgatggcggccatgcggcggcgggatgggcggcacggcgcggacgcggccggcgaggcggccagccgtggcggcgtcccggggagattctctagggctcaagggggcgcgacgatacgaggggttcggtatgaggagaccgatggcggcgcatggccgagcgcggcgcaggcgtggcgagcggccgc

SEQ ID NO: 59240 - DNA, 8509 bp, Oryza sativa
tgcacctttgggtaagcctttactcaatagaaagggaggttgtggggattttgccactgcacctttacttcaataggtacaatctgacatacgctatatcagttttgtttggctccatatttaccaacatagggttttccatagtaagctcattctatgctttctggatatactacttgtcgcgatggttctcggccatgtcataggacatcacctcgtctaacttgtaattttagctgttgtaactattcatccaactttgtggcctcggttttcagttcgaggttcttgatacatgaacgtgcctgatcataatgaaaagtcccattgcaattgtacaaatatctcaattttaattaccatgtgttatttactttccagtaatacgttaccagaatcctccaatttcacatatacaaagaggtgtgtgccaattccatactggagtactcctatatttttaagtcacatactaagggtgtgtttagattccaaaataaattttggtcaaaaatgtcgcatcaaatatttggacatatgcatggagcattaaacatgggaaaaaaaatcaattgcacagtttgcatgtaaattgcgagactaatctttttgagcctaattgtgctatgatttggcaatgtgatgctaagtaaacatttactaatggtggattaattaggcttaaataataaatttgtctcgcagtttaaagacagaatatgtaatttgtttttgttattagtctatgtttaatactttaaatgtgtgtctgtatacttaaaaaaaaaatttggacgatgaactaaacacggcctaacatgaggagtatgtgtagcgagctttcgaatgccaacatgaggagtatgtgtagcgagctttcgaatgcacaaggtcattcatacctgttgttcagatgaagtttttatgtgaccggatgagcagtggggacgtgtggtcctttgcccagtcgcaccaacatctattactagggacacgggcaccaactgacgacattacgaacaatggcccggtttctcgaggagtaccagaaatctaacttgcgagacaactgccacgaactaaactgacgaactagatggaacgaacaatcccgtgcaatagtccctgcctaaactgccgtcctcatacccgtcgttcgtgtcccatacgtggaaccgatcattgcaccgtgctatgtactttggtcgggtctagtccagccagaatatggtggtggtgtcggcgcagccgcactaacgcggcacgtcgactcgtcgtacctgctgcttgtttttttgagtggaaacggactcgcgcaccggcagcaggcgagcgggagaattccgttgcattcaaaccaaaccaacctaaccagcaccaaagctgtggccagccactttaccccctcccgcatcgcacgcgccccgacctaacgcaacgacccgacgcgtctcttctcctcgtcgtcggtgccgtgccgctccggttggactctctcctcgacggcgccggtctcggcctctcgggttatctccgcgtcgtccaaacgctcgcccacacgcgaaagaaaaacgcacacaaaaacacacgcaaaacgagccgttgcgacctgtctctctctctctctctccgctaatccggtgagtcccccaccaccgcaacggtccggtctttaataaacacccagcctcccacttcacctctcgcttcgcttgtcgcttccgcctcgccacgcctcgcttttccaatgccgccgccgaagcgcgcgtgccgcctcgcgctgctcgccgccgggggagcctacctcctcttcctgctcctcttcgagctcccctccgtctccatctccgtctccactgcctcgccggcggcggcggcagcggccaccacgcaccgcccgcgccgccgcgagctcgaggcggcctcctcctcctcctcctcctcctcctcgcctctccgcccgctcaagaccgccttcccttcccgccgctccccgctcgccgtctcgtcgatccgcttccgccgccgcaactcgtcttccatcgatgcttccgccgcctccgccttcgccgccgcgcgcccgctcatgcaccacctcctctcctccttctcttccccttccccgtcgtcctcgccgtccccatctccgtccacgtccgattcatgcccgtccacgatctcggtgcctacccaccgcctcacaagcggcggcggcggtggcaatggcgggggtgtgacggtggagctgccgtgcgggatgggggtgggatcgcacgtcacggtggtggcccggccgcggccggcgcggccggagagcgagccgaggatcgcggagaggaggggaggggaggcggcggtgatggtgtcgcagttcatggtggagctgctcgggaccaaggcggtgcagggcgaggagccgccgcggatactgcacttcaatcccaggatccgcggcgatttcagcggccgccccgtgatcgagctcaacacttgctaccggatgcagtgggcgcagccgcagcggtgcgagggctgggcgtcacagccgcacgaggagacaggtaaactctcatactactatatcttatcacttggtatctaaattcccttcaaaaatgtatatttaaatgttaaattagcctcaaactgatgtgaactttaacattttggcgaatggttttggccattcagttgacgggcaactgaaatgtgagagatggattcgggatgataacagcaagtcagaggaatcaaatgcgcaattgtggttaaaccgtttgattggtaggggaaatgaggtggccgccgataggccatacccgtttgaggagggcaagctgtttgctttaactgtaacagctggtttggatggctaccatgtcaatgttgatgggagacatgttgcgtcgttcccttaccgcactgtaagtttgttaattatgctcctatagattgctggtcagtttttttatgccatcataagatttgattatttgattgtggtttaattgttggtgcaacagggttacagtctcgaggatgcaacaggcttgtctttgaagggagaccttgatatcgagtcgattttagcgggacatttgcccaattcacatcctagtttcgctcctcagagatacctggaaatgtctgaacagtggaaggcaccaccactgccaactgaacctgttgagcttttcattggcattctttcagcagccaatcattttgctgagcgtatggctgttcggaagtcatggatgattgacacgagaaaatcatctaatgtcgttgccaggttctttgtcgctctggtaggtacttatgttcatgactgggtttttcgaatatgttatttgcctgatgcaaactctaaccaaaaaagcaccttcacagaatggggaaaaagagatcaatgaagagctgaaaaaggaggcagaattctttagtgacattgttatagtgcctttcatggatagctatgaccttgttgttttgaagaccatagccattgctgagtatggggtaggcaattggactttactggacaaatacatcattcattttttaccatgcttctatttgattgaccttcatcctcatgttaaccttgtaggtgcgaattgttcctgcaaaatacataatgaagtgtgatgacgatacatttgttagaattgactcagtgctggatcaagtgaagaaagtagagagggaaggaagcatgtatattggtaatataaactactatcacagacctttacgatctggaaagtggtctgtatcatatgaggtaagaatcacaagatgccatttgctttgcgattaaaggagtcacactatgtatgatgctgacccttgattacaaaaatgaatagtctttgttttgtatttccttcataagtggaacttagttgttcagcataatgctgctttatagagctggcacatatattctgctttttatttttatatcaatttatggttcagtgcattcatgttgatcctctttcaaacataactatttccgagttaccatcatttgtcctttaaaacctgacattggcatctgttagtttgttatcatatttctcatggtagcagtgaactagtgatgagttttacgcggcaggagtttgatgtggtttcatgcttctttcaggaatggcaagaggaagtatacccaccttatgctaatgggccaggctacgtaatttcttcagacattgcccagtacattgtatctgaattcgataatcagacgctaagagtacgtttatctaccctatccctggtcactgaacatagaaatggagtattatgtttagaacgtgataaatggatgtatcatttttgtgatgcagctcttcaagatggaagacgtgagtatgggaatgtgggttgagaagttcaacagcacccgtcagccagtgaagtattcgcacgatgtcaagttcttccagtccggttgctttgatggctactacaccgcacactaccaatccccgcagcagatgatttgcctgtggagaaaattgcaattcggcagcgctcaatgttgcaacatgaggtagtatggacgctgacaagagaaagctcgttttaaccactaactaacggccatcaacaaggatgtgtttggaggttcaccattctatgtaccttgtggccattcgttcattcttttggtcagtggccgattgagctactgatgctgaccagatgttccttgtgtttgtctatatacacgttcaggaacgaaaaattctgccactagcaggaagtatgctgattccatccagataattgtctcatcccaattttagattgaattttatgggatagagcgagtataatgtagagttgtagcctccatctaaatttattgtaatagattagattttgttttatcctaattttagatttaatttagattctgttttatcctaattttagatttatttttatgggatggaacgagtatgagcctgttcagctgccagggctgcggccgcagcatgaacagtgtcgcactcactatacgtagccgcagccgcagccctctcgggaaggggctcgataatgtagagttgtaggcactatttacaatgtcatatctaagatggtgttcttttctcttgaagatgaagattaagttttttacgcaaaacgatgtgttattaatatataattgattgagttttaattattacaaacttaaaaaatagattaacaatgatattttagagcaacttttatatagaaagttttcgtacaaaacgtactgtttagccgtttgaaaacgtaccacgaaaatttttatcttcatccaacttttgttggaaaaatgaacaggtatattttgatatattttcgggattaagatagttttactaatttagagagggagcacaagttccaaacttccggtacaaagtgccgcgtgtccaccctgactgttcgtggcagactactgcacctttgggtgggtcactcccaagtcaagcatgacccagcacgcagcagtgccgcaccgcaccgcaccgcaccaccgctcatccgagcaaacgtggagaggaaatggcagaatccgattcccccgcaccagcaccggctcgcattgcacccttgcaccgttgcacgcacgcagaaaagaaaagaaaacgtcgcgcaccgacgcggccctcgtgacggacggggtcaaaaccgtcgacgagacggccgcgcgcccacggaacacaggcgatcccgcctcttgtctttccagtgggcgccgcgccggaattccaactccacagaccgcgctacctttcccactcctctgcctctgctctgcttcaccttccttccaccatagcagcggttaaatatttatataagcgagaaaccgctcacccaagcggccatgaacccgctcccatggcgcccctccgaacactcgttatcttcctcctcctcctcctcgcgctcgtcccggcactctcgcgcccggatggcggcggcggcggcttctatgacccggcgcgcgtcacccagctatcctggcgccccaggtcggtctgcctttgagctctttcttggttgggtacttgggtctgcagtgcttggctgcgcgccacctgtttggcgatttgcgtctgacagcgcgaggctcctcctcttgcagggcgttcctgtacagcggcttcctctcgcacgacgagtgcgaccacctcgtcaatctggtgagttgctgctgctgtgattccctcttggtgatgcgaatgggagattgttgtgagttgcgatcttgatgctttttgttttggggaatttggggttgtgacgttaggcgaaggggaggatggagaagtcgatggttgcagacaatgattccggcaagagtatcatgagccaggtgcgcaccagctccggcatccttcttatcgaagcacgaggtaagcaaaatgtgcatgttatgctgcgcaataccgcttcttcaatttgttcctgtatgctgttcggtgctgctaattatatagccataaattgatcgtatattcatatatgcgtgggagaaaagaatttgtctctgtggttagtgcattggattagctcgatattgtgttcgatcattagaaatttcgccggatctggctttatggtaatgcaaaagagattgatttgttcttcgattttagtttctagaaccttagtgtcttgactttgatacggtactctcaagagtcagcattgctaacctactcctttttattttgacccattcaaggacgacattgtttctggaattgaaaagcgtgtagctgcttggacatttcttcctgaaggtaatttcgcgcgactttatctagtttgtcttttggagtttggagctagattaccattctctggctggtctctttcttgatcagaaaacgccgagtcaattcagattctgcattatgagcttggtcagaagtatgatgcccacttcgattatttccatgacaagaacaaccttaagcgtgggggtcatcgagtcgccactgtgcttatgtacttgaccgatgtcaaaaagggtggagagactgtatttccaaatgctgcggtatgcaattagctttgacattacccccttgtaatttcccaagacatctagtttagaagttctttgccattgcttgcagggaaggcatttacaactcaaggatgaaacttggtctgattgtgcaagatctggcctggcaggtagccttcaccccctatacatttctgaacgaaatggacaatatgaattgcctttctgcacaaagttaattaacctcagtagtaggaactaacgagaccaatttatcttcatctcctctctcagtgaagccaaagaaaggcgatgcgctactgttcttcagtctccatgttaacgcgacaacggatccagccagtcttcatggaagctgtccggtgatcgaaggcgagaaatggtctgcaacgaaatggatccatgtcagatcatttgataatcctccggatgtaagcctggatttgccgtgttccgatgaaaacgagcgctgcacgagatgggctgctgttggagagtgttacaggaacccaaaatacatggttggcaccaaggattcgctcggattctgccgcaagagctgcggggtttgcgatgcttaaaccctgcacccgccaaactgaagatctgaaaatcaaagtgtcatgttaggctgttagctattttcgcccactttacttacacagttacactacttgagaagttgagatgtacataacagacaaagcaggtttattagtatgtgtttctgtgtagtttaaccttgaacgatattgattgaaagtaattggaactttttttcaggtctaaagtgctactgaaatttttcgcaaaaaagttgggagtatttcttttagaggaaaactgcttcaatttgctctggtttctgtacgctgcatccgcttcggattaaaggtcactcgtgggcctcacgttttaccccagcccagaacacgcgttgtaccgttccggccgaatcagtatgggcctcacgtgtgtcacaatctcgatccggccttccggcccatctatcacggtccacaccttcgccgcattcccgtttcggcccaactagtacgggcccgcacgtgcgaagaagcctaagcctatgggcgaaaaggcccacacaacgtgggcgccacttcacgacgtggtgggcagccggaacggcggttcgtccgccgccagttcgccggagcaccgccgcggtcctaccatccttccttccgtcggatccatctactacggccggagatctcaaccagccacctacctgtatggatgcttctagtagagtctctcctaccgatctgcccgcccttgcccccccacggccaccgccgccgccggcggccggcaatcagggaggcaacgcgtcggcgaatgcgagcgctactcaaggtattcacctatgcaggtggaattctggctcgaatttgatattgcgtcaagctcgcc

SEQ ID NO: 59241 - DNA, 1141 bp, Oryza sativa
attctaactttgaaggaatatgcgtatcgggatgctgggatctaaccatacttggactaatttcacctctatgcacaattacgaatttttcaagttgtttaagaatttataagaaccattaacatacttgtacgttgtaatagaccaaattcatataattgtgaataagctagaagggtgattggagataaagtattggattcgatggttactcacgtgaaccttacggacacactcatatattgcacgaactgtccaagttgaatgttctattacttgatccagcaattcagaacacgaatatgtgattattacaaaaaaaaataaaagagataaggtttttgttatgaagcgcttgatttatacagcctcgtagtaaaactgttaccaaaattttggcacacggtagacaactcgtatctagatccggctcctctgcctttagactcaaaaggtagagaggtacacagcaaaaatatgtcttgttcaacagtagttcgttcgtttgttgtgaatcgaacggctaaacatacttccaaagtcagagcagtagagctctcagatgatccaaatccctcgcataccacccccggcacgtccatagacttttgagacatatttgtacttcctaggccgagttgctgagttatgatctgctcccaaccgaaagcggcccatctgcgggcccaacccgctccgcattacgcattttcagggttagggtttaggatccctccgcgacgccggtggagacggacgtggtcttgttactcttgtagccgcgcgacacggacccacccccacattatcgtgcttgtcaatctgggccagttggcccagcccaactacggcccaactgctcttgttgccatttgcttttgaaattttcctttttgattcacggtgtttcttatcttgaaacaggtgtaaattgtaagtataatactttttcatattataattataagactttctagcattgtctatatttatatatgtgttaatgaatctaaacatatatgtgtgcctagattcattaacatctatataaatataggcaatgctagaaagtcttatataacttgaaacttgaaacggagatagtaaaagatagtaacatgataaatcaaattttggtttg

SEQ ID NO: 59242 - DNA, 13306 bp, Oryza sativa
cactccacttcttgtgtgccgagcttcgttcggttcatgtctgaataattagtggcaactttagccttctaaagcttgcatgcctgcaggtcgaaactagccccgctgctgctcaccatgacacacaagagagagcgtggaataaagttcgtaacatgatactgtaacgcgacgaagaataataggcatggaaaattacgtactataaaccacgtctgtaataaaaaattgaaaactactgttagataaaaataaacgtttgagatttccccacgtcaccaagagtaaaaatattactgcaatatgaaagtaaaatttttacttttataccgtggacaaatcttatacatccatatattttaatcaaatgatagtttttaggttttcattacatgtggtttacaacacatatttttctaaataagctagtcttatatttgcacagggggtccggtctaaggggaaaaaggctcagaattgtttgtcgtcttatagcattcaattcgacaaagaaccataaaaaatgcagccacatcaaaacttgcctgataaaagaattttcatcaacgaaaaactaatttacaagtaaagtccgtgggtgaaaatggagtgtccagatgagatgggacaaaatgaaaagagagaaaaaaaagttgacgttagcaccctaagcccagaaaaggccgaattgcagatccacgaaaggcgccataacccagcccatccatatgctatgggccatgatctcagcctatccaaataaggcccaagtaaaataatctgtccgtaccagcccacgaatagcccacgaactatccaaaggcagtagagcccttcgcctcccggccgcctcgacgcatcgacgacgccggcgaccaggagatcccgcggccatgccgccgccgccgccgccgcatcccctcccctcaccatgccgccgacgccgctgcatcttgctcctcctgctctccaggctgctgctctcttcagcaagcaggtcggtccccttcctctgccacgatccacgctgcctcaccgtgctgtttctcaacctccccgtgtgtgtgtgttttgccctgcagcttggaggaggggagggtcctcaccgtcggcgaggagctgatgggtgagacgatgccgctgcgccacggaagccggctgtacaggctcgacgggacgcggccgtccgcgtggtacgaagtcaagatctcctacccggcctccgtacgaactgactgacccccattggttcagaaaactagggaaatgaggcctccttgtttcaccattgatgcttcttcttgttcttgaaggcatttttgtgcttttagataccgtcgagcttctcgatccggcttgtggacgatcctcactctgtggaggatttggggagcatgaacaggaggttgctcaacacggagaagataattttcaaggctcagagcagcaggccagtatgtgttcataattcttcagctatatttgttgcttgcccgcagaattggactggcatacataatttatagtggctgtgtgatattgattttaggtttatgttcttgtcacggtggagcctgaaggggtagttgcaaagccaaatgtgccggagagagagcttgcgatgttcaacattggtacgatagtatggttctttatgttatgttttttccttcaatgataatgaaatcagatcgatcgaagcaagacagaaattttagaaactctaatgaagtacttttgttgttgggttatggtagcattaggtgtatattctcagagttggttagtcctgtgaatatcgtgatcccataggatgaattttgaatagaggcttaagcaacctcatgcatttcaacctttgatgtagtgctcaatttttgtcacttccctgttcgtctaggaagtagaggatagcctgagggtgtgaagatcaaatgatcaattctaataggcttgatgcaacagttgtaatttcaccttctttttacaataattttgcaaacttcacaatagccaaatatctcattggtgtggagaaagtagatgatatgcagccaggatatataaatgaaagaaattaaggcacttgtagtagccatggctaaccaaaggcaagggttcattcactaacctagcagatggcttcagctccttagttttgtttttagttttcaccttttgaattttgacatggaacctctgtgtccttatgctgtttgcatagacttatttgatgctagtgtacacttttttaatgaaattggtgtgtggaattttggcttttctagttagtttggtgcttttctgctaatagctactgtcatttaagaaagggggaagtaagaaccaacttgttcttatgttcagcaattataagaaattcgttagagtcattccttggagttgggactagagtccaatgttgtgattatggtttggagtttagacatattacctaatctataactcttgtcacgtcctaattgcatatgtagttatccaaatttctgcctcattgataagcatttgtaccccttttttttcatcttgtgacaaagatgcctgaacttcagttggagaatggtattttgtctactgtagagcattttttttgtggatttgaaatccataactacggttgagaaggaaccttgagaaagcttgatctaagataaaatacttatttatcattgatgcttttttagttacttgtcctttagtatttggattgcatctacttttgttttacagtcattttgtgttatttctatctgactgacctaaagcttttaaatattactttgatttgattctgcttcaaggatttgtgtttatgctttgacaaagcacctagtcaatcagaaatatctagaacatcttctggtcgtacaccaagaccttggttgtaggtttctactgaactttcagtgtctaatgccgaaactgaaaatgttattctcgcccatccaaggtcatgagattaatatcaatctgtaaaactttagtctctggttggccagttaactgcatgaccattgatttctgttgataaattatttacttcacattttatgtataatttactttggaaactgtatgctctaagaaatatgtctgattaggtagttttgctgcccttccttgcttctggatattatcgcctatgctccttaacctttcatccggttcaagcattgaaataacacctttgatcagagcggtgttttgtttgtaattatttcttttgtgcagtttgcgacgaacttatgcttgggatcccacattttgcctggtgggttggaattggatctctgttctgtattgcgctggcatctgtggctccctattttctccctctgcacaagctacttaactacgaagccacagaactgagtgatgactttgcggctaagctctcatgatagatggaagtgtgctgaatgatagaaatgtttcattttgcagagtaggctattgtacaggcacctagctcttttttcctttccatcagatgcagctgtgtacaagtatttactgtaccttgcaatacaatggtagattcattcatttcgatcttgtaagattggttccgtgatgggctctagtttactttgttttttcccggaaaaggctatacatactaactttttctctctaaattcttagtagcgccgatgtgtcatgttacgagtgtatttagatttatttattttttataactttcacctatctaaatcaaatggttgagatgattacttgttttctccaactgaatgaactgctaaaaggacagttttatgccgttttctcgaatgtgcttgttgaccggacaataaaaacatattctgtggaacaaacagtagcgaatttatatcagcatactgatatgatacccacaagagatactgagttttcaggtgatcaaaacaaggacagattggaagactccttttaaagcattgatgccaacgtttcttacaacgacatcaaagaagagacaactgaattattgccagcacacttacaagctacagtgtagcactaaaacgagaaaaggaacatcgtctgacctgagactctcagaggtgagagggaaggccacgaaaaacattggaggatctatctcccgttctccgtgagctcctgacgcgaagcactaaaatatatgagactggaacttgaaccacatcaaagttttcattccggcacggcatccgccaactgcaaaccacccttacaatgacgtggtgtgtccccgcgtgtaaccgtgaggttgtgttctatctagtatttggttgttatagtttaaaatagaggaagtaaaaaatatataactttgaaagaaagtaagttgcacttgctcgactcggattagctcggctagttagttcattgacaaaaaatagtcttaaatgataacaagccataaagagactaatttcaaaggatgttaaatgaaaaggtgaatatgtagagaagcgttcaagctaagtatgtgtacagtcctcatctccttcttggcgtttagattaagatttatgcataaacatttgttaaagatcctcttctactaaacatcggtaagcatcctcttctcctagtagatggcaagattattaaatattgtgagaaacacattaagaaaaatacttttgataagcacatcattaaacatctactactatgttggagatgaccatcagccaagcaagcatcttcctggcgactcgcctgctcaattctccgtcgctttcggtgcagtttgccattgatacacacagttacggccagccagggctctctgtcatgtcgtcattaacgtctgatcgagccgtgtaaccacaccttggtctgagtttatttatatttatatattttaatcagcatgtgttttgagtactacagtactatgctaccacttccacaattaaagctgcatatgcgtacacatctttctgtttccgaaaaatagatggacagttggaaaccctgtgtttggaatgttcgacggatttgattgatatctacgtgtaaccaacacatcacctccgtatattcggttaacagttactagtaataactatacatactgtctccgtaaatattacaaagttataaatacatttaaccattaatttttaaaatttcgtatggtttaataaaatgtaagtttgaaagtatttattgtggtgagtctaaaaatataattcttgtgattgttgagttttatgagcttacaagaactgatagtcaaagattaaaattttggatttagaataaatttaaaatgataagtaattttaaaaggagggagtagctaaaaagatcctagcttttgaagttaataactgatatatatatatatatatatatatatatatatatatatatatatatatatatatccaagataatattgatggagtttattttctcttgcaaatgttccagccttgttcccgaggcacatgtgcacatactccctccgttccatattataatgtattttggatggatacgacacatcctattactacgaatttgatcatactctctatctagatttgtagtaaacgtgtcatattcacccaaaatactttataattgggacgaagggagtacatcactatacatgtccacgtgatggtgtattgggttggtcaatatcacacctctggatagtagcgttcatcgctggaaatccatttatcaacgtcaagaaaaaccatccaatcctccatgctgaatattgttgatgtgtgtgtgttatgaaaacagcctgtaaccactagcttgcttgttccaggatagcactgaatcaattgtttctgatctcttgcattcaagtcctgttttaatttattccaaaaaaagaaatgttattttttttacccttattaatgttaattagcgtccacaagccctagtaggcagtagcgccttatactatccagtttaaaatgttggcttgaaactacagatataccttatagcaagttcaatagtatatcccactgctagctccaattcagctatagccaatctaatagccaattcatacaatagttgcttactatactattcatatatggtcccatctgtcatacacacactgtgtcttggagtccgtgctacagctggttacagatctgtagcttgctgctcttctctctcatcttctatctcattaaaatatgtttatagctggctaatagtgtgctattgtacctgctcttataaactagtactcccttcaactcaaaatgggcctgttcagcataccggctgcaaacaggtgaggctgcggctgcgaacagtgagtgcgcgcgcccgacagctgaacatgcccactattacaatttctatcgtctaaattttgttctagaacatagtattttctcactgtattttcttacctcaaccaatcacgataattctcatttactctctttacatgctacctcatttgaagtaatcacaatcattcaaatataatcctgttcttctctatgctccctgcgaaaagctttataatacatgtattttgtgatggagggatagtaaatacatctcgtattaacgccacagctgcaatgtcccatggtgtgtggcatggtgtcaaaatcaaatgtaagaccgaccatggacataaccatgatgcgtcaagatcagcttttgaagcaccgttagtacagtgataggacagaggttagagcatccttctccaagcaacaaactataaattaactttcatgttgggagaattaatcaatggttctagcaataaactctcaagttgcagtattgcaccaaagttcaaccagaaattagatagaccagattattaattactagtttgcagcccatcacgatcgaattgaagccagtggattgatcggtgaaaggcagggatccattgttttgaggctaatttgaacatagctagctggctttgcccgttttgctgctgcatatatataatattaggtgaaaccccgcgcattgctgcgggaatttggtatgataacaataaaaaaataacgtgtaagatagctagttaacatcaaattaagtaaattaatgtagtttatgataatttaaatttaaacagtatgtagaatagtgattcaaacgtaaaaagtaaggtggtatgactttatagaaaaagaaaagtagggaaatggtttggaccatagattaatcatctaaaggctaaaaacaattgatgtaatatgacttaattagagggaaaaaggagaaatataatttggaccatagattaatcatttaagcactaagtaaggatgaactacataggtatataggatatcataaaacataataaaaatatacattgaaacattatgtgaattatattagatgataatttaacatgtttgtatttgaaaagctcttacattataaaaactataaagatatagcatgtttgcatgatgtttaaatggtgacgattgttagtggatgatgatgtggcatcttgttaattagtggattggtggatgatgatgtggcattttgttagtggatgatgatgtagcatctttgcatgttaagcttaaggagttagtgggggataattttatagtaagataggatacatcacgagttgcacgatgcacacattcgtgcgagtctgaaacataagaccatctgctaattaaaagcttagccggacgaacgggtgggaggagcagtgccattaacgactaaaaatttgcaatcacgttttaatatccctaatattatacaatatacgcttaatatcctgtttgacatagctccaaatcttatattctttgctagattatattgtaaattaatttataacggtttgaaattttatactttctataaagtatgaataaaatgatcattattaaaatactatcaatctaatcacaaatttagatccatgaatttttgtagttatgaatgttcaattataagaaatcttgaatatagagctatactaaaataatcttaatttactgaatcaatacatagcattaagcgaaatgatgtaaagtaaactaacagtcaaagcttgattttggcggtcaaaataagccatatatttctagatggagggagtagctggcatagtgttaatagcaagcttcagacgaaaatgttcataacatttttattttatcctttttatttgtgtaaaaaaattgggtggtcgatatcatgtcttaaaaacggagggattgggaacccctcccctccacacagaaaacggagcgatagattaacacgtgattaattaaatattagctataaaaaaatttaaaatggattaatatgatttcttaaagcaactttcctatataaactttttgtaaaatgtgtaccgtttagcagtttgaaaagtgtgcacatgcaaaacgagggagatgggttgggaacccatgggaaataacacaacattattaacttcaaaaacaaaacctatacaacattgttttccaaccagagaaagtatataggcatatggtgtaataactattttctccgttccctaaaaaccaacatagtactaaatatgacacatcctactattacgaatataaagatatatatgtctagatttatttgtgctagaatgtgttatatccaattcgttctttttttatgagaccaatggagtacttatggagattagaaactagtactagatttggcaatggcaagtagtacaaaagggtagaagaagatgaataatacttatgcttcggtgatgtcctgttccggtttctgcttcagttggacacgagttgctgtgtacagtaatgttcttgatggcagggttcatgcatcaagccatcaacccaaaatgaaagtaagctcatgcatctctccgttggcgtcgacagtatccaaatcaaatcaccagtagatatatgcaatatatgcaatgcaatgcacgcgtgttggagtatggtttaggtcaaatccagcagtgcggatatagtaaccggccttatatgttcggttgctagtgcaccggccatttatgtactgcaaacgcgacaaacctgatcagcatcagatcaactgttcagctatagtttcaacaaccgaacacggattcaattctcaaaggggtctagttagaacaagatacagaggaaggatcccatggcttgaaatatatttgttaatgcgatgtgtatgtatgcagtactgcagagccagcaccgtcgtaaaactcgggtgactagtaacattttctggtggccgactaatttttatacgcatcgacagctaatggtaatggaaacgatagcggcagagctcaggcggccacctaatctacccgggagctatctccgccgctatatatattcttttctataaataaatgattcttgtgggttttttactatggtgtaagaaatttttgacagagtattgtttccatgaggatggtaatgattctgatttagttgtatataaaatttaatgtttctaatttcgatcaatttcatataattgaattaccaaatataaaaaagttctaaccaatcaagaaccgttttcgtaattatcatttccgacatttccataccatactcacaggatagatcctgatcctgctagctaggagtagaagatgaagagaaagacagaaacaggcccgaacaaccaattaaaaccactccataattaaattaagtagtaagctggagtacaatccatccattgatcaccatgttgagagactattgcccaggtaagccaatacggcaataccacagccacacgcgcgcgcggagctcctaacgattgtccggtgaagaaattaactatcttctgccattccgtattttccgttgcttctcgttgcacgcacgcgtcacacgagcacggctacctagcctgccacgaccgtacattggcacatggattacgtgccgcttcatccactggcctccagacctccacgtcgtctcgctcgatcgatctcctctcttctccgctctccttgaaccttctttcttccatgatgagtacgagtacggcgcccagtgtgaaatgccccccacaaactgcgtgagaatttaatatttgccactctatcaaactgcctgagaatttaggacctgatcacttttatgacattttcaaccatactattttccttaaagttatcaagaaaatatatacgtttagtttgttgccaaatttaatcaatacaataataaatcctaccaaaattttagcaatatattaccatcttgctaaaacttggtaaggtttattttgactacaatctaaatagacccttactatttggtactctataggtccggtggtatttagaaataagaatttagaaaagtggcatttgagcaatggtattttgatacagtggcaaaaaataaaaagcccccccccccccccccccccccaaaaaaaaaacccacgcaccccaaaaacaccacaaactgcacgaccagcaacacacacgcacgcaatctagcgatctccccaactaaccccattaactgatcacccgtcgactgatccctccaaagattgtaccaccattaatcacccttcatcattaattaattttcctcgacaaaaatgttactcaatccatccaattctaagcgagtaactttttactatcttattttaaatttacgagtttccgtgtcgaattttgatcgtatatcttattttaaactttttatggttagtatttttattattattagatgataaaatataaataatactttatacgtaacttatgttttaaattttttaaataaaataaatgattaaaattgaacataaaaacacattattatacttagaatgagacgaatggagtaattatgtttcttcactaattaagctgaccaatcgccagtgctcacacccactctcctagcctagctagtatctatatatagacgcatataaccacacgcaagaagcatccattccgatattccatcgatcgatcacgtcgcaaacacacacagtacacacgcaagctacctagcgatagcaatggcggcggcggcgagatggtgggtggcggcggtggtggtggcggtggcggcgatggcgggggcggcgaagggggacttcgcggcggacaaggcggagtgcgcggacaagctgatggcgctggcgacgtgcctgacgtacgtggaggagaaggcgacggcgagggcgccgacgagggattgctgcgccgggcttgggcaggtggtcgccggcagcaagaagtgcctgtgcgtgctcgtcaaggaccgcgacgagccggcgctgggcttccgcatcaacgtcacccgcgccatggacctcccctccggctgctccatcgccgccaccttctccgactgcccaagtacatcacattttacactttatttaatcatcatcaattgattgatttattaattagttaactaacaccgccttaattagtttgttagctagtttggttgatgccatgccggccgctttgtttgcttactatccgtcttagacaaaatttaaatggtttttaatcgtattctattttctagccttgcctttgaaacggctaacgatgcagatatttgaagggaaggatatccctccaaatatttttttaagagaaaattatgggcgtgttaagaattaaacataagatatcggattaaaatcactatctcttaccacttcactatttagaaatttcttttacttataaaatattgtgattgctctgtctatttttttactatgatcgtcggctgtagttcaacttcatagctttgcattgcatggacgtgctcaatcaagtttgcttcgtgcatgctgcaaattaatcggtttaattttttttaaaacaatggatagatatccggtttctatatccacaagcgaacatatacaaccaaaatgggtatggatggtataatttagttttggatgttgttcctgtacagtaggagtacaactacatcgatctcgatctggcgaattgaatgaaacactaacctggagtggtgctggaccatgcttgcttgttagaactgtacactactatgattagctttttgtcgtgcttgcacaccgtacagtaacacgtacgttaattgcacggtgcaagcagggtccggtcgatcgaccaaataattaagtactttctagagcaatttgctacagaaatcagaccacctctgcttcaggaatcaatactttcttcatttgatatcatcattgccatgcctttttttgcttctgttgatctgttcgtgattaattcgtcggtaattagcatgactgaactaactgcttgttactaatttggatcgatggccatgtatatatgcagagatgctgaacatgtcgcctgactccaaggaggcagagatcttcaagcagtacgcgagggagcacgagtccaacaacgccaccaagcctgctcctgctgccgctgctgctgccaccggtaataatcattaatcaatctctgatcgatcaaacaataatcctcttaattacactaccaagaagaaataatagtaatcagatgacagataatgcatctgtctaaatcttgagttaattaatcagtagtactataaataataatgatgctaaatcgagagagagagagagaattctgagctttctgcttgcatgtgcgagctaacgacatgtagcacggtgaagtgccatgccgtgcatgatagcaagagttatgtcgagaaagctacagcaaacgctacactagctgctgcattgaagcttcgatgtagaaagcgtagtgccatgagaaatcaatgccacactcctccgtagtaaccgccacgcatggccaacccgtccatccaaccgaaactgctgcctgtactgtactgtacgctggagactgtacccaaaacttgcagcagcagtagaccagaagtccagaataccggaccatgcagctgcggcatgtttggcttcatgactaaaaacgtggagaagatccctagtttttcacgcgcacatttaacatactactaaacggtgtgttttttctaataacaatatataaaatgttttaaaaaattatattaattattttttaagtttaaaataattaatatccaatcaatcatacgttaattgttcatttcattttatatatcttttcaatcttatattggacagcttaggacttcttaggaacatatgaatttcacaggaactgttcatttcctcctaaaagtttcttaagatgaattcctccatttcgttttactaatctgaaagactggtaattgca

SEQ ID NO: 59243 - DNA, 2479 bp, Oryza sativa
aagcgtctcaaacatgaacaaggagatgattggggatagatacgataggggataggacgagcgacaggtgaagaagtaccaggaattaggatcttgaaattggaagcagtcggcaggtttcgatccgagaaccttcgtaatcgccatcgccaaatccgatctcaaaccctcaacgatcgattaatagggattagatagactgaagaacacaatcaattccgccccagaacgacgcagcaactgcacaatttcgcattgatctcccaaatggacctgatcgtggatgatgaggaggcgaagaagaagaagaagaaggtggtttggcaatggcggcgagcttgttcgttcgtcagtgaagaactgggcagaggattaaatcatcaaacagaaatggaaggtggcgagacgaacaccgtggaatccagcagttcgcttcgctaaaaaactacgttagatttgcgtcaaaaaaaaaaaaactacgttagattagcacctagctgctgcgtgcgtggtgtggggcctctaaaaccgcgccgtgattagtgaaacaaactccccgttttggtcagtgtcgaactactatctcgatagggaacagtcagatttatgcgctggaaaacgcgtgtgttgcatgcacatgtcttctgtttaattattcatctgatgatgatcatggatagtcatttcactagagataacaaaaaatcctggccaaaattatggtgtcaagactcaagagcatttcgggcttatttatattgttcctttacaaaaacaacaaaattcagtaaaattagaaataaagaatgtctaaatttgtcatgactgcgttaaaaaaattgcaacgtacctctatcattattatttccaaaagaatctgtaacgcgagtaatttggcccatgcatgcagcccatgggataattcaccatcgcggcatcaagcagaaaatcacgataaagagagaatatcggccagaactctgtggcaaatgaaatctgcaaagccactcacgtttgtagcaaaactgagtatgcaacccaactttggggcatactagcaatttttttttaaaaaaaattctagtaggctataaagcagaaacagcttggtgcaatgagagtagtatagtcattgaatcttgtctagatacaattaatcatacatgtggatgtacatctctttatgatcagaaaagaatggaattggtttgctatgtcctgttgatttcaagcgttgcttacttgtattactatgtggttaattaatcagcattgttggcatcaactattcatcgtaaaaatagagtcacgtatcacgtaaaaataaaatgaaatggatgcggccgttagattacacgtgtggttaacttctgaattttctgagggattctgaagagtcaccagctatcagttcaggctggtgatgcgacgtcacggttgtgctccccgaagagccgattcaagaacatggccagcctaactcccccctgcgcgattcgtcgtgtcacgatcgggagccgtgagccgaagtagtcatctggaaataacaaattgacaatcccatgacatcagctaggttcagacttcagagatgtgtgcttgttctagcaaaggcagcattacctgacagagtttcgccttcacggacatcgttgtacgcccatttgcaagccaaatttatgctctctgtagcgtacctgttgtatgatagaaaaatatgattcgaatgcaaaaaaccaaggcgattctttctttgttaaacaatacagaattgtggtttcagaattttggattgtactgacttggttgagcaagacaggagatcctcgcagtctccccaagaggatacgtcatcagaccacgttccctggagatgaaaaattgcagaaattcgttcgttcaaaataattttgcaggaatttttctcatgtttctttgcttggaagagttgttttcaggcagttctcttaccgtggtgaagttgtgcacaaggtccttttgaaacgcatccatgtccttgccgtagaattcagcaatagctgtgagtatcatctccctatcccacacctgaaaaaacaccagacagacttgaaaagtaagtaaattgagcttaacggcaggtttttcacatggaaggaattatgtgcaaggatcaaggaagttgattacatgatggagattggatttgtgcctgaaccagcgtagattaatcgtattgcccccttggtcgctcgtgaacccaacatgcattggctggatggacagataaaatagttagtatgttgatgtgtatgaactgttgcagggagtgcatgagagtagactaattggtaaggttacctgatgaacatctcccatgaagtgtgacaagaatagcagtgcttcagtcatgttatctgcgttacaagcagttacaacaatatgaaagaaaatgaacagtcagacaagagatacatgacaactaaactatattggttga

SEQ ID NO: 59244 - DNA, 2024 bp, Oryza sativa
atccaatggcgggtgcagcgaaggcgtcgtggatggtggcgatgagcgtgggcgcagtggaggcgctcaaggaccagggcggactctgccgctggaactacgcgctgcggtccatccacaaggcggccaaggccaacgccgccggcgtctcgcagggcaagaagctgcctgcctccgcggcggcggtagcggagaggaggagagcggagaaggccgaggaggggttgaggacggtcatgtacatcagctgctggagcaccaattagtgtataaactcgagatactagtacgtagctagagctgaagtagcaaaccatggcttgagatttggccggttgcttccttgatgtgtatatatatcaagatgatgatgaaaatttcttgttactaaattgccccgtggtttttttgccatgtgaattgcgatcacgttggctcgtggatttgttgcccctgaatttcagtctctctagctagtggctaaggccatctcttatttggttcagatgacagtaattcatccaggtctccaagttctaggattttcagaactgcaacttattttatcaaggaatctttaaacatacgaacagatcacttaaagttcttctgaagcaacttaaagttatcaggcatgcatggatcttggaggaatcagatgtgcagtcagggaccatagcacaagacaggcgtcttctactggtgctaccagcaaatgctggaagccgggaacactgggtacgttggaaaccacgtgatgtgaagaagtaagataaactgtaggagaaaagcatttcgtagtgggccatgaagcctttcaggacatgtattgcagtatgggccggcccattacgcaattggacgacaacaaagactagtattagtaccacctcggctatccacatagatcaaagctgatttaaaagagttgtgcagatgatccgtggcacgaccttacttgaacgggatctgttctataggctcgtaccgttgcatccttgactaataaggaggcaagcacttaagcttggttgatgacgcatgacctgtgggccagagcgtgattaacggccggatcactggctgatttgatcccacggctgtagaggatcgtttcttgccgggcctcgcctggccaggatggctctcaggttctctgacaggctcccattttttttttcgttttgcattgagttttctccgtcgcatgtttgcagttttattttccgttttgcattgaaatttctccgtctcatgtttgcagcgtgttcaaaaagtacgcagctgtatttcacttatttacggcgccacattttcatgccgtttgtgccaactatcccgagctagtgaatacagcttggcttcacacaacactggtgacccgctgacctgctcgtacctcgtaccgtcgtacggcacagcatttggaattaaagggtgtgatcgatactgcttgctgctgcagcaactgtggctgcaagagctaaaaatggctgcagcggcagcagctgaaaaacagccacagccatagcggcagcagcagatagcagttccgatcaggccctaaatccaagtcctacctaaacaggatgctccattgaacagccaaaccggcctcacatggtctatccaaggactctaccacatcagctgtctttgcatccccatgttcccaacccatcttcctcattttccgcgcgcacgttttttaaactactaaacgatgcgttttttttaaaaagttttctatacgaaagttgcttaaaaatcaaattaattcatttttttttaaaaaaattagctaatacttaattaatcacgcgctaaaggaccgcttcgttttccgtacgggagggattggcttccatcactggactccgaacacagccatgtcctccagctaacggttttccctaccagctcccataactccgctctagctcaccgtcacccaaagacacaaacattaatttttttaaaaaaaaaatgacttcgacttatatatatagaatcaataacgatca

SEQ ID NO: 59245 - DNA, 1383 bp, Oryza sativa
attcctgcagcccatccctcctccctcctcgagctctctcgccggtgggttgccaccgttgatgaccatagcggctgagcatggaggccaagcaccaccacaccaacggcatagagggcgagtgttggtggaaactcccctcactcatttcttctgtcgtggccatcgccaccaccatgccactcgttgtgccgtggaggaagatgaaggcagggtggccgtgggcatcggcggggagttgaggagggaggagggaaggccagcgagctcaccatgccgctcgtcctccatgtgaggtgcgtagctgccatggatattagcctccgtcttgttggcctctagacccctccaatatcgccggccaccactgcatctgtggaaggagagcaaagaaggggggagaagacgtcgttggccacgtctggttgggtaagggttgaaagggaaggaggtgctacccactgcatcttgtggcgataggcagggtgaaagaggtaaggagtatttcgactagtgctcagtctccatggtagtctgcgatggtagcagcggtggccgtccaacgagggagctcgaggagggaggaaggaaagacgggagggagagaggagaaggggaatgaggcattgtcggccatggcaaaagaagcgagtaggagcgctccagcctccagcgctcccgtcggcctctgtgcttatcgtcagtggtgactgcgggaaggtgacaacaactgcaggaaggcggcaacccggcggtgagggagcttgaggagggaggagggatggctaggagggagaggggagaaggaggcgtcgccacactgccgtccgtggagatagagaggagggttccactatttttgttatcttctggctgactaacatgtgggctccatattttttattttttattttttatattttgcttctagtgccacgtcaccttcaagtatgtagcgcccgttccgtcgtggcgcctagcgggaaaattatctcttaaaaaccctaactgcgaaatttgtttctttgcttgttgtctagtgtccgtgccatctcaagatctcaatccccgatctatcgtcgagttcaattccgaatccaaatccttccaatcaaattcctccgcaaaagtctattttgcctcccccgaggtcgatgggccgaatctcgctcggcccatcttcccctcttccccggccccctctctccccgggcgctctctctctctctctctctctctctcgcgcgctctcccatctctccccccccgctcggcctcgcccgtacgctgctcgcgcgtgcgagagccgccccgagcgcctctttccccgctcccccgctcagcctcgcccgcacgccgcgcgcgcgtgcgcgtaagccgccg

SEQ ID NO: 59246 - DNA, 1719 bp, Oryza sativa
catgcaccgcgtcccttccccgcccgcgcgcgtgcgtcgcgtgctccctccgcacggtgagccgagccgctgacaagcgggtcccacccgggaccgcgcgtggtgagcccggtccaccggctctctctgtcctccctcccgcgcgcgcgcgagtttgggccgccttgggccggccggcccatttagctcggccagactgctccatttctcttgggccgcgccctagccgtccgagaaaagtctatattccctccctcccttcttttctttttcttttccaaaaaggatttaaataaatactttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttatttttgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttacatttgatccttcctttgttaattgttataccatgtccccttgtaaccacccagttgcgcctcgatattcgtgcactctgtgcgagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccaggtgtacggtttcccgctctcgcacttaaggaccgattcccttggaatttcatccaaacataagacaagtacgaccacatgggtggaatgggacacccctggctgagtaactagcttccacgccttccctctggccactcagacgccaggtacccttgtccgtacaacgagtctcagccagcgctgactcgcatggtcgagctttcggaggctcaggccactcagcacgacctactccttgaggcttaccgctcccttgcccgccgctacgccgctttggaggcctgtctagccgaggagggtgtcacctcagttgacactatctcttgggactcaggccgcctctgccacgccagccacctgtcctcccacagctcccgcggctctgccctcactcccagtggcccgcgctcccccagctcgcgtgcgccgtactcaccagtgtactccccctacccacacccagttagcccttcctacacccccggacacaccccagttgcttcctcccgccgtggcccacgctttatccgcaccgcgcggaagcgtgttgttggttcttccaacgtgttccgtttccactacccagctcccccaccgccagcggcccgtgctgctgctggccctcgacaggttccgccggtcccttcgcgtcagccgatcgacgtttcttcgactgaggagccgactacaggaggcagccaggccgacgaggagtagaggaggcagtcttcagcagccgtccgtgtgataggcccttttgttccgccaccaactcttttggagtcgtggcgaggtagtgcgt

SEQ ID NO: 59247 - DNA, 19668 bp, Oryza sativa
ctcggctggcgcggcgcttgcggtcaaggagcggcaggtggtgacagcggctgtggtcggggaaaaaggcgaaaaggggagggaaaagagcttggctcccttgccactttgggaggaaggaggaaggagggagagagaacgagggagaggagcacgagctctgtctcttggttttggaaggatgcggcatggaggcatcggggccgagcgatgatagcggcgatgacggctaaaggcgagcggggccgggcggctgcgcggcgcaggcgcggggacaggcggcgtctgggctgacgtggcggcaaccgggcggtcagccacgcgcgagcgcgcaggaacgagcgaaggcggtgcagatttgagcggcgttggcgggaatcgacgccggggagagagagagcgaacggagagggagagaaaaggcagagaggcgggagctctcttcctctctcagctctgctgagtgaccacgtgcagcgcacgtgagagagaagggcagaggggagagatgggccgagggaggggattcggcccacgaacctgagggatgaaaattagacttttgcttagaatttgagttggagagaatttggattgggaatggaatttggatatctttcgagttggtacaagtatttggcgagaattcaaagagaggaattgaatttcggaatttgatctcggtgacttgaatcaggattggaaatttgaggtggaggatttcgattttgatgagagggggcaacgggatttgaattgagatcctggcacgacttagactctcacacaaagaacgaaaattttcgcaattaggattttgccgaattagtttttaacgcctcacgaaaagcggagcgttacaatagctcatagccgaaatatttgaccgaataaattaatatacggtcttgatttccgttggtatgctactgtgtgtatgtagcaaaaatttacaaaaactgaaacttcctagtgatagccgatgcaaattgaatcggctttgattttttctttttcggtaacagcgtgcagcaagaacagaactgtttctgtctcgtgtgtattgttagcgatgctactccacgtgacaaacgtataaagaggtgtcacactctcgcagcggcggtggacggtttacggtgcaaaccgacaaagatggactaaaactagggtaaaataaaaaacatagtaaaagaacgattgaagtaagcggcgacgaggtggagaggcggcggctcctctcccgacgatgatgatgactgtcgcgaccaagatgactaccgcgaccacgacgacgactgccgcgaggacgactactgccgcgacaccgacgccgacgcctatgggggcggcggtggatgaaggaggagagccattgtcggctggagggggaggctggcagcggtgcgtttttttatttgctgaaatgtttttttgcaggcgggtgaatctatcgcctacgaagatatcgtccgagggcccgcatgcgaaaatcatctatttttgcaggtctttgcttgcaaaaagaatgcccgtccgcctggaaagatggatttggcccgccagcaaataccttttttttaaaggagtgagagcaaactatgatgacaaagctcagctagataaaaaaaatgtgagcctagagctaaattagtcaatttttatttgaagctcagttgtgtgttttcgcttttactttttaacaaatacgcaataggaagcaaggataaaaatgtattttcaaaacagggcaaatatttgtcatattttgcaaaatctcagtcaaaacaagttgcgaatacacgagtgctgttcaaaattgaggcaaaaatgcaattgtaaaaaagggtaaaaatgtctttttcatgctcaacttaacatggttatgttgtgaaacaaatctctaggagataagtctcttatgggccaatctgaaccagagtagagataagatatatctcttcctaagacccatatatatacaggggcagggtgagacatatgagattggcttgtactcagatgagatctataatgaagagagagctacaacctatatatgtgttcattgtctacttctgcaatgttcttgagggcaaagggatgggcctactgctatgggagggacagggaacggatctggtgatccgctaataggcatgttggtttacaacaggttaaactcaccatatattcaaactaggggcagaactctgcttcatttcaaaaaaaagcagggaaataccctaaaaagttagggcaaaattatcattatcggtaaatataggatagctccgaattctgaaggactacttacatatatagttttagagctaccccgagggctcaagccacatgcctggctttgccactgtatgataatgcaaagctcgttcttttgtgtgtaagggtgtatacaatgattcttgagtgtgttttggtctaggaaaaaaatacattgtaccaattggattatctcttgagtgtaaatacaatgtaatatatttgtaccaattgaagtttcttgtcttagataattgaaaaaaatgtttttgcttaaaagaaatcacaaccacttatattccataattcacttaatagagaacatataaaaactaggatataactagacaataactaataataccaatacaaaatagagaaacatgtattcaagtctgtttgtaaatctccatccgaggctgggaaatatctgcatgaccgttttctctagatttcgacccacagtatgtattagttccttgtcatcatcacaattttgtagttatgtccaaaattgaaaccaatacattgtcctaaatagtgtctggatataagatttcatttagaatttatcaaaaatcatatcatttctacgaggcaatgttttaccactatgtggccacagacttgcagaagactgcagcagtcttgcatgctattgttgttgtcaaccaaccaataaaaaaccttgaaggttttctttattcatgaagcataccatcatcaaaaccataacgccgtatgtcacaaaaaacacgcgcgcgcacacacactaatgcgacatacggagaacgttaacatacatccagcattattagagcattgctcacctgcagctccatgtttatttatattggaagctgctagttcggaaagcaggtaagcggatacaccggcgacttgttaggatagaagaggccaaagttcctctcggtgagatccccgttcttctggttctcgttgaacatggcgaatatgtcactggtagagaaatcgtttgtagtcccggttcgtaactcccctttagtcccggttgtccaaccgggactatgaatccgggactaaagatagcgatctttagtcccgagtaaaataaccggaactaaagatcgatctttagtcccggttggtaacacgaaccgggactaaagatcggtcagccacgtggccggctgatccatctttaactgggactaaagatctatgtaccatttttttttatttacatggccctgtttgctgcatggttgattatatatatatatatatatatatatatatatgcgtatgtatatatgtataaatacatatattacacacatatttataatttaaagcacttaacatttaacattttatgtacatatatattaccaaaatatatattaacactaaagtaaatgtacgtacatatatatacatatatatatatatacatatatatatatacatatatatatatatatatacatatatatatatatatatacatatatatatatatatatatatgcatatatagtacaattcatttgctcgctagctatagctacgacttcgacgccggtgttacgtcagaagaggaaggaccgacgttatgaattgtcgatccgtcgtagtagaattcaccatcgggattaaggacttcttcgttgatgaaccccatcagttgttcttgaacagccgtgataaattccttatgtgggagtttttccctcatgtgaatacgctatcattcgaaaaataatgacatatcaatatatgaaattaataaacaacttaacaaatcgatacgcaatgaaattttaaatggtttatgtatacgtacatcgagctctcgtgtggtgtatatttggtttgataggcagtgggcatactcgcatacgtagtagccgcataagttagttcccttatcctgctttgcacactacatgagaaacgatgagagatttaatatactctttatattaactgtaactagagattcaattcaatataattttggatcatgcatgtactcactggaaaatgaaacctcgatccaagtttttctttccaagtcccgcggaccaattgacggaaccgatcccaagccctacatgtgcagttgcaagctatgattaattaattattacccgagatcaacataatagcaacagagtcccgtgactttggaatagatggcattatattacctgtctatcagttggaagacctttgtcaaaaaccttctcctcgtacacagtgactctgcatgcgtccaagtcgaaaaagaacaggacccagtggaatctggaatatgcgtgagatgagataaatatcagaatgtacatgttatatgtatgggaatgaaatttgttcgaacgacaataaaaactcactctgtgttgtacgacaatagtatgaacgtcttgaaatgctgctgcgttaggagatggacgagattgtcctctgtgtctttctcgtacttgtcgagcatttcggtgttgattttccgagggtcgatgaacccagtatcgtaaaccccccgccgtcgggccctttgaatctccattctacaacaatgaaaggaaattattattgcttacatatatgccaggagctaattattgaacgaaacaaatcgaactcaaagatacttacaaaatccatgcgctcagaagagagacgtcgagggcgtcccgatggtacagatcgaagacatccttgaaatggatccatagaacatcttctccttgcaagaagtcggggtttctaatcctcgctccgaacatctctctaccattggcgctcatttccatgtaccgttcatggaatttatacatttgtgtcggtagggactgcagccgctcaggcctgacaagcggtttaccgagttcaaacttgtatgccacttccgccttcgggattggtgcgcctccaaccaacagagccacagttagaccggtgtccgaaatgaaatccgttatgccaaagtcttcgccggtcaccaacggctcgaccacttggtgtggttgttttccaagctgaggaactggattggacttcttgtaataggctttcctaagtgttcggtcatagtccgatagctttaaggcctccttgtttgcggtggatattcccttgaagaaattcttcacgctcgggttaataggtatcttcttttcaggactccgaggcttgagttgcctcttcacttctcctgccacataagcgtcaagctcctcttgactgcaaccgtacggcggctccttgtttttggtggtgtcaactttggccttcttcgttgcccttgtgctggcaggaggtggagcttggcgagaccttgtcttgggaggtgcaggcggacacggtggaggtggaggcggaggaggcggaggagccggaggagatggtgcaggaggaggtggtagaggagccggaggagatggtgcaggaggaggtggcagaggagccggaggagatggtgcaggaggagacggcggagccggaggagatggtgcacgagacgccgcttgttgcccagggaggatgatgtaccgcttgcgccatagtataatggcgtggcttgtgtctcgtagatgcgtctcaccgtctcctcctgggtagtccaactcgaggtcctcgtacacggcttccaccagctcaacttcgaccctcgagtatcctgctggaatcggccagtagtggtaagtccctgaaatgtccgttgggatggccattcccgacgccaccttcacgtgatgagaggttatctattagtaatcaacctaagcagcaacttgcggaacgtacaagtcaaaaatcatatattacatcgagcataccttgattgataagttcttgaagggaatatgcagcttacatggtgtccgttgcgtgatctcatcaacggggcaggtggtttcgtcctgggtttgcatggcgtccatgctatgtgattctacctgccccgttgaggcgcagctgctacgattgcctgatgggctgaccattggaggaggtatgtatggctggggatcgtgtgaccgatgtgctgccatgcgttcatccaccttccggaccacctcctcttgcatgctgagctcgtagctcgataccctgtactcaagatctgcaatcttcgcctcggtatctctcttgctcctcatccgactcttgtacgtgtggatgtcctccttgaatccaatcttccagggaatcacgcctttccctcgtgttcgtcctggatgctcgagagtctgtagggcgagtgacagctcgtccttctctctgtcgggttggaacgtgccatgagaagaggcttccactgcgtccgttagtcgactggcagcctcgcgtatctgatcgctgaagaccagggagccatcaactgggttaagcgttccaccgtgagcatagtaccagaacttcgatcgatctggccatttagcggtggctggttcgatacccctctcaatcattcttgcctccatctcctcccacttcggtattgcgacgctatagccacctgaccccaagtggtgatggtacttcttcttggcaacgttttacttgtttttgaccatcattgcttgcccttgttgccctgtcttgtaagcaacgaactcgtcccaatgatcccttagctttgggaatacgtcgaagttcggtgttagtcccttcaggatgtatttcttgtacagatctcccttgaaggtctagaactgttctgccattttcttaagagtccactatttcactatgttctccgtacccgcagggagcgtgaacgtcttgagcattgtggtccacaacatctctttctctgattccgggacaaagctgtcattatccccacgtgcccttgttttgctgacaggcacgttatccctcacaacccaaccgctgtggcgtacaaaaattcttggttgcttctgccggggcactaggtcggccgtctgcgtccacctcagttatgatgtgccgaccctctatcttcttcgcggcacctcgttgtctgcgtgccctcttctgtccagcggagggatgacttccactagcctcctcctcgttcccctccgcattcctctccacgttcccctcctcgttcccctctgcatccctctccacgttcccctcctcgttcaagtactggtttggatcctcgttcccctcttcttcgttccagtactggctgcttccctctgcgattgtatcgtacagtatctgttcctcatcgcgatcagccatctgttcatagaagaaatatttgctaagcgtaatattaaaactctactaattaatcttgtattaaaactcaaataatcatatatgctaagtctaagtgtcgtgtattagaaccctagataatcatatatgctaagtttaattaagtttcgaatattatatctctaataatcttatattaaatctctaacaatctctaacaatcaaatatgctaagtctaattaagttccgtatattaaacctctaataatcttatattaaatctctaacaatctctgacactcacatatgctaagtctaattaagttccgtatattaaacctctaataatcttatattaaatctctaataatcttatattaaaattgtaataatcatatatgctaagtctaacaatcttatattaaatcgctactaatcttatattaaaattgtaataatcatatatgctaagtctaacaatcttatattcaaactctaataatcttagattaaaattgtaataatcatatatgctaagtctaacaatcttatattcaaactctaataatcttatatcaaaattgtaataatcatatatgctaagtctaacaatcttatattaaatctctaataatataataatcttatattaaaactctaataatctaataatcttatattaaaactctaataatcttatattaaatctctaacaatcacttctttacatcacttgcctacgcgaattccttcgatggctagctaccacttcggcttgagggacgacaacgacgtcttctctgcaatattaccaggaaaatatattatctaaacagggccaagttacatatattgtatttcacgttttaacctatatatataatcatatatgtatgctaagtttaataatcgtttaattatcttgttcgtacacgtttcgctcgcgttcgttctcacacttttagtacaagtgcattcactttcataagcgtttcgttcacgttcgttcgcgttccttaatgtttcgttcgcgttcgttaacgtttctttaacgtttcattcgcgttcattcgcgttcggtcgcgttcgttcgcgttcggttacgttcgttaagcgttcgttcgcgttcgttcacgttcgttaagcgttcgttcgcggcggcggcgtctcgcggcggtgggggcgcggtccggcgccgtgggccggcccggcggcgtgggggcgcggcggcggcgtcgtctcgcggcggtgggggcgcggtccggcggcgtgggggcccgatggcgtcggcgtcatcggcggtggcggccgcgccgaagtcgttcgtcggcagtggcggttgaccgcggcgtggcgtagtggcgtcggcaacgagctatagctaggcacgcggcagcggtttggagagagagagagagagagagagagagagagggctatatcgagaaagagagagagagggcgggggctctcacccaagagacgcggcggcggcgtctgcggcggaggcggcgaggaccgccaggcgacggtgagagacgacggcggcgtcggcgcggggttgccctagacagtggtggcgaaggagaagccgatgctcgatctcgatggaaaaacgtcgaagtgttggtggagaagacaagggcgcaccgggaatatatatacccccggatctttactcccggttgaaccgggagtaaagatatctttagatttttaatcccggttgttgttacgaaccgggagtaaagatatctttactcccggttgttctcaccaaccgggagtaaagatattttcccgctatttccaaattctgttttaaacccggttagggttaagaaccgggtctaaagataatagcactgaatattgaatttcgttgcatatgtgtttctaaaatagtaaataatgcattaaaaattctaattaacatatgtaaatcccacatgcatgatttaaaacctttaaaaattctaataatcatatatcattagcatatgcatgatattaaattgttaaaaattctaattaacatatgtaaatcccacatgcatgatttaaaacttttaaaaattctaataatcatatatcattagcatatgcatgatattaaattgttaaaaattctaattaacatatgtaaatcccacatgcatgatttaaaattactaaaaattctaataatcatatataattagcatatgcatgatattaaattgttaaaaattctaattaacatatgtaaatcccacatgcatgatttaaaacttttaaaaattctaataatcatatataattagcacatgcatgatattaaattgttaaaaattgtaattaacatatgtaaatcccacatgcatgatttaaaacttttaaaaattctaataatcatatataattagcatatgcatgatattaaattgttaaaaattgtaattaacatatgtaaataccacatgcatgatttaaaacttttaaaaattctaataattatatatacctagcatatgcatgatttaaatttgttaatcatcatatataactagcatattcaatacatccaaaatagtttacaacaattacggcaatacatcggcggtgacggttgtccgcacgtactttctcctcactattgttccttccttgtgatcgctacgtgagtaaggggtgtcttcatttgataggaggatgctagggtcaatcgtcactgtgaaaggggattgcccatcaaactgatcgtaatcctctactccgacgatttttcttttgcctgggagaaccaagtggcgcttcggctcgtcaggccctttgcccttctttcctttgctagacatgtccttcacgtaaaaaacttgcgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatctcctcgatggcaccgtaatacatgccagttgtaccatcgtgtcccatggcatcgatatgaacagcactgttctggttcgtgctcttcatgtcttgggctcttgtgtagaatgtatacccattgatctcatatccctggaatgccgcgatcgagccagatggacccctcgccaggaaggccagttgctggttaattgtctcgttacccatgagatgttgtcgcagccatgcgaggaaagtatcaatgtgatgccgtgtaatctatgcatcggacttaccgatgtttctggcgcgaactagagtcaagtgctcctcgatgtaaggagccaccaatgaagattgttgtaaaaccgtaaaatgggctttacggaataaattgttgtctaccgtcattattgctttccttccgagagtcccctttccccttcatggcgtgattcaggtaccccgattgggcgaaggtcttcaataaattctacgcagaattcaatgacctcctttgttccataccccttggcgatgcttgcctctggacgagcacggttatgaacatacttcttcagaacgcccatgtacctctcgaaaggaaacatgttgtgtaggaacacaggcgcgagaataccgatctctttcactaggtgacaaagcagatgcgtcattatattgaaaaatgaaggtggaaatatcaactcaaagctgacaagacattgcaccacatcattctgaagggcctctaacctatccggatcgatgaccttctacgaaattgcgttcatgaaagaacatagctttgttatcgttgcccggacattgtctgggaggataccccttattataactggtagcagctgtgtcatcaacacgtgacagtcatgagactttaggtttgtgaacttcttctccttcgtgcttattattcgctttatattcgtggagtatctagatggtaccttgatgctctccaagcattgaaacatactttccttctctgccttgctaagagtgtagctggctggactcaagtaatggctgcctttctcctttggttccgagtgaaggtcgccgcgttgttccatatgtttcagatcattacgtgcttccagtgtatctttcgactttccatatacacctaggaagccaagaaggtttacgcaaaggttcttagtgaggtgcatcacgtcgattgcgtgacggacgtccaagaattcccaataggaactcccaaaatatggagttttttttccacatcgccgcgtgaccatcttcgcactctataggctggctgccaggcccctttccaaacactactttaagatctttcaccatagcaaacactgttttcccgctgtgatgtttaggcttcgtacggtggtccgccttatgttcaaagtgcttgcctttcttccgtactaggtggtttgcagcaagaaatcgacgatgacccatgtacacaaccttcctacagtgcttaagatacgtactttctgtttcatccatacagtgaatgcaagccttgtaccccttgtttgactgcccggataggttgctaagtgcaggccaatcgttgatggttatgaacagcagcgttcgtaggttaaactcctcctgtttatcctcatcccacacggggacacctttcttcttccacaacagtttaagatcttcgaccagtggtcttaggaacacatcgatgtcgttaccaggttgcttagggccttgaataataatcgacatcattatgtacttcctcttcatgcatagccaaggggggaggttgtagatacacatcgtaacgggccaagtgctatggccgctgctcatctctacaaaaggattcatgccatccgtacttaaaccaaaccgtatgtttcgtgcgtcctttccaaagtctttaaattttctgtcgatgtttcgccactgcgaaccatctgcggggtgtctcagcatcccgtcctgttgatgttcttcagcgtgccaacgcatcattctagcattccccttgttcctaaataaacgccttagccgtggtattatagggaaatactacatcaccttagtaggaattctcttcttcgttagctgcccgtcaacctcacctggatcatctcgtctaatcttgtatcgtagtgttttacaaacagggcatgcttctaggttctcgtactcctcatcgcgatataggatacaatcattcggacatgcgtgaatcttctgaacttccagtcctagagggcagactatcttcttagcctcgtacgttgtctcgggcaatttgtttctctccagaagaatgttcttgacaagtttcaataaatcgccaaatgccttgtcactaacaccattttttgccttctattgcaagaactccagagtggtatccaactttttgtgcccctgctcgcaacctgggtacaacgacgttctatggtcctctaatatattgtccaatttatgggcccccttttcactttcgcagtcctccttggcatcctgcaacatctgaccaagatcatccgcaacgtcgttataatcagcatctctgtcctcctcacccgtttgatttccttcaaatccagcgtactgagcaaagtctggaatattgtcatcttccacttcatcttcttccatttcaaccccttgctctccgtgggatgtccaacaattatagcttggaatgaaccccgactcaaacaagtggaaatgaatagtcctggatgcagaatactccttctgattcttacacttattgcatggacaacaaataaaacccttctgcttgttagcttcggccactctcaaaaaataatgcacgccgtcaataaactctttggaccgccggtcagcgtacatccattgccgatccatctacatgaaatgaaaaaaaaatcgtatacaaataatcattcgtacaataatgacagtcatataataatgataaaataatcacaaactctttcaacagtcatacaataatgacatatcattattcatacaaaaattataaaatattccaccaaataattcttatttattattttttaagttttaaattattttaattttcaatttagtttgttttcttttatttaagattaactttcactatattttcctactcaactattttataaaaccttatttagcaaataaacaaaatttctatatattctttcttttcccacacaaattttctctctcatcaacttacaacaaaattttggagacaaaaaagtgtgcaaaacatagctccaaatgtaatatgaccaaaaaaatattggaggatgaagttgctaatattttaggcacctccgatttgtatataatcaccaaagtaaattcactataaattttggcatgacctcccctcttttttaaagaaattttgaagcttgctcgggctggaggaggaagaagacatatataaaggggtgggactttagtcagatcccggtgatctttagtaccggttggtaacaccaaccgggactaaagttatgaccaaccgggactaaagatcccagggggcctgagatcaaatatgcccgttaccctttttaaccgggactaagatcggtttttattgcaaccgggattattgtggaattcggccgaccgataaaagatggtttctccaccagtgtgtacgtctccagtggcctcggcctcctgggcgtgccacgcctgacgtgatcgatcagtccctggttgtatgccctcgcgttgtccacgctcgccgcgaaccctcccgccgacggccacccgctctccgacaccaccacattcacgttccccgcgccagccttctccagcgcggcgtagatggcatgcatcatggcgtcgaacaggttggtgtaggtgagtccgttattttggtccctctctgtggggctcacccggaacgtggcgtagttgaggttgatgcacggtttatccttgtaggcgaagtaggggtagacgttggccagcagcggcgcgccggtgctcgccaggtactgagctatgccattcatgtaggtatacgcgaacacgccggcggagggagggtaatagttggcgatcacgtcggatttcaccgcggtggaaaccttgatgccgccgatgccggccgcggcaagggcggagttgacgttgcgcatggccgggaggatgctctccgtggtgccgcctaccacctcgttgccgacggcgatgtacttgatgttgacggccggatagtaggggctgatgttgtcacggacccacgcggccgcgttggaggagctggcggcgaggttggacaactggtcgccgacgtcgaggatgagggcgatgccggagttgcgcagggcgttgagagcctccttgtcggggtagtagatgcgcatccgtttgatgcccttggatatgtacatatgcaccacctcgctccgcgacgggaggttattacccaccatgccatagcacacaccgatcatttgcacggctgcacgtgcaccgcaacagttagctggagtactacaaacgtggaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcaattgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacatgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgtagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgttctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgctgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccaca

SEQ ID NO: 59248 - DNA, 7566 bp, Oryza sativa
ccacattttcagaggcgtgtggagcaaataattcacatcaacaatacgattaaaaagagagaaaaaaaatagatgctggagggataaactcttcagcatatgtgagaaactgagaaaccatgagttggtgtgctcaggcgagcatggagcgaagaacagtcgttttttcctcaaacgtttttcgtgtttacgttttccaaactgttaaatgatatattttttaaaaaaaatctatagaaaagttattttaaaatatcacaataatccatttttctattaatacttaattaactatatgctaatgagtcgttttgttttacgtgtttgggagatgagttcccaactcattgagaagaacacagccgaagtcaggccaaagttttggataatgatggccgtcgggtgactgggcggcgggaggaaaaatcggtcgctcccccctcccccgcccctgcgcacgctgatgtcgctggccccaccacaatacctgtccccacctgtaacaaatcaaccacatattttgaaaaccctctattaaggaattttggtttattttttgttccataaaaaatatttcacctagtgtacttacaaggtttcactatgtatatatctaatgttgcagtgaactgaaatattccattgcaacaaaaaatccacatattttggaaaccccctattaagggaattcgttttattttttgttccacccaaaaatgtttcacctagtgcacttataatgtttcactgtgtatggatcaaatgttgcagtgaactgaaacaatctttcgctatttgctgaaacattgtttttatataaggtgaaacaatacccaatttaaatgagtgaaacattttcgatctacttagtgaaacaattccgatatacttggtggaacatcgtgcaacatttaaaaataattcaataataagcttaaaaaaattgtcgtcggaatatatccacgtgtggtcttgttttgaagatttaattgcaacgaatttaatggtgcaatcggatcataatttggataagtaatttaagagaaaaatcagtttaaattagtttttacacgtaaatcgggcgctgacgtcagcatgacgtcagtgcccgatttttctccaaatcatcgggcgcccgagccgtaggcagcccccaaagttttattatttattaattaatcaacatttgttttacacgtgtatttctatattttgttttctcttaatgcaatggaccaaggccttatgcacaaactaggacacgggcctagtcgcccggcccaccacgtccaagtatgcctcacgctctgcctcgcgccacaggaaagaggaaaggaaaaagtccatttggactcccttaattatacgccgaatcttaagtcgtacccctcaggcctcaaccagaaaaccggataggacgactctatgaactattgaaaccagtgcaatttgactccctcggcggttttgctaatgtggtgctgacgtgacggtgttgacccgatcttcgtcccacgtggcgtctatgtggcattagaattaaaaaaaaatctgtggaacctatttgtcattaaaaaaaactgggtgatactgcaccagctggcgaaccgcaccagccggaacgcctgcccccgccatgccgcacgcggcgaccgccgagccgcagtagtggaacagcgccgccaaatcatcagcgcaacaacggtgacgtcgacgagccgggtgatgagctcctccaaatcatcaccgcgccccggcgccgccatctccatgcccaccgccgcgtgtggcgccgtggcggcagcgtccagcagcagctagttgttgccgtgcacagcgacggcatcgttgaagcgggctgtgagctgctccatctccatgctcgccgaggccaccaccgtcgacgtcgatggatcagaaagctcgaccgctggtgccgagaattgacagtcttggactctggttggcatgctcgatgatcggataaagaagggtttggcttcgtgaatcgtgatgtccgaggagatgacgtcttgcttgctccttttatggcaagaaagcgcgcgtgcgtgcgtcgctgacctgagtccgtctctgtcgtcgggggaggcagcgccgacatcccgagatggagaggccgactcctccctctcgagtgacggagacggaggggtggcccggcggcacgaagaggagctggtccgcggtagcccagaccggcggacggggacagggtcggcctagaggagagatctaggaggcgctctttctcctgctgagtcgagattgataggggtggacaggcagtggaggtcgcggaagccggcgggggtggcggcgttgcaaccggccctcgcccgcccgctgccgccgctctcgtctccggcctcctcggccgcggcggccgccaccagccatgggacgcaccgccgcagttctggccctcgcccgccgccgccgtcgctccagctctccccgcagacggcgaagggggagagaaaggggagagaaagagagataggagatccggtcgcgcggagacgcgtcgctgcatgacctgcggctcgaaggaagagagagaagggagggagaaggaggaggaagaagggttggagagggaggtgggccccacatgtcagtgggttccacaatatatttttgtatgtgaatgatagatgtgtctcacatatattttttaaattctaatgtcacgtaagcatcacgtgggacgaagaccgggtcaataccgtcacgtcagcgacacatcagcaaaatcaccctctaaaaccactgagggagtcaaattacactggtttcaatagttttgggagtcgccatatccggttttctggttgagggatatgaattagattccgcgcacaagtaagaaagtcaaagtggactttttcaaagaggaaacagccaagttggtggcatgattggacaaattatttcacacataagcagaaaactccacaaaaatttacaagccatagaagtttatgagcacagtatgagacgaaatttggagcattttttacatacagaagaaattggtgacttgcgtggtgagagcaacaccatcaatcaaagaagaaaaacaatcacggaatgatcataactggaagagattttcacattagaagagcaaggaaaaaaaaacatgttagtcggatgggacattagtcacagatcaattgtaaatatttctattctagagtgaaacaagtaccgatcaagttcatcttctactccgatgaactccatctgttttattttgttgcgttatagtactagactttaacctacactggcttggctctattaaaacaacatttatgtgatccaaaattataatcttaaataagtacttttaaatataaatctaataaattcaattttacgtcataaagattataccctaatagagcaattgttagccaaagccttgtcgtaacgaaacaaaatacatcatatattccttttgaaaacgggtgcactattttaaaatgacaaactaataaaataacacttaaacatccagttctctaattaacacaggttatcttatcaacatgtcatgctctaataactgtacgtctattgcacagctcaaatcattgtacatcatacatctggaaacccatctgaaacacactaaaaagaatttacatcacatgcctcttttagccacaatagcaagacctctacgttctttgcccaatcagacagcacaagtgaattacacagggtttgaaaagtaattctgggaacactctcttcggaggccatgtagtacccaaccagcaatgctgtcagtactaaggtgtacctttaaaaatatttaactctacgatatcggaaggaaaccgtaaaatttacatggaacatatttggtgcatatgggaagtgagggcacaggcgaaattgtcccatcacaattcttgcccatccaaatctgtcctgacagggtaatcaaggccctgtagaactggcattcttctcaaatcctcttctgagtacgcagggatgaaccaatacctcttgtcatttccaaaaacctggtaacagaacactgtttagttagctttgccttttgttaaagttatgttcacttattcacatgtggctgactgagttcagtagtgatgtcggaatggggtttttcatggcacgcaaaacaagacaagtcattagcgcacgtttaattgagtattaattattacaaacttgaaaaataggttatttgattttttttttaaagaaacttttatataaaaagttgtttttttgcaaaaagcacaccctttagcagtttgagaaagtgctaatggaaaacccggaagttgccaccccctaaactcactaccaaacagggctttaacagataagaattgcaaccttgcagtagaatgcttagcaaaaaaagaaataaaaatgaaaaagaaggcatatttcagatgttgaagataacacatagtactaacttgaattagtactagtgtactaccaggctagcggctttgctgggttatattttagtaatactggccaaagtaaccataagttaaataaatatcatggcccttgagcacctgtaaaatgccacactcgaaatgtatggaactctaaatgacgggcagcttaaaatattagaagtttggaacaatatatacaattttcacaaattagaaatagaagttcaagtaaattcttaatttgccctggaggttgatcacatcccttatctgtccttgcagaaccgctatttggataaggaaaatttggcacttgtatgggaaatgggataataaaatgaggagtgaaaatgggtggatctaccacagaagtctaaattagggggtaaaaggtccacttttgatttctgaactactctggtttacaacctgtactttaataccatttaatttacatcacacaactgttggaattggtgcaaaatgcatccaaagcagctttcttgactggttttgggttttgtggttgccacatcatcatttttttaatacagtatgtcatttattacctcatctggaaaaaaaggagcattaatttccttccgtaaattatttgccacatcagcctatgactctatgcatcatatatatgatgtcatatcatccaagaccactctctaaccatcatatacatgattttgataactggggacgttttctaattagcattggcattcagaatatgacctccctctgtcccaaaataaacaaacctagtacgggatgtgtcacaccctatactacgtttgtttattttggaacaggtggagtaaacaaaagggatagtagaggggccaaaagtatggcttccctctaaaatatctgcatttgtgcatgtcctataatcccacctcatcaaggtgtatcaagcctttaaacaaagataatttcgcgtgcgcttgcaccattacaagaagtaacagattatttaacatgttctgaaagcctaacctgaatgaaattcctcttccggccaatatcatacatccagcgtggcgtagttttcttttcatatgcctaaataaaaaaataatgtaacaaattaatctcaccttggagatatcaaaagtaagtatttaatagacattgataaatacttgagtatttaattatacattctagatacttgcctcaattgttgttgtattagcagaaacaagtgaaacatgcataatcataaaacccagaacactcaaggaaaaggccaggttcaacactgcagagaaaaagaatattataagccaatcctcagtcaaacgtgcccaagaataatttctcatgaatgaaagtaatgcaattaccaaaggtgaggaaagtggttgcaagtgctgcaggacttcctgggatatcaatatcactaaagaaggctatgaagtgaggcaatagagaaagggtaaccagtgttgtctcaaggaaggtgtaaaactgcatggaatcattaaaaacatgaactcagcttcagaaatcaaaggatcgaatagctgtgtggaagaaaaaaggatagtagtccaaaataagtcaaacgaaagcaccaccaaggcagcagcatttatactgccaatattaatatgttattatcagagaagtgaacacactaattactctgatttatatttttttgcattattttcttcactgctatataagtggaatccccaagtagatgagaaaagcaataattaatattcaacaataacacactaattactctgatgcatcaaagccacaaaagccacagaagatgcatatgcagtgggtcagcagcatgacagaggagctaccaactgtttgttggattgcgtctccattagtttagtacttaatatttggttagcttgtttattagcttgtaaacataataatatggaaacgttatgcaccagtgaccaatgacatgtccgatatcaatacatcttcaatacgcctccgatacgtatcgaccaagtattgtaaaattaaatagaaaaaaataattagttttatgttctgatacatggtcgattcatctccggcacatatgacatatgcgatatggcccggcccacatagccacatgataaatcacatccccctacacacccccaccaaagcgccatccttttaggagctaaggattgtccttgaggtacattgtacttgcttgcaatacattattgattattttagttgtaaataattgagaatttgaaagtatttttattaaaatatgtagacgtgtcgccgtatcggtatttttctgaaaatggtgaatccgcagatcggtattgtgtcgtgttgacgcatctatgtccttgcatcatagatccacccctctagctaataacatcgaatagaagaagcattttaagtattcatggtggcttaaattgattatacatttcacgtgcgtgtgtgtggtttggggtgaatggacatagtttgctgtataagatattgatttgtaaacacagtgaataaaaatagactgggcaaaatgaaaccagtctcattgcaaaaagaagggttaaagcaatacaaaaaaaaaaatctgtatagttcgctagcatcacaataaataacagactgtgaatatgttagatataccacaactccagtagttattgaacgaactttttacattttcaccgaggttgtgttacccagagtccctatgaacaatctgcgaggtattcaaacgtcattttttgcatcaacgcgcctggtgaatgatgacaccgctcgctctagctgtcaccgcacgctaccgccctaaggggaagaaggggagagaaagagagagaagggaaacagggaggagaaagcaggtatgacatgtgggccccacatgtcagtgggcccatatttatgactaatgggtcccacgcatattttttatttctatcgctacgttggtgccacgtgtaagaaagactcggtcaatattgccacgtaggtgccatgtggcaccacgtcagcaaaattgcctcccaaaaccgctcagggagttaaattgtaccggttttaggagtttgggggtcgagatatctgg

SEQ ID NO: 59249 - DNA, 2789 bp, Oryza sativa
taaggactaaataatcaaattttgaagagcatgtgcctcaccttgaagtaagtgaagcatagcagtatacgctagctaacagcctgcacctcccagtgccatgtttctccatcactaagcaagttacttttctttccagaatccaagcaaccaaaaagacaagttcagtttcttcatattgctgccatagtagtagcctcattctgcagtaaacagcacaagatactggaagggtgtcaataagagggggcatggattcaagcaagtacagatcaagaggctacacgatggcaagcagcaacaacaagaggccacctccttacctcctcctgctgctgctggcactcggcgctgcggcgctgagcgtgggcatcctgcacaagatgagggagcgccgcgtcttctccatcctcctccaggaacgcgatcagcagcttatctcccttcaagccctcctgcaggtatggatatatttctggaatatcatgcatcgaattcttatacattggccatccaggaagttgtagccaaaaaatagtctagcattatatattttttaatcaacacatcatgttcacataatacaagtactgaaataaattcaagctcccctaagaggctagaagctgtactcccggagaatgtgaatgtgtactcggtatccctgtgcatattaatattccctccgtattttaatgtatgacgccgttgacttttcgaccaacgtttgaccattcgttttattcaaaatttttgtgcaaatatgaaaatatttatgtcatgcttaagaacatttgatgacaaatcaagtcataataaaataaatgataattacataaattttttgaataagacgaatggtcaaacgttggacaaaaaatcaacgacgtcatacattaaaatatggaggtagtagatgaagtatacacctcaccctgcactactgcactcacaaaagttatgtaaagcccaagctgtgtaatctggaactaaaattcaaacttgccaaagacttccatactgacagcgttccagagaaacttcgagctagatacatcatatcagaaatccggagtattactttcaaatagacagagatatatactcaactgaacatcctcttagttcaatctataatcattccgaaaggtaaacactgcaataccagtagcattctagatttttttttagataatagatacaagcactctagatatgtaaaacttaagaatgtatgcctttcagttactgggttctataatcattttttgggtcagttcagatacctgatctttgaattccataatatatcgttaatcacatagtaatgttttattttgccagaaagaacaagaaatcagtaaagagatgaggagaaagatggatgaattagaagccaaaacatctgtcctaagcattgagaggacagaactgaaaaacaagctcatggattctgaaaccaccacgacatatctcacaaatacccagaaagagctggaagcggctctagtggaaaaagagggtcatatcaaccaaatgaaagagaatgcggctgcttcaggccctgaacaaatggcagctataaaggaacttctgcagcaaaaagaagctgagcttgaagagatcaagaccaagttgcacgactacaagaaatcagatacaaatatcagcgagagcattttggttggcacaaacaatgagaatacaacttctgacacagcggtacctgagaattctgcaaaccctggtgactctgctccagcagaagaacatcattcttacgacaatagtgcgtcagagagtaaccaagatgagagcactggagcaagcacaaacaacgaaaatgcaactgttgatactgtggtggtcgataagtatgcaaactcagtgagtatgcaactagtgattccacacctgctactacagaagaaccgcatccctacaacaccactgcatcagagagcaaccctcaagaaaatagttccccagaacaacactttataaagcttagaactaacagggaagatgatgaaccacaagacaaaacaacaggtgatgccaatgataattcaaatgatgctctagagggaagccacttggggaaatctgaacttcctcagtggagccccaaattggcagatagtcaagataatagcacagaagaactagatagcactagacagttggagaactcacaaggtgaggccaactatgaaagcagaggcagtaatctgctggagaaagaggtggaagccagcaacgaagttgaaccaatgaaggaaaccagtcctgagactgagctggagacttcgaaggatagcttgagtgaagccaaccaaaacagtacacaggctgttgaacctgtggctgatcctgcagatgtgaagccccgtatgcccatatataatgatgaaacaaaagagacaagcaagagacgtaggcggagaaagtttagatccagaaggaaaaagaggaccaatgctccttctaccaatgttgatggagaagtcaccaaagtaaggtagccacagcaaaaccaaaaagatacttggatttggaaaatgactgcaatgcaatgatgaatcataaaaggtatagataggaaaactgcaaaacaattcaaaagagatgacccagatagctgccatatgctaaatagccctgaagagaaggaaaagaaaataatagctaagcagctgcagttaccagatcgtagcctatggcagcacaaataatatttctgttctgaatatcacactttgtttcgtgtaaacactttcaagcacgac

SEQ ID NO: 59250 - DNA, 12036 bp, Oryza sativa
cagcgataaagttgtgtagttgacgacaacaaacgcaaccgacatgatgaagatgacgatgtcggtgatccagccaatagcagtgtagcaaccaatgaaaatgacaaagacgctcatcagcatttgcatagtaggtcaaccgtgaaggtgaaataataagtcagcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgttcaagtagaaatcctaaatattggagagcctcttgttgtagtaaaataacatggcatcgcatgccgagatgtcgaggctcacaaagacgtcgtggttggtgaagtagcaaaacttgcgaagtagcatcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagttgtataaaccagatgtagaagcgagggcactagtcagcagcagacgagacgaccggcgatgaagatggtaaggccaatcaacactggcagaatcatgcagccatggaagtgaagaaaacagtcggcagccatggcaaatgtaggcagcttgtgttgaagatactgatgcctattagtagtgacagcgatgtagccagccgtgaagaagatagcatcagttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcggccggttggtgaagacgtagacgcccaacaacggcggcataataagtcagccgtgcaggcggaaacaccagtcggcggcggcgaaggcaagccggtcggtgaagacgtagacgcccaacaacggcggcataataggtcagccgtgcaggcggaagcaccagtcggcggcggcgaaggcaagccggtcggtgaagacgtagacgcccaacaacggcggcattaaaggccagccgtgcaggcggaaacaccagtcggcggcggcgaaggcaagccggtcggtgaagtcgtagacgcccaacaacggcggcataataagtcagccgtgcaggcggaagcaccagtcggcggcggcgaaggcaagccggtcggtgaagtcgtagacgcccaacaacggcggcataataagtcagccgtgcaggcggaagcaccagtcggcggcagacgaggcggccggttggtgatgttctgactgatccattcctggagcgtaagagataagcttaaaaccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacactctgcccgactaatcatagccaccaagcactgggagtcggcctaagcacttcccaaacatgcatatgagtgtcatgagttcgtcattaatggaacaaagtttcacggatcggagtttactactcgggtacttttgcaattattaagagcagaaaataaatttatctcatctctatgcttttgatttattccgaatagtacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaaatatcatataaagaataaaataaatgatgacttagctttgtaatattccccttggtgatggcagaagtggccaatgtgggaacaaagtcgtccatcaataacaatgaagacaccagttggcggcgacgaaggcggtcgacggtgaaagcgaagatgcccactaatggcggcatgataggtcagccgtgtaagcggaaacaccagtcgacggcaacgaaggtgagccaacggtgaggatgtagacatccaacaacggcggcataataataggccagctgtgtaggcggaggcaccactcggcggcgacggaggcaggccggtggtgaagtcgtagacgcctaacagcggcggcataataggccagccgtgtaggcggaggcaccactcggcggcgacggaggcaggccggcggtgaagtcgtagacgcccaacagcggcggcataataggccagccgtgtaggcagagacaccagtcggcggcggcggaggcaagccggtcggtgaagacgtagacgcccaacaacggcggcttgatatgccagctgtatgttgatctgctgaatcaactcatgcatgcatgaaatttctccgagcaagctataggcggctgctcccatgtgcccgtggtggcgtggtggccgcaacgcatccgtcggcgctgctcccgactgaagatttgagccatcgagattaatctcgccgtttcttctgtagtcgattccatcacacttttcgatgggtaattcgacgcagcccctacctggcgcgccaactgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacaaggggactgcagcagcggcggcggggggtggaacggcgatggcagcaccgccgtgagctatagctgggtgagggcgagagggggatcgcgacaggtggaatggcgatgctgacaagatcgatctagggcaccgccgtgagcaagagccggcgcatctcgatcccctttgtctcactgatctaaagaatgacccaggggcacattggtcacaacactcgcgattcggtgtgttaatccggtgaaattggaaaaacggcgaagcagcgtgttgtgcgagcgtggcgatagcattttagcgaaacaacttggcggaatggcattacagcgaaacccatccttacatgtggctaaatgtcaattttctcggacaatgcaccatgaaaaaagaaaagaaaagccattggttcattcactcgctgtttgttgatgctttttctcttggccaacaaaaatcacctaacgatttgcggtgtaatcgacggtgttgtcaatatcgatagatcaaaatttcaagattaattcactttcgtggaatcaaacgactaatttatgagcaaattagcaaataagagaaatatcgtacttacatgacgagaaatatcggaattacgttacgacaaacgagtagtttccgagcaaactagcaaaggataacctcctcgctttcgtggagaaacacaaccatttttcagtgcaaaacaacaaagattaaccaaatcctcttagccataaaaacaaaatagaaaatatcatatctctactacttaaaaaataagagatgcttccatcgtccgtcaaaaaaactggcgaaaaaaaaaccgggcgagcgaggaaaaaaaccaaaacagggcgagcgaggaaaaaaaccgggccaaaaaaaccgtaactgtccggcgaaaaaaataattcgattctgtgaaaaaaatacaaagtgtttccttcgtccgtgtaaaaaaagtccgactgtaaaaaaaaaaaaggccagcgcgaaaaaaaataggaagggtgaaaaaaagggcggcgagaaaaaaaaagcggcaaaaaaagaccgattccgacgcggcaaaaaaaacgtaaaaaaggtaaaaaaaaaaaggccagcgcgaaaaaaaataggaagggtgaaaaaaagggcggcgagaaaaaaaaaagcggcaaaaaaagaccgattccgacgcggcaaaaaaaaacgtaaaaaaggcaaaaaaaaaaaagaagcgccccaaaaaatcatctgattcctattcctatcgtaccataaaatttaaaaaaagggcagaaaaatgcaaaaaaaaaaagaggcgcagcaaaaaaaaaaagaagtcctatttctattcaacacggaaaaaaattaaccgcctttgaaaaccgattcgataccccaccatgacaaaaaaaacaagtttccatctaaaaaaggttcagcataacataaaaaaaatctgactatagaaaaaaaaatcaacactccaaattggctgtaaatcaaccgaacaggagttggtttaaatcgtaccaagtcctattcagcacacatcaggagatcaaaaccatatatctctatctcttctctactacttaaaaagatatgcttccatcgtccgtcaaaaaaaccgggcgagcgaggaaaaaaaccgggcaaaaaaaaaccgtaactgtctggcgaaaaaaataattcgattccgtgaaaaaaagggcgacaaaaaaccggcgaaaaaaaccaaatgaaaaaaaccgtaactgtccaataaaaaagggcaaaaaaaagtccgattctgtgaaaaagggcgacaaaaaaaccgccccaaaaaaacggacgagcgagaaaaaaaaccgtaaatgtccgatcccaaaaaaagggcgaaaaaataatccgattccatgttaaaaaagcgaaaaaaaatctctatctctatctctgtctctactacttaaaaaataataaaagatgtttccttcgtctgtaaaaaaaaaagctaaaaaaaaaggtccgactcctatccgattccctctcagaaacaaaaaaaaagtccgactatagatccgattcttaatctataccgtgatatctcacatatcttggtgaaacaaaatgatgtgccggattagagatctgtttaataaaacagaacctacaggtcgagagcattccatttttatatgattttaatttttgggtttgtacttttgcttttgagtccctataatttttatatttatatttgagttcctataatcttgcaataaggtacttggggccgtttttgttaaaaataataataaaagagagaacaaaagcagaaaggtgcataaaaagaaaaaggaaagctgcaaaaaaaaaagaaaaacaacaacaacaaaagttctgtttcccctatgtggcaaaaaaaaaccgtagatccgaacgaaaaaaaatctgattcctataaaaggcaaaaaaaagtgaaaaaaaatactagattcgattccgttaaaaacaggaaaaaaagtcggattcctataaaggtgaaaaaaaacagaaaaaaaatctaaaaaagtttgtccgattccataagaaagtggcgaaaaaaatggttcgtaaaaaataaaacgcttgttcgtataaaataaaaaatgcacacaggaaaaaaatggaaagggcgaaatttctaatcaatatatatctcttctctatctctaatataatctaactattttttaaaaaaaaatgcacgagagaatagaaacggttcaaacaaacgcgtgagaaaaaagtcagaaaaagcgcaaaaaaacacgctaaaaaggttttccatcttccataaataaataaaaaaacgcgcgaggaaaattatttccatcatcggtaacttttttaaaaaataaaacatgcaaggaaaaaactgtcagaaaaaacgcgccattttaacaaatggttttaaaaaaccgcgcaagaaaaaaacaccgtctattaaaaaaatcgctctgagtcggataggatccatcgattttttgccacctactacacggcttttatttcgtctatattctcttgtttttaaaaaaagcaacaaaaataacatttgaaaaaaaacaagcaaaaaaacacgcgagaaaataattggcaaaaaaaggcaaaaaacacacgagaaaagaaaagcaaaaaatagagaaaaatatggttttcattgtaaataaaaaagcaaaaagatcatgttagaaaaatcttttagaaagaaatgcgtcatttctgaatggtttgagaaaatcgcgcaagaaaaaaacaccgttcgtaaaaaacaagccgctcattaaaatacaaacattgccattgacatgattatttatgaaaaacgtatattatcattagaattttttcacccgttgcaacgcacgggcatttttgctagtaaaaataaaaagaggaaaatagtagattgataatattgttcggcggggtcctttctgccgacgccttgactaactttaaagcgccgcaggccgcatcaacgatctccttttttctgctccgtgggcccatccttccttcctatccggactggtataccgcatgcaatcaatcaggttgataatcctctataatctcgtaccgttccatgattccatctgatcatccctgttgcttcatccaaaattccaaatcatgtgcacgctattagtgctgctctccattctgcaccatctgcctgtgatgtgctacaatagaaacctgctcagcggcatccgcatagtccacatacatatatacatatatatattcctagctatttgtttttaatgtataatttaaccgttataatttcatttagcccgcatagtgtctcagccaatttaaaacattggttgctgctatagcatttgcacgttgcactttgctttctcatactaaattagtaataacacaaataggaccaagcagaaataggaaaaatgaaggtaaatctggataagtacgatatcttatggtgaaaaccatattgatatcctgtatttctgtaaaataaataataatcgggaaaaactaaataacaaatatgaagtgaaagattcgatgagaatttgtaatactaagaaccgttttttcaaatatgcactttagtctataactttttggttaatgaaatcgcaacaattttgaggaaacataactttaaattttataatagaatatctaaggaaaaagtatgaattacccccctaaactatcgcggtcgaccgaattaccccctaaatctgaaaaccagacatcactcacctcgaactttcaataccggacgaattacccccactggcacaatccaaagcggttttatcctacgtgacgtacacgtggcaatccagtcagcatttcctttttttttaaaaaaatggtggggcccacctgtcatctcacctcctccttctcctcttcccctctctctctctctctctccccccttctctcggcgagcacggcagctcgcggctctacgccggcctcagctacgcctgctacgcgtcatcggccacctccccgtccaccaacggccacgttcgtcttctcccgcgcggcgccgccgccgacgacctgtacgccacgggctgcttcacctactgcgccgagctcacgccgacggcgcgccgtgcaccgggacgggttgttgccaggtccccatctcgccggacatcccctacctcggcgcggtgttccacaccggcaactggacgaacaccgcgggcggttcacactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatctgtgacggcttgcacttgtaacccgtcacagatcgtctgtgacgggtcacaaccatggctcgtcacacatgacatgtcatctgtgacgggtgtagtattatgaaccatcacaaaagagaccactcatctctgacgggtcttttaactaacacacgtcacagataacgttatctctgacgggtggtagttatgacccgtcagtgatgagtgaaaattcaaatttttaaattttgcaaaaaaacctcggattgaaacatgtcctatataaaagttgtagctcttaatgatatccacaactttataactaacaacatttctattagagatcatttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataataacattgggttagtagtcaatatgtgttaagtaggtgagttggtaagggagctctatatggaggttgaggtcttgagttcgaatctcacttgtagcatccaagttatattgcgtgaaaaattgtgaatttgtaggtagtgatgtgtaaccatgtataggatggctagtaaaattcaaaatatttttttgaggttttttgttgcgtttaaaattcaaaaattgtatttcttgctttgtcatcagtgacgggtcgtaagttacaacccgtcagagatgagtcatcagtgacggtcaggtgggtacgacacgtcactgatgactcatctgtgacgggtgacaagttttaacccgtcagagatgacttatataccggtcagagatgggttatctgtgacgggtgtttcatccgtcacaggtgattttgtcatcagtgaccactaatcactgaccaagaccaaacccgtcaaaggtgagggtttgggcccgtcagagatgacctggtccggcgtagtgtcaacccgtgcttctaagccatcggcatgctcgtgtactacaacgagaccttggatgccggccgtggcatccccgtggacgtcgacgtgtgcgctcaggtcgccggcggcgagctagaggtcgtacaccatacggaggaggtgccgaagctcgtagttgtcggcgcgggtgagcacgccgatgagaaggcggaagtcgggcttccgcgacgccgtgtacgcccccggtgtcgccgggccgcacgagctcatcatgagcgcctggacggtgggaaggaggatcctgccgccatctcgctccacgtcccgccgccctcgccctctctgccgccgctgccatcggagccgaccgagcgctaccccgacgtctagtacgccgcgtcctcggctcctcgcccgccgcccacagccgcctccgcccccgcccaccgccggcctcggctccttgcccgccgctcgcagccgccttctgttcactgagagagagaggggcaaaggaggaggagagagaggggcagagaaggagagaaacaacaagcgctgaaaggtgggccccaccattgcttttgctgactgtattgtcatgagtgtgccatgtaggctgaaaaccggttcgaatcgatttagggttgtaatttatccggttttgagagtttgggatgttaaatgtctagtattatggtttagggggtaaatcgtactaccgcaatagttcgaggggtaattcgtactttccaatatggaaatatctaactatttgccaaactattggtcatcattaattacaatcttaatttggttgttctcataattctttggaaacagaaaattaaattccattaatatattactctgtatgtttcaaaatattactggtcattctcacatttaaaattattaatttagatcgtggtcttctatcttcacattttatcaatgccatgtacaactgttaatcaaagttaatattgcttttgagaacgattataatgtagttaataagcatagcagtgtaatttgcacatctcctagtttgatgtgaaattttgctagaatgacaaataatataaaatgagatatatgcaaatttaatatatattttgcagatgagccatattacaggctaaattaggcggcacgtcaacagggcgtgcagatcttctagtatctactaatctaaagctagcacttcttgtgccaacgggacatttaactatttaccactatttggtttgacaattatcaaatacccttcttatatttgcacatgcattggtagtgcataaacttgttagatgggtacaatttagtacataatcttgtaaaatgctcgtttcggtacacgaacttgtctagttttgtgcaaacgagggccaaaatagcttggcaatattaatcttacgaagttgatattgattagggtgtgacatgcatatgtatagtgcgtttgcataagactgcaattatttataaatttgatctctactttatccttcatcaaggaagtgatgatatttcatatctttcccaccctagcttatatcattgctctttttttaatctttttctacaatcacaaaaacaataagattatccatgtagtgttcttttcgccttcctccgcacgcacctgacaagttcatgcactagaacaagcgttttataagttcgtacactagattgctaccacctaacaagttcatgtacggcgatgcaatttactcttttttttttcaatccccttctccaaatcgaaccaactctagaaaggggagaaggagctgtcgtttacatggaatgacagaagtggatatcgatctccgtggtgccatggtgtgctatccacacgtttgatccgttgcatgatagcccttctacacagaactcttggataactattacagactttcccattgataagaattgttcggtatagtgaagcagggtttctagatgctttactggtcgaaaaaatggattagatatcgcagctctttttctccttgctagaaaaataatttctggtagccaatatccaaccccttccattttaatacatcaatatacactaccggagaattgatatttgtccggatgataaaaatcgcattagtctcgattcgaataggaacagagacataagaatgtgtttagtcccggttcaaaagaccaatagaattttttgattctttagttccagttggtaacatcaaccagaactagagatcattttttatgtcctggttcaaaaattgttaggcctcccactatctttagtcccggttgtctaaaccaaccggaacgaaaaattaaaaac

SEQ ID NO: 59251 - DNA, 10927 bp, Oryza sativa
aattaaatagaaaaaaataattagttttatgttctgatacatggtcgattcatctccggcacatatgacatatgcgatatggcccggcccacatagccacatgataaatcacatccccctacacacccccaccaaagcgccatccttttaggagctaaggattgtccttgaggtacattgtacttgcttgcaatacattattgattattttagttgtaaataattgagaatttgaaagtatttttattaaaatatgtagacgtgtcgccgtatcggtatttttctgaaaatggtgaatccgcagatcggtattgtgtcgtgttgacgcatctatgtccttgcatcatagatccacccctctagctaataacatcgaatagaagaagcattttaagtattcatggtggcttaaattgattatacatttcacgtgcgtgtgtgtggtttggggtggatggacatagtttgctgtataagatcttgatttgtcaacacagtgcataaaaatagactgggcaaaatgaaaccagtctcattgcaaaagatagggttaaagcaataacaaaaaaaaaatctgcatatttcactagcatgacaataaataacagcctgtgaatatgttaaaaataacaaaactccaaagcctatctcccttctaaacacatcctaagaaatatatcaattacagtaatatcataccaggaagagaagaaagtatttgtagtttagtgccccaacacaattaacaacccatacacaatgatgatccatcttaagaacacatcttccacctgaaaccatgattagtgataaatacacaatattgttgactatacaattcataataactagaacaacaaaaaattgatcctgaagaataaatcaacaacttacaaacagagcaatgatggcatcgaggtggcttcatctggttgcacttcctacaatacctagcccttggatgtcctgtgtcattgtgagcgatagattgttgcgagtttacctggctattgaaatctaagccagaaaggggggcagtttctcccctctcctcatcaaagtcgagattccaatttggtggaacagaaccagggtcggtgaatacaacagaaaagtagctccataaaagcataacaagctacaatgagaaataaactaattagtgtcaaaagcaaatatgcgggaaaaaattgaaacggtgcgaaaatgtttaatattacagggctaatgtttatagtcaactattcttcgcatccaatttttgagttaatattgtgattcttaatcattatagcatcaatattgcattttgttcacctcattttgcactttcctttcttaacttctcagtacaatccatccgcatttcaacaatgtgggtagtgtatatcaggaaacatctaatatgttgtcaagaagcatgataggaaaataaatactagaccatggacataacagctcaattgtccgaacatgtatccagctcactcgtagccactcctacttagtacaaaaaatctgaggaaatacaacgagggctacttagtactgattggtatcagggctacttagtactaattggtatcaaaataaaggtggaaaaaaacaaaatcaaaacagtgcgaatatgtccaatataacgggggctagtatttataatcaactatttcgggcaaggaaacttcagttaacattgcggttctctaatcaatatagcatcaacattgcattttatcaactcattctgccgcttttttatccttaaatctatcactgcaacccatatccatttcaacaatgtagcaagcatacatcataggcaaatcatgtattttgtccagaaacatatattaggaaaataattacttataccatggcaacaacagatcaatttatcggcaaatccagtattttgtacagaagcatatattaggcaaacaattactagatcacggtcgctatagatcaatttatccaaatcagtatccagcctgcatatagccactccaaccaagtaccccaaaaaaaaacaaccaacacagataacaaaattttcgacctgtatcctaacattgctccaaaaacactcaatctctcgtctacttgcgagattcgacccaaccagctaatcgttttcaccgtttttgacacccaaaccccccccccccccccttaagagttcgagccaatagttaccaggaagtggaagaggagcaggacgacgagcgcgaggagggtgctggcgccgccggcgaagagcgcggggccgtagttgtacaccacgaccgcgtagtaggtgaccccgacgatggagaggacgagcaggatcatgatggagcccagccccctcagcgcagtgcagaacctgaacacgttccacgccatcgtggcgcccgcggatctgtgcatctctccccacctcccccgcccgcgcagcagcagcagccgacgcacgcctccgccgccctgcggctccccgctggcgaggggattagggaagaaggcgccgccgccgccgccgcgcttcgccggcgagggggattagggaagaaggatttggagatggaagaagacaggggaatggcaaaggttagaggtggagtacgcgggcggtcaggtcgtcttctctcagctccgcgtttttactttgaaaaagaaatcgcacaaaaaagatcgtttagagggatttctagatgaaccataaaagaaaattgaaactaaattaaaattgttgggtaagggttaactgaaaatagtcaaatttgttcaaatcggaatcggttagaacttaggattatctgattatgattcggtgaggtttcagtaccaaactttttttttaaaaaaaagacatatgactatatgagtgggtattttatggaaaccgtttggctatgccggtgccgccggcgctcgtaggatggagatcggtgcagatggtgaattcaaattcgagacaaaagtgtgatggaagcggaataatatacccgcatcattgctggtggtaggatggagattgatgcgcgcagcgagcgaggagacgggagtcgaggttgagaggatggggaaggtcgattgggtggctagggtggtgacatgggtcaacaggtccgttggtggaaaaagtcccatttgtatccctcgatgattctttatagtaactctggttaacaataccttgttgaaaatgtaaaaagttcggtcaatagttactccttacagactaccggctcctactccaacagtccaaccatactttgagttgtagaactgttcttgtgtaattgtgtttttcttttagctaggtgatattgtccaactatcttgtggttagtattaatccatcattcacactagaattaaaaaggattttttttatttgcacgtttcccaagatacattttatgcaaaaaaaaatcctatatatctattatattattaaaaagccttaaaatgaggtaccacgttcgctgtgtgggctataaattcccacattaatcggagaaaaagaaaaaaaaaggagagtccaagtaaaaatacaatctaaaaatagctgaaattcggaattaaaaataagcaatattgaaagaagtttccatataagaactcaatacgagattaattaaaattagaaataaaaataaaataaaataaaatccaaaattagaaaaggaaaggagaatccaagtagaaatacaatttaaaaatagctgaaattcggaattaaaaataagcaatattgaaagaagtttccatataagaatccaatactagattaatcaaaattcgaaataaaaataaaataaaatctaatattagaaaagaaaatgagagtccaagtaggaatacaatttaaaaatagctgaaattcagaattaaaaataagaaatattaaaataagagtccatgtcagaacctaatacgagattaattaaaattcggaataaaaataaataaatccaaaattagcaaaagaaaataaaagaagagttcaagtaggaatacaatttaaatttggctgaaattcggaattaaaaataagaaatattgaaagaagaatccatataagaacccaatacgagattaattaaaatttagaataaaaaataaaataatatccaaaattagaaaaaataaaagagagttcaaggaatacaattttgaaacaactgaaattgaaaataaaaaataaaaaacattaaaagaacacaatacggtattaactattttttaaaaaagatgaaattagaaaaagaaaaataagatttcaattaggaatacaatttataaataactaaaatttgtgataaaaataaatattattgaaagaaaagaccatctaaaacacatgacgagataaattaagtaacatgcctataaaggagtagagtggtggcggttgatacgacatataaaaattgttaataaaacaccaaatagaatcctaatgacgattaaaaggagaaacgtcaggcaggccgtgaagcaaacgagtaaagcagttgccaagacttctagaaagttaaaaaaaaaaaccccattgataatcatattcgattttaaaatcttaatgacaataaaaaggagaagcagcaggctgagtgtataagagtatagttgcagagcctgtaactatagaaaataaaaaatgaattccaacgatagttatgtttaatttttagaatcacaatgataataaagagtaggcggcatacgggttgtagaggggcatagtggcatcgtttgatgggacttctaaaaattataaaagaatgaaactacaagtccaatttttaaaggttcggaacttctaaaagtaaaaaaaaacctatgataatcatgttcgattttaaaatctcaatgacaataaagaaaggaggcaaagggcgagccgtagaggagtacaatggcaaagccgctaatggtttggcgggacttctagaaactaaaaatgaacccaaacgataattatgttcgatttttaaattctcaatgacaataaagagaagagacagtggacgggccgcagaggagtataatgacaacatttgacgggactctagaagttataaaaatgaaacccaacgtgacaataaactctaaaaactgtaaaatccgatttttaaagctttcaagaagaataaatagaaaatagtggtagatcgagcaagcaaataaagaaggagatgacataagaggtagcaaccggtgtgacttttaaaaactatataattagaaacacgaggatgataaggtttggtctttcaaagtcttaagacaacgagatatctattcaataaatttaagtaaaatcatacttaaaaaataatatgattttgtttgggtgctagccgcgcaattgcgcgggccacccagctagtttctgaaaaaacaaagaaatttagttttcaaatattctacgaaaagtttttagataatctttgaccctccacgtgttaaaaaaattaaaaataaacataaactacctactcacttctttcgttaaaagtatatttttaaaaaataaatctcatcactaaaaattctattttatgatcgttatgttctactccctccgttttttaatacatgacgccgttgattttttctcacatgtttgaccattcgtcttatttaaaaaatttacgtaattataatttattttgttatgagttgttttatcactcatagtactttaagtgtgatttatatcttatacatttgcataaaatttttgaataagacgaatggtcaaacatgtaagaaaaagtcaacggcgtcatctattaaaaaacgaagttagtataatataaaagattttaaagagatataatataatcatataatataaaagattttaaagggatatatggacggagggagtagtaccggtctactcccagtctccagagacattccaagaacaaccatatgtctttcttcctttcgcaaccgtccaactcaactcctcattattccacgtacccaaagaaaaacatcccccacccaaaaaaaaaaaaaatccgcgcagctgcaaaggcgagcggagctctcaatcgagcagcggttccacttctagaagcttcttaatcacgcgggaggaaggagaggggaagcccccggcggcggcggcggtggggttcgcctgcgcgcggcgatgtcgtccgccaagtcgacgaggtcgcgcccagccgggcactccggcgtgctgccggtgaacgctacggccggaggcggcgacggcggggtgcctctcgccgacaagatgaagatcttcaagaccgacaacttcgaccccgacgcgtacgtgcagtccaagtgccacgccatgaacgagaaggtaaagggattggtccactcgtgaaacggggaggaaactggagtggtagaattttggtcggaagttcacacgcgcttttgctgttctgtgttcgagaggtgtgagggatacggtgtcgggagtttcccagtgcatttgaactagcgaaagtgtgaattgagcgttattaggattgtttcccttagagggaaaacggtggttgcatggaactagatatgtttattgtgtttgatttttttcatgttcagatactagttatgaaacgggttttttttactctgatgcggagaaatactgattctggccagtactgacaaatttctggttgcgctgcatgcttgcgtagttgaattgaggtcgaattaagtttgtcaataaccttgaatttgcatttgtctggagcttggagggagcactgaagtagagtgctgttagtttgttagttttatgttatcttctagagaagtgaccacatgtagatttacacatatttgcaaagaaccggagtttgtactatattatggcggctctggtgatgaaatgaatcgtacgcaaattttgtaagggttctttttttgttttagaaagttggcgtttattgtatatgagataaatggttgcctttaaattgcttttacctattgttttgtgcgggagaccacttgtgctcatggttgtcaaaggatttgggtagcaacgaatggatgatcctacacttctaccttttctgcatgagttatgctcacttaagacctattttgcagttgtgccgtatcatgcatgtgtgcattttctgaggcttcaaatgttgagtttcctttgcatgctccctgtgtgtgttttagagcttgaactattactttagtaaaaggcacatcatgcttggaaaatctaacaggattgatgctcaaaaactgtgacaggaaataagacacctctgttcttatctgcaagacctaaagaaggcttcttctgaagagatgcgtagaagtgtttatgcgaattatgctgcattcataaggtgtgaacacaattgttgaaattttaatctaacccaagggagtatatccctggactcagagtatcgtgtctgattattctccaatttttattctttttgtttctctaaaatgagtatgcctgctagctttgtttattgctaatctttggcatctcaaccgctgcgcactccatacaagttcataaaattttgaattagtattttgtaagaatcacaatccaaagaattattgaaaaaagaaaggtaggcagcggatttgtcgtttctgcaaaattatatgcagatgtcataaaacttgtgggatgcaaaatcataattgtatttttttttcacatctggtatttctctgtttttcttagttacttcctgggattgttctctgttttatccagttcataactttcggataaaatgttgataactcaatctcctggttttcagaacatcaaaggagatatcagaccttgaaagggagctgctatctgtcagaaatctgctaagtacacagtcagctctaattcgtggtctatctgaaggggttcatattgattccttgactacagggtctgaaggctctgcagaagaggggacagatgaagaccaggagccctcagaaatacaaaactggtgcacagatttccctgagatgcttgatgttttgctagctgagagaagagtggatgaagcattggatgctttggatgaagcagaacgtgtcgttgctgatgaaaaacagaaacagacactcaccacagctgacattctggccgtgaagagggctatctctgataatcgtctgaaattggcaaatcagctagcagaagctgcttgccagtcttctactcgtggcgttgaacttcgtgcttcagcttctgctctcaagagactcggtgatggaccccgtgctcatagtttgttgcttagtgcacacaaccagaggcttcaatgcagcatgcaaactatacatccgtctagcacatcacacagtggggcatacactgcatctcttgcacggcaagttttttctgttatagcccaggctctcagtgactctttagaactgtttggtgatgaaccgtcttatttgtctgaactgattacatgggctacagaacaagcaatgttatttgcactacttgtaaagaggcatgctttagccgcttgtgtggctgctgggggcttgagagctgctgccgaatgtattcagatctcacttggtcattcttccttgctggaaactcgtggtttgtcactttcgtctgttctgatgaagcaattcaaaccctctgttgagcaagcactggagtccagtttgaggagaattgaagagagtactgctgctttagctgcagctgatgactgggtactcacctatcctccatctggtatacggacgtttgctagatcatctgctagtagtttgttgctccaacctaagctctcaaacagtggccatcgcttcagttcaatggttcaggtaatgttctattgcttgacaaatgtttctagcctttgtaattgaggatttatacataaagttattcttttaatgttttactgtattattttgcaggatttctttgaggatgttggcccactgcatagcttgcagttaggtggttctgcaatggacgggcttctgaaaatattcaattcatatgtcaatctgctcataagtgctctgccacactcactggatgatgaagcgaatttggaaggtttaggaaataagattgttcgagtggcagagactgaggagcagcagctagcattgttcgctaatgcatccttactagctgaagagttgctacctagagcagctatgaagttgtcgtctgtaaaccatactggtgtgaatgatattcgtaaaaaaagtgtagacaggcaaaaccgtgtagcagagcagcgagaatggaaaaagaagctgcaacgtattgtggataaacttaaagatagtttctgcagacagcacgcccttgatcttatattcacggaagatgatgacacccgtctgagtgcagaaatgtacatcaatatggataatactgttgaagagccagaatgggttccatctctaatttttcaggtccgtataaattttttgcccttaacaactatctggataaacattactgcttatatttgtttgaagaatgaggttcattatgacattcatcattgaggtagttcttctatgatctataaaatatattgatttttagatgaattgttgtaaaataagtaaaccaaattgtttttctgaatctatgctctatagcacttcctttcttgtttatatacatagaagacatgaaaaaccgaggaatgatgcaagggttagatacatagaaggataaagtaaatatagcatgtttcatgcatgcccacttgacatgtacacattacgtcttaatcagcataaacttggtaaaattggccttgtcgtgtccttttggccttggttcgcacacactagacaagtctttgcactaaaacgagtgtttgccaagttcatccactagattgcacccaccaaacaagttcatgtaccaccaatgcaattcactcatatggtaaagaagttgcattcagcttgcaaataatttcctagttattgcttgtgctattatactggtatgtctagcccaacattaacaagatcaaccaaattgtagaaccaacagtacagaactctgtttggttcctgatgagttgtcaccaaaaatagattttggcagctggctggcttgcaattttgttcgaagaaatgctttatttagaaattgaaaccagaaaattttgcactttgagaaatataacaaaggtacaattttgaattagataatagacttcagtattttgtcaggcagaaattttgttaatgtaaagcttagatgacaactcatgaaacttgggcagtcatgctgcttgcaaatctacccaagaaactttagccttttgttgcagcatctcatatattgttgcaggaattatatgcaaagttaaacaggatggcgagcattgctgcagatttgtttgttggtagggaaaggtttgctacattcctactgatgcggcttacagaaacagtcatactgtggctatcagaggaccagagcttttgggaagagattgaagaggggccaagggctctgggtccccttggacttcagcaggtgagttctttttttcttgttttgatcttatgacaccaactattattcttattttcaccttccttttcagttctacctggatatgcaatttgtcatcctttccgggcgaggccgtttcttatctcggcacgtacatcaagtgatactgaaaatcattgatagagcaatggcagcattttctgctacagggatgaaccctgataggtatgttactatctatctgacttgcatctatccttttgcggttaataaatctatttcagtccgactgtatttagtaggaggtgctaatattaatatctatgcatgttatgctgtaatggcaatcggatgcatgcatgtattttgctccatgttacaattgtaatagattcctcacataccagaaac

SEQ ID NO: 59252 - DNA, 1068 bp, Oryza sativa
taatgagggcggcaagctgacgtaccaaacggcggctcgacggcgccgtctgcaaaaaattgcatttagcccctaaagtttggctggtactttttgcatctggaccccttgccgccctactatagggcggtaaggggccaagatgcaaaaagtactaggcccgggctggcttttttgcatggggccccttgccgccctaataaaaaacggcaagggttttcgtgaaaaaaaccctccctcccccgtctgttgtcaccgcccgtccctccctcgtttgccacgtcagcttgccgctctagtggagggcgccagggtctatttttgtaattttttacgctgatggattatttctgtaaatattaaaagaaaaaaatttaaaaataaaaaaaattccacgaagatatacaagtgccctattgtgtcaagcttttcgatgcacatgtcacactccagtaatcacgcggtcgacacgagggaatatccgtgtgattttggctgcgctcccggctgtcggcctgtacggctgtgtgatctccgatccgggtgctggaaatgcagcgttctgcttgagtcattttctgtgtgctataggcaattgccaattgacatgagcttacttggttcacttgatttcttcgtgccttgcacgccgccactgcgaaggtaatggatttttcagagactcggagtattgcgttgattggtggcttaaaagttttaactatcgtttggttcgggtcaggtgcgttaatttgtttagctggctattggtaaagtcggatctgtgacagaagcacatgagttgcgaccagactgcagctcctcagatgctaaacaagtgactgcataataaaaatcgttgggctggatgagtttgtcagctgaggagcacattttcctttccctcctaaagctagctgttcgaagtcaaagatcaaatgctagcagattgagttggtatggtatatgccttggtccaacacagtatgcatgctcatatgaacttcacctctttgaggcaactgtttttccaaaaaaatgaattttttattcgcatgtaaacttcgt

SEQ ID NO: 59253 - DNA, 3141 bp, Oryza sativa
gaacttcctctgtattttttaaaaaacattgccaacgttaaatatttagtgaaactaccgaaagaaaacaacgattttaaactagatttttctattatacttcctctggattttttttattttctttatgatgatcaacgtcaaatatttaatgaaggtggtagcataagaaaaatatattacttcataaaacatacacaccccaaaatagatctataatataatataaaatatcaaataaacatatcatttcacaccacaattgttgagtatagatagattttatttgcatcagtgggtctacattgatagttcaagatgaaacaatgagtaattaaaatattacttgggacatattgtcagaaactcaaataaaaaatgtattgtttaaaaatatgttgcattttttctcgcaaaacatagttagccgttaatgactcaattaatatacgcttttgatttgtacatatttagtaataaatttaaggttgagttctaaagtgtttatcagattggctctccctcatttatcttgagcatgttcttcgaactattaaactgtgtgtgtgttttgcaaatattttctataatttttttaaaactatctattttaatgtttgtaatatttaatacttaattaatattgcgttgatgacctacattgttttccgtgcccggcataagctcaaccaatgagatagaatgtagtttaagtaggagataaattagattatttactatataatttaaaattaaataatcaagttaactacattattaaaaaatttcattactttggatcatatatatttaagaaaaaagcaaataagttttgttgtctccttgctatttcttagctattaactaaaataaaaacaatagacaatgttggatttttttttgaaacaccgcccgcgcacaccctacccttttgagtacctccaaaagactaagccagcacattttgagactgacgatgtcaccacgggcgtctcgctgtcgacgggtatgtcacctaccactgaaagaataattagtcgtaactgcgaacacccatgtcaagtctaggacttgaacatgggcatgtttcaccaaaagaaacctaaccaattaattgagccacgctcacttcgcaataacgttggatattaaaataaccataatttttcagctacattactggaatacttatatgccttttagaccggtgaactattagttataaccgttagatctatcttatataaaagttaagcatgtatccatggtacatgatatttccaaaatattattgtgcaattatatttcgttattatcgtatccatattaggttgcatggagcctctcacccaccctacttgaaatgttcatagatggatcacctctcaaattacatcaatcgtattagcttatataaacccatacatttaatggagcttcatgtcccacccaattcatctcttaatgaactattataatagatatccatttactttcgctgacatgtattctaaaaaaaagtctactttatttttaaatgataaagaagattataaataattgcttatagatattatttaaatatgatattactaataggttagaaacttattaagcaattaatactgatgaaaacaatttaatatctcacggcagatgttctccgtttaatatttcgctcttatatttatctcaaacatagcgtacgatgcatgcccgcgcaaatgcgcgggctaccttcctagttattctaatatattgatgtgcaatcttcattcgcgaaaaaagaaggaaacaagaaagaattatccacataggattgaaattaaattgatggcaccactgccaagttgatcatgatcccatcggcaattcaaacgtactagaagaaattgtagctatccagtagaagtagaagtatgagtactacgccatgtccaggagtactagtgctttgtagcactatgccatgtccaattatgtttatttgttataatcaaggggcagggttcgtacggtcgtctcgtttttgtcatgataagtagttcttccccttcaaaaaccaaatcacgtactgcatgctacaggaaatgcttgccaagatctcaaaagcattttgaacccatgaggcatcgagacaccagtatactcaagtaacagaagttttcatcatcatcatcttcgtggtatatacaatcaggaggaattcaacaagcaaccggcaagtctcagccatgcttgccccttccaaacccgactctatcctactactattagctagctatagtagacagagctatactaattggtgctccagcagctgatgtacatgaccgtcctcaacccctcttcggccttttccgctctcctcctctccgctaccgccgccgcggaggcaggcagcttcttgccctgcgagacgccggcggcgttggccttgcccgccttgtggatggaccgcagcgcgtagttccagcggcagagtccgccctggtccttgagcgcctccactgcgcccacgctcatcgccaccatccaagacgcattcgctgcacccgccattggatcgatctcttctttcttgctgagaattggaccggattgtttgtgatttcttcttttggtttgcagtgaactattgtatgctgtgttgaggatgaggaggaaggagaggggcgggttatatagaggaggagggcaggaggctgtggagaggagaaggacggggttggggcgaaacaggaggcgccgcgcgttggtttcccagtataccgggtgctctgctctgcttgattaggccggaattcgcattcgtccaggttcggtggcccgagttgtctctgttcgcggtatgggagatggttgtccgttgcgaggagcccacatgggcaggagtaaccgataaggacgcgtgtcgctgcagatgccacgcagggccagtacctgtatgggcctgaattttggggtttatgaaagcttagcacgatcagactgtgagctatttttcctctctcagcaacaggtaaaacttcttcagagtaaggaagcaaagcaattctttctgtactgtactcctacctatctcgctctcaaagtttcagcaaaatctgccaaatctactactccctccgtttcgaaatg

SEQ ID NO: 59254 - DNA, 1723 bp, Oryza sativa
catcggccagccgaagagggtcgggtctgcgcaggccttgctcgccagcgcgtcgatgcagcgcggcacgacgaggagctcctcggcgagcgggaggagcgcgccgtcgcacgaccgcagcgcgcgcaaggcgtcgtcccagctgccgagcacgtcgcggaggaacgcctccgcctgctcgacgaggttgccctcgccgccgtggtcctcggtcatgccgaggtgctccgccgcgcaccgcagcgcgaccacgttcccggcgtcgagctccgccctgacgtcgtagcagaacctggccgccagctcgaacgccgcggcgccgccggggacgtcgtggagcttgacgctgcacggctcgccgtcgtcggcgccggcggctgcttcgcttatcagcttttgcagcgtgccacttcggctcatcaatgggaactggaaatggaagagcaatttgacacacgtcagtagagaaaaatcttaaaatgttcagattatgcagaatttaaggcttctgtccctgttcttgaacatttctttttaatctttgtagtagttaattcattcatttaaaccctcaaatagctgtcacaaaaatcagataatccatcaatatatcgatttcagctacctcaaacaggacatggaacaagaaaacaggatgacagatgatatcttttcatcaagaaaccaaattgttgacgcatgtgtaatgagttcaatttaggatcccctttgtacttcaagactcaatagtgaatttgcactagaaaaagataggagattgaaagagagatcagtgtagcagatgtaccttgtggagatggaaggagaaatctccaacctcaacgaccacatcgcttacaagctcagtcatgcaagtcctgcaagattgagaaattttgattttgtcaaaaaaaaaaccaggataacatgcaattccactagcagagtgcaggaaagagacccaaaagattctgcactgttcatctcaaatatgctcatctattctgttaatgtgtcaaagtttacatctcagtttattttctctgttatgtgctacattcggtcaaaactgaaagttaagttcatcttacaggtgtattatgatcgagttactgtcatcttaacctgatcaaagatagcgatattttttttggaaaaaaaaaacctgaaatgaagaattttcatggaagaaaatccatgcagtctgtgcgctacagggacacaatcaacaagtcatatgttaggatcacattgaaccctaacgaaggcaaatatatatatacatatatatagaagttaacgaatcgtttaggagatgaacacacgcaaagcgtctcaaacatgaacaaggagatgattggggatagatacgataggggataggacgagcgacaggtgaagaagtaccaggaattaggatcttgaaattggaagcagtcggcaggtttcgatccgagaaccttcgtaatcgccatcgccaaatccgatctcaaaccctcaacgatcgattaatagggattagatagactgaagaacacaatcaattccgccccagaacgacgcagcaactgcacaatttcgcattgatctcccaaatggacctgatcgtggatgatgaggaggcgaagaagaaaaagaagaaggtggtttggcaatggcggcgagcttgttcgttcgtcagtgaagaactgggcagaggattaatcatcaaacagaaatggag

SEQ ID NO: 59255 - DNA, 30910 bp, Oryza sativa
  unsure (1)..(30910): unsure at all n locations
taggcgactatttccgtcaattttcaaaatggaaaattatttttgtaaaacttttaataagaaaaattataaataaaaaaaattctacaaacgtgtacatacgtgcggatacgatcatgcgaaagacaataataacgacattggggaaccaaagcctcgggctacctgggccgtgaaagcccacgatgtgagccgtctttttaccatgtaaaacttacggacgtcactacacagctacacagcgtgatagtctaaaccagctacctaatccttttcataactagtacccttttcaatcgagtgtgctttctgaaaatagatatgtctaattagaatttatctttttctcacgtagggagtatacaagcattcaacaataagagtcctaatagctaaacttcaaataaacttctctttcaaattacatatctgatttacaatccaattatactattgtattcgttgtaactaaatctttgcatcattatattctaatgaaaataaacatatatgttgtaaattacttttataatagatgtaagttatttttatcacatatatatatatatatatatatatatatatatataaattactgttatatttgattaaattactttttataaatttagtgaacagtttaatttattggttaattctataatatgtcaattaaatttaatttttagatagacatatgtagttaccccccaccaagatttacttttaatatcgtgacaagttactttatttttttagttacttctataatatatttaaattacgtttagcctttattgaatttacttttatatgttcaagaagtaatttaataaaatctaaaagtaatttgtaatttttcataaaaatatataatcatatgagatcttattataaagatttagttgttacggacataacggtgtaattgaatcgtagatcggatgagtaatttaagagaaaattttatttaaaacataggtgataggaatatattttctatacttgtttgatggactagtactatagttaagtagatttttctagtcatgtgatgcttcgtcactagttacaattaaaacgagatgctctagatttagattttacgaaaacttaagcacggtttaatatgcgatgggttgggacgggccttcgaccatactgggtccgccacttaatacgaggtggagcttgcacaaccgaataggtgggtgtggtgctatgtgcgtttttagattttcgttcgaatgaaagctcataggaacgcaaaaaagaatgtaggattctttttatttttgccaccttacacatgtattctctattcaaccatgaaaaaattgcacttaagagtaaatttgacctaacaacgtgtattgtagtctaagttgcacatgacatataactccatgtattatagccatatagtttcataaacccacaatcatcttaattttgatctatcaaattttttagttctacaatcaatttcttagctatttatcaatcatataaatgttacatctatgtaagtaatgttttttaaaatttgaaaatagatgttaaattggttaacggtgtggttttgtgaaactttagaatcataatacccgaggttacgtgtcatgtgctaaaattcctataattttgtaaaacttagactatagtaggtggggttttatgaaatttactcttgcaacttatcattttcaccactctttcgttagtgcatatctttcgtttgccatcactaataaatgtagttattaaaaacaaatttgtaatcaatgtcagttgaccgttaagtttgtccctaattaaacaaccactgttcccttgtaaaagttcaaaataaagtagcacttgaaattttaacatgtaccctaatattgtcaagaaaagtaaattatagcaacttaaaagatacttcctctggtttatattataagtcgctttgatttttcctcatcaaacttaatcaagtttgatcaactttatagaaaaatttagtaacatctaaaataccaaattagtttcattaaatctaacattgaatatattattttgataatatatatgttttgcgttgaaaatgctactgtgtttctttaataaacttagtcaaattaaaaaaagtttgactagaaaaaaatcaaaatgaattataatatgaaaaggggagtagtaatattgtggagagtatggttactaagtgtacacacggtctacacatccgattacagataggtggtgagctatatgatataataggccagtgatagagtaggaccggtcgtcatgttgccttctatcctaaggttgtgttcggcactctgtttttccaactctcccctctcgttttcggcgtgtacgtttttcaaactgctaaacagtgtgttttttgcaaaaagtttctatatgaaagttgcttaaaaaatcaaattaatcctttttgaaaaaaatagctaatgcttaattaatcacgcgctaatggaccgctccgttttccgtgcatactgttccggttgggaaccagagatgccgaacatagcctaaaggtagtgtatagagctccaattggagacccgtgtaatagattagaaaaccgaagtcatgtcttcgagagggcttaaatctatctaaaccattgtcttcagtatctatgcaattttaggtctcacgcgctaccatatttattatcaccgatatagaatatggagaaatatatttttagggaaaaaaagtaaaattgggtttcatgctagagataatccattatatgccactaagtttgtcatatgtctacgatttttcactgactttgtcacgttataaaatatgccatcgacttttgtttaacttctacgatataccatcatcgtccggttaacctccgttagtaatgtacaattttgtccaaataaccaaaatacccttgggacaaaaacttctaaattttagattaaaaaatctaaaatatcatattacttagtggcatataatgatagtggcaaaagataaatgaatactaatgaaatagtggcaaaatagataagtgtaaaatttcgatgatgggaagtacaatatggtttcgacaagtggcaaaaaggaaatttcccccaaaatgtattattttcaattctttagtttactctaaatagcgactagctacctccatctcaaaatcttgcccatataactacctgtagtacgtgcgagtgtgtgcgactgcatgcaagaaaaaatgacattcatctattgtaacacggttataggacatgagaatttattgtatatatcataacaattcttgagaggaattagttaccacaagtagatcagatcctcaagagaaaaggagagggaaatgaatctaaatataccttccatttggtcaaatatacagctaggcgaattcggtttcactgcttgatcgatcgagtatctcgggtatgcttcgatgctagcttgtgattttccctaggaaagaatgtgtggccttatatagcgtaagacgatggtgtgatatttcacgagaaaagtccatatctacgcttgtaaccactcttaatctgttggttatgtaaatttgactggtaatagccaactactaacattcaaattaagttggctatgtaacatagtcaacttaattaatttaaatgttaatagtcaacttaagttggctgttaacagtcaaattaagtccgtatctacgcttgtaaccactcttgatctgttgggctaacaagagaagtttactgttggctattaacagtcaaattaagttggctaattaaattcattatcgacgcttgtaatcactcttgattatattactacactatctagggaaatgtcatttacgaacaaatgccaagatggctagttgtgtttcgctgagtagcttgattaccaaaattttttttcccaaaaacatcacatcaaatttttggatacatgcatgaagtattaaatatagataaaatgaaaattaattacacagttagggaggaaatcgcgagacgaatcttttggacctaattagtccatgattagctataagtgctacagtaacctatatgtgctaatgacggattaattaggctcaacaaattcgtcttgcggttcccaggcgagttatgaaattagtttttcattcgtgtctgaaaacttcttccgacatccggtcaaacatccgatatgacacctaaaattttttatttgacgaaaaagggcctatatatccatgcgcgcactggcccatcttatcaaagaaaccggtggtcagacagaagctagagacaaagttagttttcattatttgatcacgagacaaacttgcattgtagttgtagacatctttctattggaactcatagactcagattatttcactaaattaatctccgccatcctgtttcgctgaacttccaggtatttaagctactcgtgttttttgctgactggaacacgtacttaggagctcatacaaatatgaaaaaccacaaactcgctaatgggcctgttcggctgccgttttattgcagttgcgcgggctgcagctgcaagccggctacagaggcctatgttttcacctcgatggaccagtgggcatcctcggtcctatacgccatatggaataagttcacctgacatccctcaactttaagtccagtttgcctagggcccccaatccgcaataccagaaatctctatccttcaactatcacaaaccgtacaaaaaaagatctcaagacagtattgacccatttttccccggttccgctgacgtggcatacggtgggacccacatgtcagtgtcctatctttttctcttttctttttcttttttcttcttcttttctctttcttctcctctcttctcctcttctcttcttccccgagccttagaggctggtgggtaggcgagcaggcaagcggcggtggcggtgggtggagcaggcaggaggcggcaggcggagttccagcggccagaggcgagcgcagagggcgtagcaggcagggggcggcgggcgcagcacggcgtgtgagcgacggctccgcggttccgagcggcggcacctctgagagagggtgtggtgtgggtgtcactgtgctacggcgggcggagtggggtggcggcggcggtggggtgcaaaggacgacggcagatggagccggccacggacggtgaggacaacgacgacgtggcggacatagtaggctgggagaggacgacgacgacgcgcttggggtttcaccgggagacctcgccttcaccatcttcgtgccctcaccggagttgttccaccgcgtccttaggctgcggcgtcccaaagacagtgttgtcgataggaaggccgatgacgccacctacgccgtcatctcccacgtgctcggcttctccatcgttcccttaccgcctgcgcgctacggatgtagcagcagcgccgccgataacgggcggtggcgcttgtcctggtctcttggagtccgtgtctgggctgaggatctccgcctggagaaggccgacggcctctcacccctctcctgtcggcgtggcctgcctcctttcccccttatcctgccggcacagccggcggcctctcccctctctcccgctggtgcggcctctcccgccagcgccctcccctcccgccggctgtcccatgtttgggaagaaaagaaagatgatggtgctgataggtgggtcccacatttttcttctatttcacttacatgtgggacccacatattatcttatttctattttgccgactaggatgccacgtcagcaaaaccaggcatctatattaccatgggacctaatttgaacagttttgtatagtttagaggtgaatatttctggtattgagaataaaggatgtcaaacaaactcggtgtaaagttgagggatggcagctgaacttattcttacgccatattgactgactcaacatgcaaggatttcttcttttactccctctagttaggagcccgtgcgttgcaacgcaaaaaaaaaaagtttttcggctcgtacaacgaaaatcgattaatataacagcacagtaagacagcacgtccatggatgtaaatatatcaagcatcttgcttttgtttaaaaataattgtactgatttgaaagcgataccaacattacaaataattattgatcgttcagcgaaaccgtatactacgtctaactatggagaagatgactcaagtatcaggcagacttgaaaaggctttatacacactaaaaggccccatagaggcttgagtagaattgcacatgagcaattgagcatggagagcgtccaaagatatagcgcacaaaaagatcgcaacaaaaaggagaaacaaacgttgagttaaaatgtaaggaccatttaagaaacaaaaggcattacacaaatactgctaaacctacgtttgggtgtactgatatgagcactcgtcatttagagtaaattcacacttgaaagccaaactctttaaaatatagatgcaggattaactcgtcatgttaattcacacttggaaaacatgtgagtattaaaaccggtgagtttttttcggtaacatgcaaataaatcacgagttgacaaaaatcactcaattgtccttgctgtagattctcacgatttgtccacaaactcagtgacctccaggcatttgagacaaacttactctaaaaatggcttaaaccataaaattttgcaaacacctaaaccacaataaatttattccatgtctgcaacaacagcattcagtgcatcaccagtccaaaggtatcagtggagttgtcgccaaacagacttgaatagctagcaaatggtgatgttgcatacaaaagggtgtttttttttttgagttgtgattcaaattcatttgcacataataaccatcgccggaggcttgggctggagcgaagcggagaatcgttattcttttagggtttcaccttcgtatactttcatgagttcagttgagaatccatttggtcgatggaaccattttaatcacaagatggcaaattctgctttctctttcccttgaaagaaagtccatgtccctgcaaagtgcagaatcagaacaccaatgattgataagtgtgttcatgctgaaattgaaaggaaaagtttagagtttagttgactacatgaataaatcttctatattttagaaggagaaacatatgggtagcaaacttaatcaattgcaatgacatcagattcgtcaaccagaagggcccaatctctagctattgtgacattctcctttcccttcttgtggccactaccggaagtggattttgatccctcgaggggatatccactcgttgtttgcatgttatttaaatggctatgaagaaaattaaaaaaaattaagaaaatgtattaacatgtgatataccactccataaacatgcaagtaaaaattcaactcctacatcttacaacaaaaaaaataaatttgactctgaatatacgttaactagctgcggtttaatttgtttttttgttacgagatgtaggctgtgtttagttcagcgcaaagtttggattttggttgaaattggagatgatgtgattgaaaagttgtgtgtgtatgacaggttgatgtgatagaaaaggactgaagtttggatccaaactttggatctaaacacagccgaagaagttgaatttgaacctgcatgattgtgtagtgttatatcatgtagcgcccgttccgtcgtggcgcctagcgggaaaattatctcctaaaaaccctaattgcgaaatctgtttctttgcttgttgtctagtgtccgtgccatctcaagatctcaatccccgatctatcgtcgagttcaattccgaatccaaatccttccaaatcaaattcctccgcaaaagtccattttgcctcccccggggtcgatgggccaattttctctcggcccatcttcccctctcccccggccctttcccctctctccccggcgccctctctctctctcgctctctcccccggcgcgctcccgctccctctctccctctctctctccgctctgcccgcgcgcgtgcgcgtgagtcgccggcgccgagccgagtcttccctctccgctccctcgctgccgctccccgcgctcgttcgcgcgcgcacccgcttggttgccgcccgtgtcgcgtcgcgtctgcgccgcccggtcccgctgccctgccgcctgcagccgcgcagccgcttggccccgcgagccagcgcgcgtgcccgagccgcgccactccatccgccgcgcctcccgttgcgagccgcgcgcgcgtgccgtggtggccgaccgcccggtcgccgccgccgtcagcctctgcacgcgcctgtcgccagtgtcgccgctccgctccaaaccgccccgccgtcatcgccgtcgtcatcgcccggccccgccactccgcgcgcaagccgccaagggatggaggcagcatccctcctccctctgccgcgtcgcccccgctcacctcctcctttttcccgaatcggcaaatgggcaagccccctttctccccctccttttccccttttttctcctcgccggcgtcatcctccctgtcgccgctttggccgtgaccgccgaacgccagctcgcgcccttgaccgcgcaagtcggttcccaaaccgacattgccgcccatttaaaccccagcctcccctttcccttcctcttccattcgcctccgtgccattaccgccgcccccgtgctctgtctcgcctccgccgtccttcgccgagcgccaggaggaccggtgcgttcgaggacgcggaaggggacttcggccgcgccctcttcttcctcttccccagcccgaggccggagagattactcccgcgccgtcggcctctcgtcacagcgccccgtcccgcacggtagtgtctccctccgttcttcctcctcgctccatctccccccccttagttttcggtggtagcacgagtagactccccgtagctagccggcgccgccccagccgttgccgtcgctcgccgtgtgctcgccgccgtcgccgctcgagctccgtagcacccgcacgtcgccagcctcgctcggcgtagctccgtccaatccgacgctagcatcgagttcccgaaaccgcgtagatactctcaccgccgggaatcgacccctcgtggtctcgtcgccgtttccctcttccctccccgccggttgtcgccgccgcgattcgccgccgtcaagctctctccggcgaatccgagccgttggctcgtctcccctcatcacgaacaaccgcccggtgtgctcgcttttgcccgtatcgccgtggttcgctccgccgctcgccgccgccgcccgccgtccattcgcggccgggtcgtcgtctacctcccgccagcccacgtggcagccacgtaggcgccacgtcggcgccagctcagccgaggtcgggacgggccgacctcggtcagtccctccccgtgcgcgcgttccaccgcgagccgtggggctgcgcgtgggcccgccgcacctgcgtcctccgcgaaccgcgtgcgtgcaccacgtccatcctccaccctagcgccgcgccgcgtgctccctccgcacggtgagccgagccgctgacaagtgggtcccacccgggaccgcgcgtggtgagcccggtccaccggactctctctccttcctccgcgcgcgcgcgtcttgggccgctctgggccgccttcttgggccggccgacccgttaagctcggccgagccgctctttctctcgggccgcgccctagccgcccgagaaaagtctataatccctccctcttttcttttctttatcttttccaaaaaggatttaattaaatccttttcctttagaccaaaaatccaataatcttagaaattcaatatcttccccgccgtaaatccgtttgactccgttcaacttccaaaattccccaaatctcgagatctacctaatggcatgcttagaggtcattaataaggctttattttcgccgtttgttgagttgtcccatttcgcgtgtagtttcggagcccgaagacccgcagtgcgaggatttcgaggatcaagctccagatctcgagcaaggcaagccacctttgaacatcttgagcctatatttgaaatttaattatattgcttgcaaaatattatgcattgataggatcgcacttaatctgttgtcccgtctgcaaggcagattggcggacctgcctaatttgttgcatttgatccttcctttgttaattgttataccatgtccccttgtaaccacccagttgcgcctcgatattcgtgcactctgtgcgagtatcgacagtcgccttcaaacttaaaatctgaaaaacaacttgggtaaaacttgggttttacaaaagacttggaaaacccgacacctgggtcggtgcttgtgaactaaatgaatttctaaaaccgcggaccggggaacgtaccgggtgtacggttttcccgctcccgcacttaaggaccgattccttggaatttcatccgaacaaaagacaagtacgaccacatgggtggaatgggacacccctggctgagtaactagcttatcaggggagccatgatgccgagagacatgtggattcgccggggtggtgtcggagaggacccccctgggcttcctggcacagtatggtctgggacctaacctgttgttggtctgggacccctctcgtcggcataaggtaagcctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagtcgtgcccacggtcatgggcggatgtgaggtgattcctagcgtagttttgtttgacaactgcttgtgaaattactgttgtgaaaaggggttcgatgtttgaaaaatcagcagctgacgggatcagctaggcccgggtggccgtttgaaaagttgttggcccgggtggccgtttgaaaagctgttggccgggtgccaaccttgttttaagatctaaagattgatacattgcacatactccgaccggacgggacgcactgtctcaaccgtgtcgtttgagaagcactcacctagatgtttttagaaaagagttcaaataaaatcaattacgaaaacaacagcctttccttgaaacctgcattaaacacttatttcccctggcttgctgagtactcccgtactcacccttgctctatataaatattccccccagttgctgatgaagatgaagcggatcctgctgatgaggagttcttccaggagcaagccggttacgatgagttttagggtttcggcctagttcccaagtcgcgcctgtgttgtttggtccaagtctcggcttccgtttcccttttgtaatgcagttgtgagctcgggatctgtccgcagcccaacatgactgtactcctactctataataaagagacctctgttgctgtgatattctatcttcctgtgataccagcactgtttcctgggactggtatcgattaacaggttaatttggagcgtcacgggctaattccagtcgggactagctcggggcgtgacatatcacatgttaatacaccttctcaatttttttcataaccatttgagtgacatgcaaataacgagaggatatcccctcgaggaattaaaatagtttcccgccactgccaccatccatgacccatctcatcagctctttttccttgcctctccaaagtcaagaccatgaccggtgatggtgcttcccatcctctgctgcaagggaaacatagtcaatatagtcaacagtcgaatggaagaatggtcctacattaaggtgaaatcatgctttttatacaaagccactatataatcaaagagctaatatttgaatcaagcaacccttgttaccaatcaaagtaggaaatattgaggatagtattaacgttgaagtgaaataaaaaggtaaaaaggagttcagggcctgtttagatctatttggaatggcaaatagcaaaagttttggtggcaaaagttttgatattgtaaaagtactagttggtgtttagatgcatcctaaacttttgctattctagcactaaagtgagagagagaaagagagagtgagtggtcccaaagcactttttggcacaatttactactatggactagcaaatgctaaatgccaaattgtcaagttttgctactagtgtttagatccaaaatggcaaaaagtgcttcagatctgatttacaattcgttggtgtgcattcaatgtagtaatattgtcaccaaaggcgctcaattagcattctcgtaattggccacataaaactttttttatctgtgataaagaaattatataaaacaaacatgtggtagcaacttgcaattaaaaatgcagaaaaaaatatgtctcgcctatcatcgaatataaaaatcatcaggaggggcatgctgcactgtagtctgattgtgattccatttttcgcataacaggagacaggttgcgtcatggagtgtttaaaatgaaccatcggtaccaggtgaccaaagaacgaactgatttatgtcgctgcctcgaaaaaattatcctcctggctcttcctgttgacgatgttgaaaagagagagtttgcacaaaagaaagttttgacaatgtaaatggcagttaggaaaatgcaccagcctccaataatagctgcagcccgtagggcatagatgtaataacacaaatatgtatataatgagagttactaactaaggtccaagaaacttcctgataaataaattagaatcaaattaatccttaacgttatatgcatgctatcttcaactgcagaaaaagtccaaattaactttctacttcacaaataattgttttttttcctgacagtaaataaacagaccatactttctttcacgtttgaaaaaactaaagatattggcacatgcacaattatcaatgttacaagaaaataaataaggaatcacacaacagggaattatcaaagttctgaattttttgtacctaaaaagcttagatctccgaggcatatcccagagttgcacctaccaaccaaccaatcaatccatattgcatttgaaatccataactgtcaagagcaaaccttttttcagttacgtgaccaaaccaagaagagaatatcaaacggtattgtcaatgtttgcaacatgcttatgactacgagatttcgttatttatatgaatgcatattgattgtggatcaaagagaacagtgtgttttcacatgcttgcctatagttatcttttgagtaaattacactttggtccaccttttattacccaagtttcaatttggaccacccttaaacctatttttttaatttggaccggataaatttaccattgttgcagtttggactaccgtaaacaatttttctcgtcatgactaacttccctttcaacaaacatatgaaccatacatataggagtttggccgtatactaaagctgatgtgtttaagatcgttaattgtactgaaaaaaatcgttcgtggtggtccaaattgcaacaatggcaaatttatccggtccaaagtgaaaatatatgtttaagggtggtccaaagtgaaacttaggtaataaaatgtggcccaaagcgtaattcactcttatctttttcatgcagtcctcactcgtgtgcacccgggaagaatttcccgatcggtcacatatcttttctgcacactttgtcctcactcgtgtgcacccgggaagaatttcccgatcggtcacccatcccaaattgctccaggccagttatttggagattggcttccggaaaagaagttccaacttgttgatatgagtattctattaatcctattaagccctaggccaggatgttacaccctcacccccttaagagagatcgacgcccccgtcgatcaaccctaggccaggaacgtcctctcttggccacgtccatgtgtccagtgccagcacatgtgccatgctgtgtaaccactcccggtctacaccagccatgcgcaccatgcctgcgcaactgcaacacacgcgcccgtgaaaccgcgagagtcggctctgataccaatttgtaacgtcccgccttcccccaggccaggcccgcttacatctgatagctttcataggtcatagactgccctcacagaccaacacatatctcacccatcccaaattgctccaggccaagcacgcttaactctggagttatttggagattggcttccggaaaagaagttgcaacttgttgatatgagtattctattaatcctattaagccctaggccaggatgtcaacccatgcaataccaccagtgtcacgccccgaactagtcccgaccggaactagcccgtcacgctccaaattaacctgttaatcgataccagtcccaggaaacagtgctggtatcacagggagacagagtatcacagcaacagaggtctctttattatagagtagaagtacagtcatgttgggctgcggacagatcctgaactcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggggattatttatatagagcaagggtgagtacgggagtactcagcaagccacgggaaataagtgtttaatgcaggcttcaaggaaaggctgttgttttcgtaattgattttgtttgaactcttttctaaaaagtctaagtgagtgcttcccaaacgacacggatgagacagtgcgtctcgtccggtcggagtatgtgcaatgtgtcagtctttaggattgcaacaaggttggcacccggccaacagcttttcaaacggccacccgggccaacaacttttcaaacggccacccgggcctagctgatcccatcagctgcagatttttcaaacatcgaaccccttttcacaacagcaatttcacaagcagtagtcaaacaaaactacgctaggaatcacctcacatacgcccatgaccgtgggcacggctgttcgagcagtttgttaacctctgcagagggggtacactttacccacacgacattactaacccggatcacccagcccgtggggatcagccacgtcgggagacctccaagctttcatgacaaggcatttcgaaagccgatacaggtttaccaaatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcaaaaataaagccctattaaagacctctaagcgtgccactagatagatctcgagatttgagaaattttagaagttgaacggagtcaaacggaattacggttgggaagatattgaatttctaagattattggatttttggtctaaaggaaaaaggatttatttaaatccttttgggaaaagaaaaagaaaagaagggagggagggaatatagacttttctaggacggctagggcgcggcccaagagaaatggagcggtctggccgagctaaatgggccggccggcccaaggcggcccaaactcgcgcgcgcgcgggagggaggagagagagggccggtggaccgggctcaccacgcgcggtcccgggtgggacccgcttgtcagcggctcggctcaccgtgcggagggagcacgcgacgcacgcgcgcgggcggggaagggacgcggtgcatgcgcgcggtccgcggtggacgcaggtgcggcgggcccacgcgcagcctcacggctcgcggtggaacgcgcgcacggggagggactgaccggggtcggctcgatccggtctaggctgagctggcgccgacgtggcgcctacgtggctgccacgcgggccggcgggaggtagacgacgacccggccgcgaatggacggcgggcgacggcggcgagcggcggagcgaaccacggtgatacgggcaaaagcgtgcacaccgggcggttgcacgtgacaaggggagacgagccaacggctcggattcgccggaggttgctcgacggcggcggattgcggcggcggcaaccggcggcgggagaagagggaaacggcgacgaggtcacgagaggtcgattcccggcggtgagagcatctacgcggcgtcgggaactcgacgctagcgtcggattggacggaactacgccgagcgaggccggcgacgagcgggtgctacggagctcgagcggtgacggcggcgaacacacggcgagcgacggcaacggtcggggcggcgccggctaactacggggaggctactcaagctactaccgaaagctagggggaggagatggagcgaggaggaagaacggagagagacatcaccgagaagaggaggggcgctgtgacgagaggccggcggcgcgggagtaatctctccggcctcgggccggggaagaggaagaagagggcgcggccggagtcctcttccgcgtccttgctcgtgccggctcctccgacacgcgcaacgacgatcggcgacggcgaaacagagggcagcaatggcgcggaggcgaaaatgagggagtttggagggggagggcttgggcttaaatggacggcaatgtcggtttgggagaggggaaccgacattggacggttaaggcgcgagctggcgctcggcgcttgcagccaaagcggcggcaagaggatgacgccggcgaggaggaaaaaggggaaaaggagggggagaaaggggcttgcccctttgccgattcgggaaaaagagggggaggggaacgggagcatcgcggcagagggaggaggggcgcggctccgtcccttggcggcttgcgcgcggaggggcgggggccgggcgatgacgacggcaatgacggcggggcggtttggagcggagcggcgacactggcgacaggcgcgtgcagaggctgacggcggcggcgaccgggcggtcggccaccacggcacgcgcgcgcgggaagcaacgggcggcgtccgcgcgggcgcgcacacgctggctcgcgaggacgagcggctgcgcggctgcaggcgcggcagagcgaggggaagggagggggcgctcggcgcggcggcttacgcgcacgcgcgcgcggcgggcgggcgaggctgagcgggggagcggggagagaggcgctcggggcggctctcgcacgcgcgagcagcgtacgggcgaggccgagcggggggagagatgggagagcgcgagagagagagagagagagcgcccggggagagagagagagagagagagagcgcccggggagagagggggccggggaagaggggaagatgggccgagcgagattcggcccatcaacctcgggggaggcaaaatagacttttgcggaggaatttgattggaaggatttggattcggaattgaactcgacgatagatcagggattgagatcttgagatggcacggacactagacaacaagcaaagaaacaaatttcgcaattagggtttttaagagataatttttccgctaggcgccacgacggaacgggcgctacagcaaatctctataacttctgaaagaaagtacatgctaagaggcaggacaagttatttgtgacatgtctgatgtccctcatactattacacagccaaagatagtaagtatgatgatgcggtattcgttctctttgcgtggtattgtggcctcagaaaataactgtgtaccaatttaattgttgtcaatcgataagaaaccttgaaaagtttatattcatgtagcttttattataaaacataaagtaacatactgagaacattaaaatacgcccaacatttaatgaagcattactcgatcgatcacctgtaaggctgtaactcatttatattggcagctgctaattcgaaaaggcaatctgatagaccggcgacttgttagggtagaagaggccaaaatgcctctcggtggcagcccctgtcttctggttctcgttgaacatggcaaatatgtacgcctccatctgtccgggcctcttgggcgtgccacgcccgacatggtcgatcagcccctggttgtacgccctcgcgttgtccatgctcgccccgatcccttccgccgacggccacccgctctccgacaccaccaccctcacgttcccggcgtcggccttctccagcgcggcgtagatgcagtccaccatggcgtcgaacaggttggtgtaggtgagcccgttgccgtcgtccctcaccgtcgtgcccggctggaacgtggcgtagttgaggctgatctcgcgcgggttgccggcgtaggcgaagtaggggtagacgttggccagcagcggcgcgccagtgctcgccaggtactgagctatgccattcatgtagggatacgcgaacacgccggcggagggagggtaagagttggcgatcacgtcggatttcaccgcggtggaaaccttgatgccgccgatgccggccgcggcaagggcggagttgacgttgcgcatggccgggaggatgctctccgtggtgccgcctaccacctcgttgccgacggcgatgtacttgatgttgacggccgggtagtaggggctgatattgtcgtggacccatgacgccgcgttggaggagctggcggcgagataggacaccgtgtcgaagccgccagcgtcgaggatgaggtcgatgccggagttgcgcagggcgtccagcgcctccctgtcgggattgtagatgcgcatccgattgatgcccagggacacgtacatctgcaccacctcgctacgtgacgggagatcgttgcccaccatgccgtagcacacgccgatggattgcacggctggacgaggataagctacaaaaattaccaacacacgaatgcacgcacccgttagctacatgtaccaacgtacgtgtatacgcggatatatatacgacgatatatcatacgaaatgtgataatggcatacgtgtaatcgggtaggccggcgtcttgtcagggttgaagaggccgaaatgcctcctggtctcatcgccagtctgctggttctcgttgaacatggcgaacacgtacgtctccagtggcccgggccgcttcggcgtcccgttcttgacgttgtcgatcacgccctggttgtggttcatcgcgttctctgccgtcgccgcgaaccctcccgccgacggccacccggtctccgacacggcgatgcggacgttgggcgtgccggccttctccagcgcggcgtacacggcgtccaccatggcgttgaagaggttggtgtaggtgaggccgctgtcgctgtccctcaccgtggtgcccggctggaacgtggcgtagttgaggctgatgtcgcgcgggttctccctgtaggagacgtaggggtacacgttgacgagcagcggcgacacggtgttggcgaggaaccgcgcgatgggagccatgaactgctgcacgtcggggcggaacacgccgtgcgacggagggaacgtgttggcgaccacgtccatcttgatcgccgtcgacaccttgatgctgctcgagaggccggcggacacgagggccttgtgcacgttctgcatggccgggaggatgaggcccatgtcgccggcggggagctcgttgccgacggtgatgtagcggatgatgacgctcggccagtaggcctcgacgttgtcccggacccagtcgccggcggcggaggggttgctggcgaggttggccaccgcgccgctgtcgccgacgtcgacgatgatggcgatgccgctgccgcggagcgcgtcgagggcctccttgtccgggtagtagatgcgcatcgcgccgatgccttgggacttgagcagctgcacgacctcgctccgcggcgggaggttgtcgccaagaacaccgtagcaaacaccattgacagctgcatcatcaccacggcaccacgcaaccgtattacgatcgatcgatcgatcaaatcaacgaaaatagagaattaattgcttgaaaaaaggaaggaaaataatgaataatctaaaatatatacctcccatttgctcaaatagctaggtgactcgatctgtctcagctagtatgcttgatcgagtttctggagatggatatacgtatgcttcaatgctcgctcctgatcgtcgataggaatatgaatgggcagcttcatatatatagcgacggatgatcaatgatgttaacttcacgtatcagagagccaatcgttcttctcttgtcaaaggggcacgagtttttagccaagtggtgccaccagtataaacaagtggcactaatttcatccgttaaatttgccgatggatcaaggatgtgcaagcctggtagcaccgtgggtccgtggcggctatcagctctattttcatttgcacgttaatctacgacgtggtttcgtacgcgcacatggtttacagtattcaatcggctaatagcttattgattggtctctatgtaataattaggcttgacaaattgcattagcatgcatggttccgatgattacttgggagggaagagcatggcatcctcctgcgatgcatgcatgtacgcaagttccatcgcaatgtcaagttcccccggccgtttgttgagatgactatatgcgttttgttatttgcgatattgaaattgggcgcacatggtaggcgtgtacttgtacagtatttttttttagataatggaaaaaaatacaatatatatacatggggaaccacctatgcatctgtcgggtgattttttctcaaaaatcacccagatttttccttgcccttagattttcatccaatggagtaaaaaaaaaccgaacagacagctaaaaaaggccaaaaatgactgggccaacacactaaaaaaatagataaaacatgggctgcaatctggcccaaacaacaaattagaaaaataaatcaaacaaagaacagatctgagaggctcaaagaagtaaagtcaaccctgtccaaaagcatcaacttggctgccaagaaagctaaaagaaaaaggacaaacacaaatccaaactaacacaccagatccaaaaaagcaacaccacgcacaccatggagaacgagtaggagagaaagaagagaaaaaaggttgaaccaaagcaaaattcttcaaatcaaagtgaaatcacaggggagaaacaagaaataaggaagaaatccaaactaggtatgttccataaacctgtgctcatcctcaaaattgactacaaatcttagatcatagcaccatacgtgcccccatccataaggagtgttttgaacaaaatacagggcacagttcatacactgaaagtaaaacttacagtgcatttgcactaaaattacattgtaaaaacagtatatatgacatgtaagtgcactgtaagtttagtacaaatgcactgtaaaattatcaatcaatcaaacaagtagaccatacagaacaacttctgttgtttactacctaaaaactgaatacatcaattcaaacatgaactcaggagttccagcaccaaatacatcatatcagttgggcagcacaaaaaagaaaataaaaccacaatagtgagtagtatggtgatatgggttagagacaactaacctgcatgatggctgccgggtttggtcttgatgctggataggatagttgagatccatggagtcagaaccaaactaaaattaagagaacacaagcatgaattaggacatgttccacagtaaacttcagttacaaaccaattggtatagggcacaatccatatgaaaaacaaatatatgcacaagggataaataatgaaaaacaagttcagaaactaaaaaacaacccaccaaaccaatttcacattcatatatgctcaaaagtagaaatttacattgcatttgcactaaaattacatttgtaaaaacagtacatatggcatgtaagtgcattgtaattttagtacaattacactgtaaatttgggtaacataattttttgcattattgaagtgtaattgataaaatgatgcttgattagtaatctgtcatacagaacacctgcatatttcactcctcaatactaggtattcactcatttaagacaaatggctggataaaattttagtgatttccaatttggaactagcaaaacagattcatagttctctatatatttggcttagaatatagaccatagatcacatttaatactctcatacagaacattcaggaattatataggagcaggaccctccaataatccattcaaatcaaatctaggattaaaagaatatcactccaagaacatcatagtaaacaatctagggtactcaatatcttggaaatgtgtgatgactcgatctgccatataaacaatcttagtacatgcagagcccgatccacaatattttagtacttatttaactaatacaactacaagtatatatgcattatgcaacagttacatcatcattgagaatcatttatgcacatcaaatctatatctctagatcaggatagattcattagatcaacatgactagatgatacacatggaatacaaaaattactgtcctacataactaaaattacatctgtaaattcaggtcattgtgtatgtaagtgtactgtaatttttatacatttgttgtgtaagttataatgtattactctatgatgtattgttgtattctaatacattcaataaaattttgcagaaatgaagtcatatgcagatcctgtcaaaattagcatcaggcagaaaaaggaatctggggagacaaacaaggaaaaactacaattaggtattttcttttaaaaaaatcacatactatgttgatctgaacatcatgtagaaatttaaaaaaaatatcatagtacaactttgaaaaaaaaatcacaggaaaatgttcagctgcagggtgaaggatacaaaatattaaaaaatacattaagggttaaacactactactttcacaccattgttatcaaaactagaaaagggttaaacactcaaaacacattaacatagcacccaatcttaaatagcactatccatgctgccatacatatgcaaaatcaaacactggaagtagaaattacagtgatttgaaattaaaattaaaattagaaattacagttgtaaaaacaatttatattgcgtgtaacttcactgtaatttttgtgaataagctatgtaaataaatatgtaatacttaacattctagtaagatggtttcagtggacatgtatactaatttattccatgaattttgcaggaatgaaatttactgaaccagtcaaggttggatccatggagaaaaaaggtattgcaacactacactacttattcaagtacaaaacatctcacaatttcaaaaacttcaactacatagccaaatataataatcacatatataccactcctttcacttgccactcaataccaaacacacagaaatacaatcacatatgtgcctaaatacagaaattttaaaaatatatgcaaaaccattctaggctaacaatcataatttgacctaaatattatggccaaaaattacagtgctttatatctaaaattacatttgtaagttcagttgatacaacatgtaataaatccaaaaagtataaaacttacagtgatttataactaaaattacaattgtaaaaacagtttatatgacaagtaagtgcactacaaatgtggttcagtttataactaaaattacaacaatttatgactaaaattacatttgtaaattcagtttatttgtcatgtaagtacactataattttggtataattgaagtgtaacatgtatgtgtattgtaattttggtgcaaccacaatgtatttgaaaaatatattcatgtttgacataaaacatgcaaatgccacactgaacatatactgctaaagctcaatacatgctaaaaaatacaaatgattctcaaaagacatacctatttaacaaatcagtacctcatatacttcatttctcccatggcacaggtcgtgaagcaatacaagaaggagaaacaattagacaacaatcagaggagagcaaaaatgatgcaatgcatattgaaggaagcaaaagaaacatcaacatggctccaggtcagaaaatatatttgaataaattttgctctaagaataaataaaggtaactacaattatgtttgttgattctaacatatgctctaatgatttatataaattttacagggaggctggcatatgcaggaagtcctaatatctacaatttgcaggagggtgaaggaagcagcagcaaaatgccccatttaggtactaactaagtttctaaactaccaggtcgacaagctccaacaaaacaattgcaacatacactgatctaatattctgatctttatctttttcaaaatgcaggatgcaggaaaatacaacacgtaggaaaaaacttcaattcaccagaattaagcaataccataggaacaattgcatcagaagttgtcaattatggaggacaaatgctatatgatcaattcacattgctaaactcagacccaagacaggtacactaatcaaaaagcatagatgtagcatataaaactattttatacatgcagttataaactaataaacatataactgtgcaggaaggacagttgagctacactaacctcatgcaccaaataattcatagtccaactgtcaccatacagcaacaaacagtaagcatatcaacttacattatatacctaacaaaaaaaaagagaaaataataaatgaactgatatgtaaactatgaatatgcagggaggacaagaaagctttacaagtctacttcggacaccagcatttgatgtaagaataaaaatttatgaatacttatgtaacaattccctaattagtcatttaaatcagtactaactactgttttttgatattgcagaattcaatgatcttaacaaccagtagattttctccagaactagaagagcagcaggatatgacatatgagcaacacatatcaactacacactggagctatgaagaatttgatcagatttacaacagcaaatacatcacaccttttgctgaggtgattttagctaaaatattgacttcaaattgtttagacttaagctattttgcactattgattaacaagaacttattgtttggcagaatacaacagcaagaatagaagagctgtatcaatcaaaaaatagccatttcactacaaaggtaaaataaactttgcaacaaaaaaaccctatatcagcaagaattatcaagatataagtctaaccatcacaaaacatgcaggacaatgaagtggatatggcgactgaaaatgatgattatgtggagctgaattcagatgatgaaaatgagcaggtatactatcacttatttgaaaaacacaatacttattcaaataatgttaggaggatagatctgcaatggtgctgacatattacttgaacaaaattttcaggaagggacttcaaacatgcttcagcaagattcccaaatcaatacaatcacagcaattgaacaagttgagcaacagtgttgggcaagaagaaacaacaagtgagacaaaagctacctcagcagaggacaatgacactatcaatgaagaagacattaacaactacttggctaatgaagaagatagccaagataacactcctgtagtaattgacaagaaacacataccttgcattggcaagaaattcagaactcatgaagaagcgcgtagtttcttcaacttctatgcatatcaagtgggattttctgtagtcattacacaccactacaaatctacaagcaaaaaaagatttggtcagatcaccaagtacacataccagtgctacaggtatggtaagaatgatgatggtcagaagaagaaaaaaaagaaaactcagcagcagaggaatacacaggtgattgacagaactgattgcaaatgcatgctaacagtgaggcttgaaggtgatgtttggagaatactaagcatgaatctcaaccataaccatacactcacacccaatagagaagcaaagttcctcagatcacacaaacatatgacggatgaagagaaaaagttgataaggactttgaaacaatgcaacatacccacgagaaatatgatttcaatattgtcatttctcagaggaggcatagcagcactgccatataccagaaaagacgtcagcaatgttggaacagcaattaactcagagacaagaaatactgacatgaatcaagtgatggaatatctaaggcaaaaagaagcaaaagatcctggctactattacaagctgactctagatgagaataacaaagttaagagcatgttctggactgatgggaggtcaacacaactctatgagcaatatggtgaatttgtgagtttcgacacaacttacaaaactaacagatataatatgccatttgctccaatagttggtgttacaggccatggaaacatatgcatttttgcatgtgcatttttaggagatgaaactacagaaactttcaaatgggtttttgaaacgttcctaacagccatgggaggaaaacatccagaaacaattataacagatcaagacttggcaatgagggcagctatacgtcaagtatttccaaacagcaaacatagaaattgtttgttccacattttgaagaaatgtagagaaaggtcaggaaatacattttcagacaagagaaggaaagatctctatgcagaatttaatgacattgtgcacaatagcttgacaagagctgaatttgaaagcctatggttgcaaatgattgcacagtacaacttggaaaatatcaaatatctggaaataatgtggagaacaaggaagaattttataccggtgtattccaaaacagatttttgcccatttatacatagcacagcacttagtgagggcacaaatgcaaggtttaaaaggggagttggcccaacacatagtgtcatgacttttctactggaatatgaaacaatcaatgacatcatcttcgacactgagtatgggaaagattatgaatccagaaacaagaagccaaagtctttttggtcaaattacatgatagaagaacaagcagcagacctatacaaccatgggatatttgataagtttcaagatgaattgaagggaacactaaatctagaagtggcagctatacaacaaggaaaagcatatgaagtatatgcagcgccaaatctgaaacaacaagaattcagaccaagaagatatgttgtgatgacagacttaccacaagaaaacttcatgtgcatatgtgcaaagttctccaaagatggaatcctatgcagccatgttttgaaagtgatgttgtatctgaaaatgagcaagattcctgataagtacataattgaaagatggaggaaaaaggagagaaaattaacggtgagcatgcaacttgcaacaaatgacgagaacagttctgtgctaaggttcaatgtattatctagaagaatatgcaacatggcatcaaaggcatcanaaagtaaggaaacatatgagtacctgctaggagagattgataatctggatagcaaccttgacttgataattgaagatgcagctcaaaatcaagcaacaattgatgaaagcaacacggtggaaaacacaagtgaggatcaagcagaaaaagaaacaacaaatgagcaagaagatattcaagaccctgacatagctaacacaaaggggaaaaaatcaacaagaacaaaagggatggtagagaagataaaagaacagccaaaaaaacattgtacaagatgtggaagaacaagtcacacaatagaaaattgcccgctgatgcgaattgcaagaagtacaaagaaaatacagaagactacaacaacaagtaaaagaaatgaataatatgtaaaatattacaaacatgggcaagcaaaaaaaatcaagctaatggatataaatttttgtattgcagggacaatagagaagcaagcaatgcccgctaggaagaagaaacatgaagaaaatgacaaaggaagcaagctacctaaagatcaaggaagcacaaaaaagaacaaattaaattagaagacagaaaacaaggatgtcaaattttgagactgaaagtattagaccttaatgtttttcactgtattactgcactacacacactatatatgtgtattcatactaaaagtatttgatgtaagtgaacatctgtattcactacaggaatatgtaatggcactgcaaaaatgcattcactatgatcctatacattccactatgctagcacacactacagttttatatagcgactaatcttctggacaaattcagccttcaccagcaaattgatcctacaataacaaacaaaaataatattttcaaaactatgaaagaatccaaaaaacaagaatggcaaaaaataaaagacacttacaagattaaaccaattttcatagcaactatctttctgaaaaatttcagccttcaccaacaaattgagcatacaaataaaaaatgaaaaacatttttttcataactaaagatgtatcaaaaaacaagaataggaaaaaaataaaaacacacttacaggattaaaccaattgagcacaacttcttcaacttcagtctgcagcattttattcgttggatggaagaataactgatttgcatatagcatccgaatattgtcaatatcatctgaagaaaattcatttggtagaacaacccttggtgaccacaattccatacacttcataacaaaaattcagaatcaaagctacaaaaaaaattgaaacaactctttaaattacaaaaaacaaagaaataaaacctaggtagcactgttcatgatattgttgaatttagttgtaccacaatggcattttttcttgtttcttgtattattattattattattattattattagtatgttaaaaattgggcaagtgttattactaacatcctaagaatatatgcaatacgcaaaaaatataaaaatatatgcagcacagtaatatcacaaaatgtaaacacaaactactcaccacagtaatatcagaaattaaaatacacagcaaaagtgtgagcatagcacacacagaataaaaaaatatctagctcacagaattacatggtaatttcactagttaacaaatgaagcaagaacattctacaatgccccaatgagaggacaattaatgacatttagaaaattagaaaacattggccaaagtaaagaagtattgagaatttggacatcaacaaataagtaatgtaatacaagcgtgactctgcacattcctgaaataacgtattttgcaatgctccaattatttgaacagaaaacattaaacacaaaaaatataccaagatctctgttttggaacacaagggtaaactttcttcaaagtagtaaaatcaattgaagagccatcataagaatcccagaatgtctgtaaattattgatctgaatacaaaataaaaaaaaatcaatcaactacaaaaaacaagaagaaaaaaactgaatgaaaacgcatttaaaattaaaatatcataccagtaagcattcaatgtcttcaaaatagggatcacctttttcatgtaaagaatctaagaggaccaacattctgtcctttatatcaacaacaaaaaggaaccaatgttcaaggtgttcgatggggaaaaatagctgcaaaaaatcattcagaattaacaacataactttggaaaatttacatgagcatgaaaacaaaaaaaataccatgtcagaaaggtgcaacttcctagcactagctgctccaagaaacgatcttttcaccttgctcaaatcagcacaagatagatcagttaacaatagttcctgaaaaaaaattaaaagtgaaataaacataccaaaaaatatgtaacatatcaacattaacagaaaaaagcacaaatttgaaaaataactacttacaccaatagaagagaagaaatagtgtctcttggagtttgaaggatgattgttgttgaacaaaacacggcaaaacacattgataacatagctcaatacagtaccacctttcatgagagattgcccaaaagaagagaattttgctctaacattatcaatgtctacagcatcataactacaaaaaaaagatataaaaagaaaagcaaagtaagaaacatgcataatgc

SEQ ID NO: 59256 - DNA, 1890 bp, Oryza sativa
ccattatgcaatggattctatggagaatatccactaaggtcacatggctaccaaggaagtgagtgggagaaaaaacctgagactctcgatcgcaggtaacttcctaaatgcttgttatttagttggttccctgctgatgcttaccattgacctatagacatatttatcccattatatctacaggcaaagaaaaagatctcgaaggtacacgcaagattttgttgaggctatctcggacgtcgacccaaacttcgacagtgatgatgatatcattggtgaagcagtctatgatgaggaatatcttagaagtcgaaagcaatataaggccagacttttagaactcgataaagagttccaattggaacaagttgccgatgatggtaatgatgaagtggaatatccttcgagtaccagtgaagatgaaaaggagccccaacggtacaaaagattggctacttgcaatcctcgagggaccaacttgagaactatcgatggattccaaacatgcatcacacgaagtaagcgttccacccgcccacacatgaagtatcatcagtatgatctttctggcacagatacagaattgggaaagccaggtaaaataaaggtaccagatccagatgctggttctgatgcactaaatgacatggagctctcgacaactagtcaagaccaggaggaagaaggtgctgaagtaaataaagagcggccacccctgctttctcctagcaggaataatggaagcgatgggagaagatttcttgacttaaacgaggttgcgcctgtaggcggttttgatgaaacacagagtcgcaacggcgaaaggcgaccacctggataacaactgaggatcatgcccttgggtttagatactgagtaacattgttgatccatcagaggccaatgagcacccatgagagagcgatacaacatcattcatgcgtcaacctgattggaggtgcttttgtcaacttggaagaaccaagtgaagaaacgatatggtccatcataagtgcagctgtagaattaccattagctgatccagtctgatgattgtagaccatggtgagatgtgtgcactgatgtctggcacgcgtcaactgatagcgtattagcgtatgcgtgttagattgccatttttcttcttctttttgagtcattgtcacattgttgtttcaccccggctacatatgcttgcgaaatcgcgaggcctaaatgagtaacattgttggtgtggcttggccgcttcaggatgcattctctgcatgttgtcatcagtctcaaactgtgattcttgccctcccgtatttccaattttccatggcttgtgtagttgtgttgtgtatgtaattgtagcttggaacttcggcaaacgaaagctattcttttcttccccccatctgtgcttatttgaaccattctccgtacaagttctgaagttcatcatggaactaattcaaaccaaaatttgatttatcatgttactatcttttactatctccgtttcaagtttcaagttatataagactttctagcattgcctatatttatatagatgttaatgaatctaggcacacatatatgtttagattcattaacacatatataaatatagacaatgctagaaagtcttataattataatatgaaaaagtattatacttacaatttacacctgtttcaagataagaaacaccgtgaatcaaaaaggaaaatttcaaaagcaaatggcaacaagagcagttgggccgtagttgggctgggccaactggcccagattgacaagcacgataatgtgggggtgggtccgtgtcgcgcggctacaagagtaacaagaccacgtccgtctccaccggcgtcgcggagggatcctaaaccctaacccccaccc

SEQ ID NO: 59257 - DNA, 7180 bp, Oryza sativa
cgacatggtccgcgacaccgacgacgacatcccgcgctcggcgccggccggcgccggcgcccgatcgagcgtcagcgacgccgccaccgccgccgccgggagcttccgcgccgcgacccgcgccgcgccgccgtgcaacgcacccgtgaggcgcgtcgtagctggcgacgacggcgacgacgccttcaccgtgaaagccatgcacgtcgcggtgtgtggcggctacgtacgcgcggtggaacgtaaccgcggcgtggcgtgcgcgcgcgcggtgtgtacgacgtacgtacgcggtacgcctactggttcgatcgatcgggtcgcggtgggtgcggtggtgaactgatggcgttcgcctctcggcgtgtgcggagtttatataggagtagatcgcagcggcggcgaggggagcatggcgtgaggtggtacttggacctaggaacgaacgaagagacgagccgccagactgtccacgcaagcatgctaggctgcccatgcattttctctctcttttttcccttgacttttctattgcatgcatacaagatgaacccatgacccatttacttttaagtttgtggtttacaaatactacttcactttctacttgaatacaccgtactctctattttatccatttagggtttagaggcatatagtaagtttatagattttttacatttttttatttttaaaattccttcatacatttctttaaaaattcatgtcaaaagtttatatgtgtaaagtttacatatataaagttaccatgtataaagttactatgtactatctgcgtataactttccatgtcgaaagttgcaacatacaaagttagtatatataaaatttatatagataaaattactatgtataaattagtagtacatgtatcaagctataaattagcagtatacgtaaagtagagaactctcgatgagcaagagaaaatgcttgagctagtgggtctataaaggttttgcacgtgggctagagaagagggagtcaggggcatatggctgaaagatcagtggctcgttgcagttgctatgcgcgcacgagaatacaaaggaaagaaacagcgagcaaagccgatatgtacagctgaaataggtccggacccgttcgtgtagggcaaacgatcgtgtattagacccacccgatgccgcttgcttcgacgacctccgctcgggattcctcctatgaatacatgtgaaatggtgaattactactgtgcctctttaaaccttccaaaaaaattggagatacttacaccgtgtttagttgcaaattttttcttcaaacttccaacttttccatcacattaaaactttcttacacacacaaacttccaatttttctgtcacatcgttccaatttcaaccaaatttccaattttggtatgaactaaacacacccttagggcatgcacaaatgtagagtctaatatgagctctctatattaattaatgtcactagagactatcctcctataataatagagacaataagatttctaaaccattaatgcactaaatattttttttattatacttctttccttttttacaccctcatgcaacaaactttccgttaataaatgctaagagtcgactctgagccgttgcatgcgtagcaacgttgtttcttatttcttccatctctttcttccacatcatcaaatttacttgcatgacaacgaaaagagcccgttattagaaactattgcacatgcccttggtggacagatgtgatttgggacctccattctttaaagacgttaaaaactctttttatttaatttgtagattttatattttgcggtggagaaatagtaggaaacgtctgcttgataggtcgatgtcgtgggcacgcgggcacgggcgcgtcagctcggtttcggtttggagatgtgtcgggtcggaatagctagccccgccgtgcaaaacgtgcagtgttaagcagcaccactctctgttaatttgttcgtggccacacgctcgcgcgacgaccgttcgtcgcggatggcccagacacgatccaatactccatccctgacacttcagtacgagtacttgttcactgcactgaccagaccaaaccaaagcaacaatgaccaactgaccattccaatttcctctcgaccaccggcagaaacgaaatccaactgatgaacgtcaatgtgctcaaaaaagggggggaaaaaagctgatgaacgtgaacacaattagtacgattagtacctgctgatactggcgttgtgatagtgtctgcatgctctgctgactgctgatcaaacctgctgacgtgtaaatgctgacgtcacgaaaggagcagtacactagtgctccatcagcttagctagtgacgttctcctaaccgtccgtcgtcgatctctattcggtagatcggcgtatgactaaactaattggggaacaaacggagccatcgtttcggtgtatttgtgaacgaaaagtaatttatgaataaaaattttttatacgtgttcttagcaatatatttaaaagcaaaagctgacaaataaacttcaatgaaaaaaaccttaaaatcagctttaaatttaaggttaaaaatttaaattttggctgataagcataagtataaacgaaaagatgtggctctaaatttgtaaatcctaaaaaaagtgagaggacaaaaatataattgagattgaaaattgagacaaacaaattctccgattaataatactctaggttgtctctctacgtatatactccaattaatagtacatagcttgagagggacatcaaagactagtactaatacatgtttatgccttctagaagcttagcatgcatgtatttggccttttcggagtatatgaataatgtgctagaaaaaatgagtatatgaatttcacgaggaacaaatcataacaaaggaaaggcgtgtttcctgctgattgctaaattttgctagtactgatttgtttagacacttccaatttccaaaccatattggccttgcaaaaggctatattcgagaaatgttgcattccagcacccgtgcatataggaaaacacaaatcaatagcgcgtagaacatgctatagcatgtgaacatatatatgtcatttttttctcaaagagagagaacagatatatgacatttttgtgcactgtgcaaattaaacagggcccatattgttgcgagtgtacataatgcaacgtattttgcatttatgaatctgactgagcatatctgatactttgatttttttttttcaagttaaacttatttaaattatatatatatagggcactcatatggggcaccatggtataaaatacacaaattcgtctaaatttttcaaaaaatttaaattgttagtatatacctagttataagtattcgattcatacctatacctagaaacaaaacaacttaaattcaactttatttgacaatccagtattacatacctaactaattatatatttggatgctatatacctagaatcaaatcctaataaaaacatgtttaaattcaatttaaacttgttttgaactagttgtatagttaatattaatacctaaacatttgaaaaaatttcatactcatttgaattgagtatatactcaatttgaatcatggagcccaggcaccatggagcaccaaacaaatttatatatatatatatatatatatatatatatatatatataatttttttaatacaaatcaaatatattattaaaattatattttaatgttatatgttgctaaatttttctaataaagtttggctcaaaacgacatacttacaatatgaattactataacggaagaagtatcttggtagtgcacgtacgctccataatgctgggataaacttacattgatggatgggctaattaattcctaataattggtccgtttattcgcgtaaacaaacgtgtcctaattgcgaccatcatgatggtgatgtcatttccaaattaagctcttcagaattttgctggccgacaccacgtggaagacaaggcctaagaatagtcagagcggtggcgtttaatttccttttgttttaaatttctttcagaaattatatcacccacacatgcgcagtgcaacgagaatcacaaacggcgtgcacatatatggggaaaaagaatccgtgagcaccgtagcaactactccagcaactgtgttttcaattctgcaaatgctattctctgttaaaaacaagttctatatgacaatatcactccgataaattgtctaatctaaaaaatatttctgtagactttttttaaaaaaaatcatacttttaaaagcgtggtaagaataatctaagctatagactcatacttttgaaagcgtggcacaagaataatccagacatacagaacgtaactcaacttgttaattaggtttttctacggtggaaccaacacactcatgttaaatcatggacttcttgatatgatactcatattacaactaatttttttttagtggtgtgaagacttgacctgcgtcttttttaaaaaataaaatccaaatatacacggtgttactggatctcccggccctacagaattgggcgagatggtgactgatctcatgggccatgacgtatacaaacctatatgggccttcgctctatttactggcccggtttagacattggcttcctccttacctcgggaggcctcatttatatggaccttgatttcagttcagattccaagcttacccacccacctaaaaggccccaatttaggcccatcacatcgaggccgaaacgcgaagtgacagtgacaagggaaggacggcccacgtacagcccatcaaggcccatatccacttcgcctcttccctttgatgttgcgagtgaataaagtcgaagcgactcctcctccgatccccacctcgcttcacactagccgaggagacgcgagcgcgagctgctctcctctcctcccgccccgcgtcgccgacgtcgaggcggcggtcgacgtcgacgtcgccggggatggccgggcagcagccgcagcagcagggcccaccggaggacgactttttcgaccagttcttctccctgaccagctccttccctggcgccgcgccgggcggccgcgccgccggtgaccagcccttctccctcgcgctcagcctcgacgccgccgcggcggccgaggcgtccgggagcgggaagaggctcggggtcggcgatgacgccgagggtggcggcagcaaggcggtgagtgcgcgcgcgcgcgcaatcctctctccctctcgctaactttccccatttttgcttttgcgttggctctcctcgttcgagtgggaacggaggcgcgtgtgcttgcgtgataagcttcgagctcgcctctgtaggatcgggagaccgtgcagctcaccggactcttcccgccggtgttcggcggcggcggcgtgcagccgccgaacctccgccccaccccgcctacccaggtgctctgttgcagcagcggattgtgtctcagttcgaaatcggcagagctggtgctaatttttgttgtatttgggcggccttatggcgaatttttcaggtgttccacccgcagcagtcgaagcagggcggagcagccgtcgggccgcagccgccggcgccgaggccgaaggtgcgagcgcggcgtgggcaggcgaccgacccccacagcatcgcggagagggtaatcaaatcagttcccgcagttacactctcttagcttatggtctttcatcttgggtattttactgttgagaacttgtgatctgcataagtcactgtaccattcagacatgctgtttggcgtttgtaaggtgatcagggtttaaatttcaatgcaaatttttgctaggtttagaattggatttggtggttcctacatgcttgtaatgcagaggaaataatcagttgtctcatgctacgagtgagtcaccgaagcagttctgttgtaatgtgagactgtgagtgcaataatgcactctcttgttaggcaagtcggatcaattaggactttcaaattcgaagggattgtcacccgtgatttttttttctcagataaatgtacagaacaaatccaatttgtaagaaaaatatagcatgttctaaaagaggatgttactttagatagatgatggccggccatttggcgcagttataaggtgttttccttctggtctgtactattataccacaagtcttatctttttgacaattgatatgtcatgccgcaatcctgtcatatagcaaatgtcatgtaattgttatctagctgtagaatgcttctgctttaagataggttctcagtactttgtttctagcagttgtagatgtgtccgatgctcatttgctgttatttatatgaatgaccaccttactttaggctgcatattctcacttttcatatttttttttaatttttggacaattcttctaagtgtttgatcagcagtgctctgaagcatatttgttctgatgcagctaagaagagagagaatagcagaaaggatgagggccctacaggaattggtccccaatacaaacaaggtaatattatttgttatacttttaggttttattataagggtaaagacttctgtggttcacatgctagccattgaaaaaattttggcaagtggtttgggtcatgatgtgctcacaatattatattaattcttttttaatataaattttcttctttaaaagagtgtttcggttcactgagaaccatgcgatcaaatcttagtatgctgtcccttttgagataagcaagagcgcatccttagggttatatgcatgcttaaaataacatgtgattttactactataatacagagttccgtaaattgcaacatcagaggttgactatgggggaaataactctgatgtcttcttgaactatgcagacagatagggcagctatgctagatgagatccttgattatgtgaaattcctgaggctgcaagtaaaggtttggttcactatgctattatctagtaagcataaaccacattttgtgtttttagttgtttgatagagcatgattctatggtggtaggttttaagcatgagcaggctgggtggcgcgggtgctgttgcacagctggttgctgatattccactttcagttaaggtaaatctgtggccattaactaatatatag

SEQ ID NO: 59258 - DNA, 1625 bp, Oryza sativa
agtatcatctccctatcccacacctgaaaaaacaccagacagacttgaaaagtaagtaaattgagcttaacggcaggtttttcacatggaaggaattatgtgcaaggatcaaggaagttgattacatgatggagattggatttgtgcctgaaccagcgtagattaatcgtattgcccccttggtcgctcgtgaacccaacatgcattggctggatggacagataaaatagttagtatgttgatgtgtatgaactgttgcagggagtgcatgagagtagactaattggtaaggttacctgatgaacatctcccatgaagtgtgacaagaatagcagtgcttcagtcatgttatctgcgttacaagcagttacaacaatatgaaagaaaatgaacagtcagacaagagatacatgacaactaaactatattggttgatatgatatactacaactgcgtagttctcacatttgcgatcggcgctgccgtgattatagtgcataagctgagaggtgaagttcgcgatcgcgccagcgacgcacatatcctccgcaccatccgcgccatggcaatcccctgaaaacccaaacgcgacagacagatcaacatatacaccattatcacagcagattcagagtatagcataattcagaaactgatggaggagaagagttgcctaagcgtacttgagtagacgaagctgcaggctttgtcaggggtgtcgatgaagtggagagggctcgtccacctgtacttgtaccagtgcctgacctgatccggccacacgcacagcgccgacaggtcgccgtccgcctcctccgtcagcaggttcctcaccgcgtgcgccgcggcttggctccagcagatcctgcatccaacacggcatcataatcatcagtcattcagcctaaatgttcaggaatggttcgattgatagtgatcattcacctgcgcgattcggcatgtgagcatgtgaccctccttgctccacgaatgagccaccggcgccgacgcgaggacgagcactgcagccgctgccgctgctagtagaaacgatgagcacttgtctgatgccattgatcaacgagacgagcttgatcctgatgagagaaaacaccgggacacagcaagtgatatagagcagcatgcagcaagcggagcagtgggaggcaatgatttaagcttagcttagctagccttcgttgagtgcaagcattgtgtggcgtgttaccccgcatgctttgcttcgcaccatcaaccaatcgccgttgggggtggtttcgcctttttgaaagagctactaggttgctgggcctgggccgaagcagattctctcgtaatgggcctcatcagacggccacggcccatttctcgcttcacatggccgcattaggctgggcttaagggaggcgaaacatttcgcggggacgaggataacgtctgcccaagcggagcgaaagggatgacgggcgccgccgccgccgtctccccgctcgtcgcgtggccccgctccgcgcccgcctcgcggggcggcaggcgtgcggcgcgcgcgtctgcgttccacccggacgtgtcccgcgcggtggagtcgctgcaagcggagttccgggaggtggaccgcgcgctcg

SEQ ID NO: 59259 - DNA, 6266 bp, Oryza sativa
aacggatggataagagaacatttatgaatgtctgcatccaacatggctgttgcaacgctcttggtctgtttttcaacgatgcagcgcactggcgacagaagacaaatacaagctactttgagaacgggaaaaagaacatatacaatgaaaactttattcttatgcgatccaagatagaccatttgtaatcaactttagacgagcaattttacagtacttaagaaggtaccataagatatcaccttttctattgtaaatttggtacctcacaatacctaggtactaataggtactatgaggtaccaaattttacataaaaattttggtacctcatggtaccttatcagggactataaaaatgctcacttcataaacatatatttatactagtcgatagcctgcgttttgctgcgggatatgtttaaataatgcaaaaaaatgatgtggagataatgatttgacattgcttctttattaagttagttttaaaaatacaacaaaactgcaaatgatatgttatgtttgtatgatatttaaaatattctaaataataattgctatagtgggtaatgatgtgatatattttagctttaaaagtcggtgggcatcaactatatagatattacagatatgtctccgtttgtgcatattcaacatatttgtcaacccaaatattagtatattaagaggtacagaaaataccgctagctgtagcctatagtactactacaggatagcgccactcaaaactgaaaattttcaatttgaaaaacattttcaaattttgatttgaaaataggcaaggaaatctataaatatggtgcttcttcccaagcgagcctaatttgccacaattgcatggaaaaaccttctttccagttgagccgcttaactccgtcatgttagggcggccacctgggataatcattttccttacgtggttgggtggccagccttcaataattaccaaacatttctcatagacatctgcgagccgcctaaccgctttgaaaaactgattttagctgtccgctatctgcagaaatcttttccataaatcttttctatggtagtggcttaaacaaatctctaatattataaaaattgaagatgtttttgccggtattttggtacgtcgttcttgtttgagtcggtttttaatttcgctcacttttaaaaatatagattaatgtttgagtcagtttttatatttgttcgcttttgtaaatacaaaaggagtcgtataagaaatatttaaaaaaaaactcatatgctaacttgagatgaaagtcggactcctaattgcagctcatgattttctttaaaaaaatcaagtgaatttctagagtaaattttatcttagctaaaccgtataacaataataagattaaaatatctttcaccagttgcaatgcacgggcattttttctagtaaggatgatgtggcacaatgtgagagctggtaatgggttagagatgaaccctgagctcctttcgataagctcatggctttgattggcatgatatttaggcgagttgatgataactataatttggaagaaacgttaacgacatgactacaaccgtacgagacattattgtgttgcgctttagtgatcaatatacctctccgcgagtttttaatcttgccggtgcagatcaaccttatttctgcaagcaaatcaaagaaacaagcaaaacaagataaaagcaatctggattacaaatagaaatttaatacaaataataagttgggtttccgtaacgagcaaaccggcgatctaaccaatcacaagattacatggcaaatagcgaagctaaactttaatataaacaatacccaagaaaccctgaagggtaccttgttatttaaggaggtgggaggaccgccaaggggtctctagggtcatactccaccaggttgggatgcacccacatgggctccacttgtgccagggttccaaattgaagttacaagcctataggctcatcataggtgatgtagcatattgtttttgtgatttcaactgactaagatggaatttggagatgatgctagattcattggaaagagaactctgagagctttgcatcatgtactcacaagttaaaaacgaagcttctatgtatatttggtggctgttcgaaatcaatattgttgtaggtgactgaactagattccgtaccttttacggcttgatctcgatatctttcagtaaccatggtcacattagttggatgcacttgtatccaaagaaaggatggcatgtttctaactcctagcacatgaatgtaattctagtttttgcagccacactgccactcaatggctagacccacaagatgacccggtcgcaatcacgctagacgcacccgagaaaatgacccggtcgcgatcacgccacacgaacccctcacctgccgcgatcatgccacacgaccacctgcagtcgtcctcgctgctccggttttaaatgttcgctctggagcctcttgtccgctgccgcggcctccctcgttctcccgttggtgagccggtgagtgtcccgggtttttactcccatcgcattgcacccaaaaatttttttttgtgctgctctctgctctcagattcatcacaatttactgttcgctcacagtttcaggtagctccagggggcctatctgccgcggccctcgtcgatctggccatcagtgagccggtgagtgtccccggtttccatttgtttgcctttcttgctgccattttcttttttggtcctgcatctcacattgtactgttcgctcccagtttcgtcaggcaagaaaagccttgtcagctgccgccggccggccggtcggcggatgagacggtgagagagcctctcctccatccccagaccccagtgccgtccaattgcctatatctaatacttgtcgactttgttttcattccaggtgtatgcattccggcgttgcaacggaaacccgtatggaagctcgcggtggactgaaacttaacaggtacatcattcgtcccaaaatatagctatttttagcacagtattttatactaaaataaagttatttctccactttcctcatcctttcaaccaatcacaaccatttttctccacctattttttcttttcaaccaatcacacacttcttcaaatcattctcatctaatttcttaacctgtaccaatcttaaaaatagttacattttaggacggaggagcttcgttaaaaaaaatgtataggtaattaatgtttacattgctgttattaccgcagaaggatcacaacgacacttttcatatttgaaccgatctttcgtcacaaattaacttttggtcttctaaaacattgcctcaacatccataaaaaattcccagttataaaaagaaagaatatgagctataaatttaattaaattcatcttaagcccatgttttcggtgattatataaaatgcttcagttagagttttaggggagcagctcattttgatttaatcagtttttgctaaacgaatgaaatggaccgattaatcgcgactatatatccactgtgccgcacgccgaactgcccgtatctaatacgtacttctctactttgttttcataccaggggtatgcatccccgcgttgcggcgaaagcatgtatggaagctcgccgcggactcaaacataacaggtaattaacgttaacattaattaattgctgtttatcacctcggtaggccgacttgttttgaactgatctttcgccacaaacttatataaaaatatatgaatcggcatttaaaattctaagcaaacagaaggagcaacacagtgataaaattcaaaataactgtatgtatgtatcgccagagggcagaatatactccgttttctaaatatttgatacagttgactttttttaatatgtttgactgtttatcttattcaaaaaaatttaagtaattattaattctttttctattatttgattcattgttgaatatgcttatatgtatacatatagttttacatattttataaaaaaaaaaataagacgaacggtcaaatatgtgctaaaatatcaatggtgtaaaatatttagaaacgaagggagtacattatattaggaaaccttgttttgtacttactagtggtttatggggtgatttataattattttcataagagcatgcatgtttaactccctagctagctacacagtcgtccacaacttttatagctggcctgctgcagcctgcccatattatttgtcctgcaaagcgaagagcagtcatcacgcatcagtagggtagatacatagattatgcatgtatacggtacgtgagttagcataggcagctagcttgccctactgttatgtactctactcgaccacctgcagctcgtcgaccccggcgcgcagcaacaggccacgggcaaaacgccagtgaacacagactgctgtgagattactctgcggcattttttttttccaacagctttgtctcattttactctgtgccatatactcacaccttctcattttaaatgcagcaatgattttctacacctaactttaaccgtccatcttatttaaaaatattttaaaaaaaattaaaaacataagtcacgagtaaagtgctattcatattttatcatctcataacaaaagtactaactataaaaaaatttcaaacaacacggacgatcaaaattgggcgcataaacttatggttacacttaaaatgcgacggagcgagtatataatagcccgttataactagttttattagtcgacaaactagctatttttccttaaaaaacaaattaactatattttttgttgcgtagtgtgtttatccatgcaatatatatagcctacacctttttagttaataatcaactatgagaccttgcttttgtgggaaaaaaaatactacattgttagcgcaagggaacggcaaagccatgtaatggtacagttcagtagtaaattgtcggactaacagtagatcagatcgaaagccatttaagtttgttaatttgttcacttttttattgttataatatatatttgctcccgcataacatttttaattccttgaatatatcgctaaccattttaccaagaatttgtaatgttttctgaaggagtaacacaaaagtgaaagaaatacgaaacaacatttgacaatttaatttggcttagcggtaaaatttgtaaagttttctgaagtaacacaaaagtgaaagaaatacgaaaaaaacatttgacaatttaatttggcttagcggtagattgtaactgatcttaagcatccctaatgttgtaattattttgtacatttacagaaacttaccagtattatatgttgagatttgcgtagggtaatgtttggtcaggtcttaagatattgaaaaaaatacgtatatagttaatccataaaagaaggatgtattcttttttttttaacttggacatgtttttattatttttgctccatataatattctactttagagtgttcttttaattgcatttcatgatagttttctaaagtgtgaaagaaatccatctttatattctccctactatctgcagatgcagtacctccacgagcttgaaagaaattattagcactaatttgttgatcctggtggcactatcatatctagttcatgctgtcagtgcgcaatcactagatgaaccattcaggtatatactgtatattaaatgcttttatattgtcaacgtgcataaacataagttatttttgaattgatcttcctttaattaaagtagtttagagtataaaatgaacttttcctttgttaaataaaaaattggattctaaaattaattatagtaagaagaaaactttatgcatttctctcatatataattaagagaataaattttaaaacgtttttaccttatgtttagacatttcaaaataatttatacctctaacattatattttatcctattatataatattaaaatggatttaaagaataattttattttcttttagtacagatgtgatttatttatacactttattactttcagttaagcaagtttcaaagactttttttaagttgtaggtaaaattttctgcaatttaattgacgggaagaaatgattatttgaaacaaataattatgtccaattgtactttcctattgtgttcttcatgcatttctagtgctagtactccctccgtctcataatataaggggattttgagttttttacttgtattgtttgaccactcgt

SEQ ID NO: 59260 - DNA, 615 bp, Oryza sativa
agttgtagctgtctcatttggtgaagcttcagttctgatatttgatcacagctacaccccatgtactgaatctatgggaaacctcttcccttcccattgtatcgttagtgattttaaatcaaatgtactgcatttttccacggatgtgagaaaattggattcttctggaattggatgccatcgatccacaattgtagcgtctaaaaaaatgtcttcttgatgtttccgattcgtgtaatacttgtgatgcagccatttgcgttatagacattggactaatcttccattcttggcctgttcatttttccggtagcatcttggtgaagactgaaagtgattcacctggaaatgcagagatatgtgccagtcagtaacactctgtagattgtagacccatttttaattttggcgtggtgctaatataatggaagataggagtgtgttgatggaacggtatgaaattgggagacaattagggcaagggacctttggaaaggtttactatgctcgtaatcttagttctggtcactccgttgcaataaagatgattgataaggagataattatgaaagttagtctcgtggagcacattaaagagggagatctccataatga

SEQ ID NO: 59261 - DNA, 759 bp, Oryza sativa
ttgagatataaagcgttgaaatacactttattggatgatgagctttactatcgaacgattgatggggtgttgctcaagtgtttgagtgccgatcaggctaaagttgcaatcggcgaagtccatgaaggaatttgtcgcactcatcaattggctcataagatgaagtggttgcttcgacgtgcggggtatttttggccgacaatgctggaggattgtttttgatattacaaatggtgtcaagattgtcagaagtttggggcaattcagcgagcgccagcatcggctatgaatcctattattaagccatggccattccgaggttggggaattgatatgatcggtatgataaatccaccatcgattaaaggatataagtttatgttggtagcgaccgattattttaccaagtgggtggaagcgattcctttgaacaaagttgattctggggatgcaatacagtttgttcaagagcatataatttaccgatttggtattcatcaaactattacaactgatcaaggttcaatcttcgtgtccaatgagtttgttcaatttgccaagagcatggacaacaaatcgttgaattcttcaccttattatgcacaagctaatgggcaggccgaggcgtctaacaagagcttgatcaaattaattaagcggaagatttctgattatcctcggcaatggcatactcggctggccaaagcattgtggtcctatcggatggcttgtcatggatcgatccaagtcccgccttat

SEQ ID NO: 59262 - DNA, 9862 bp, Oryza sativa
ttagttggacatggaaaatcagtcttagcaaataatttctcctccaaattattgagctcacaaaaatcatcaaactgaacatagcccaaagtatttaaataagttatcaaattacgttcctcaacatcattagtaatgtgaacaacatgcttaaaatcagcacacaatgaaacagtagatatagcatgttcattcactagttgtggcatggatataagtgaagcattatcacacaactcttctttatcacaaggaacaacaaataaatcaacttgtgacaaaggcaaatcagcaattggttccactaatggttgctctattatagcatgaaaattgacacgtgtagctcagcttgagaatactcaccttcatttatctcagcaccaattagttgacgttgcaaactttcttcagactccgctggtgcaacatcctcttttttctcaagtacaccattctccttttgttgaatgttttgaactccctgcaaaacgttagtaacgggagagacaaaagattgctcctccaatgtttgcacatcatcattttgcacatcatcattgcataaggatataggagattcagaaataggagataaatcacattgttcatacttcctcccatttgatatgatccgactctcaatgctaccagcaagcatgaataggtgtccaatatgattatatgtcacattagcaagcaaaacctgaatttcagaattaagcccattgaaaaatatgcgcattgtattttcattgcactctttgagaccactgtagatgatacagacctcaaattcatgaatgtactccctaatagttctatcaccttgtttcagatgttctaatttctccgaagagtacatttgtaataagaagtcacaaagtgttttcgaatcatggttttgaattgatcccaagtttcaggtttattactcacataactccaccaaaagagagcagaagaggtaaacttattactagcagccttaaccatttgagcatcagaaaaatcatatttatcaaattcattgtctactgctagttcccaatcaatatatgcaacagaatcatacttcccatcgtaaaatagtaacttagattcaactcgtgcaaaattatagtcaggtacctcatatgcatcttgtggagaagtcgacatctctcgtcgatggtgaagaagccgatgttgagcatggccgtttcgtgtccccttgcgcaatcctgccatggttagtagcaaacaacaaacataaacaacaatatgcatggtcctatcaactactaggtagtggaagctccaatatcacatacactcaagctttttaccaagctcttacaagttcttaccaaagcaagcggaatggtgatgtacaccgactcaaccaagcacctcaatggaggttggatatatcgatgccttggcaaacaattgttgtacggctgcaatcaaatctgtggagctctgggtaggcttaaatatttagcaaaggatagcaattgcacaaatcagagaatgcaaagttgaataatcgtttaaagtcaagtaccgtgctagtcctaggctagaacgtactagagacgcaagcttagatacaaacgataccacaagataacaccagaaacaattgaagcacactctaatatatccaaattcagctcaaagatacaactgcttttttttatttctttcttcttcttcttttttcttcttcttgttttttttcttttttttctcctttttttgggtgcggctttttttttctctttttttagcacctttctgcctttttttttcgtttttctttaaaagaaaagactcaaggacctcaatgtaaggtcatagggactcaaatgtaaatataaaatatacagggactcaagtgtaaaagtccaaagtaaaattaaaaattatataaaaatggaatgctgaatttatacttgttccgtttctccaaacagatcttggaaccgacaccaaacaaaaattcaccaaggtgtttgacacaactcggaagaggcgaaaccgacttgagagggagggagtcggactcaggtaaagtgggcgacaagaggagatggcgccaaccggtcttcacgcgtgggggagggaatagactcggcccaagtggaaagtttggccttagatggaaactaaccaaccggattgatctaatatgcaaaacttcctctgaaaaccgatctgttatcctcttttctaccgatctgttatcttcttcctcacacacacatgccgttccatgcacacacatgcacggcacaaccaccgaacagaagcccttagatgcaactcaagaacttaaaaactaaccgacagaaacttctaaaaactacaaaaatagaaccgtggcagcgagctgattccattttcgtaaatcccgatgagagcaaacatacggcggcggcgatgatagtggtactaaacgtgactaaaaatcgaaactctaaacgaactagacgctaagaccagcaacacgacttgacgatgcaacacaaattcaacaaagcaaaaacggaaaagaacaatgcaatggcacaaatatagctaggtgatggatgtaactttttttttagctttttctggttataggtagataaaaactcaccgagcaacgaaaggtctgataccacatgatgaaccctgagttccactcgacactcaaggcagttgtttggcccgatctttcggtgagttatggataactacaatttgagagaaacattgacgatctgactacaaccgtacaagacgttgtgttgcgcctttgcgatcgatacacctctccgtgggttgctaatcttgccggtgcagatcaactttattcctacaagcaaatcgaagaaacaagcaagaacaagataaagcaatctgaattgcagacaggaatgaatacacacgataagttggggtttcgaatacaagcagacggacggtctagccgacacgcgcgctacaaaagtagcaatggttaaactttcatcaaaacaaaacccaattaaccctgaaagggtatctagctatttatggaggtgggaggaccctacgacgtcctccacctggttgaggcgtaccccacatgggccccacttgggccggggtcccagatgaagttacaagcccataggcccattacaggtgatgcagcaccttgttccctcaattgcgcatgtttgagaaggagtttggtggtgaggctggatactttggaaaaaggactccgagagctttccgtcaagtactaatgggtcgaaaacggatgtcgtatgcagattcggcggaagtttgaagtcagtagtgtagcaggtggccgaataggattccaacacttggaaaacttgatcttgatatcatcttgtttatccatgatgtgagcaacggttgtatccgtagtaaccatgggcacatcaacagtgttttaaataattcaattaggttaaaagtaaaaaaaaatgacacataagttgtttcgtagtaagtatgtctaaggaggaataagtttacattaatcactacctttcttataaataatggaggtatagttccaaccttttcatataaaaggttgtgtttctcaaatgtgctttcttgcgcactcattttaaaatatacaaataatcagtttgaaatatatattttatatttttataaataagaaaatacttagaacatgtgacaagtttttaatacacgcatattgttatgatgccagactcagtcgtcatatagaatataattacgattttagtctcttactgtctaaatatgtcactgattgttaggataactaatgctcaacatttaattttgaaaatatcaaacactcatattcaaaagaaaaagatatggttgtataattttatacgatattaacaaagtgcccgtagagtgagctataaatattaatcttggtggtttataaatatatacaatctagctactaaaaatttttttaggacaaagatcatatatttaaacattgtcaaataacatgttaagtaaaagtcactatatatccctacggcaataaaaacaataaaataaaaaataagatgtccatgcatgttttattccttcacatagcatcgagccaatcaagctgctaatgcaaagtttttttggttattatttatgcattgattgatgataatttgatctaggtgcgttagtaaattttcaattcctgtgttttctatgctccattgaaacattcgttcttttcaatactctactttacacatgtattattttcacacttttcaattttttttttcaatgctgtgttacaaaggaacctttaatttctttcaccgagagacaaagtcataacatttcataattgtaataacacaaattatgatagcttaaataagatgctcgcgcaaatgcgtgggctaccttcctagtttgtattaattaatatataaaaaacagaatacaactttaaggagttaactaagataaaatagaaatattaaggctagagttgaaacctaataacaaaatgtgatttcacatagagtgctcctcgccagtagacatgttgctcgaataaatatagcctctgagcgtcagccatggtccctgcaccatccccttatctaatgaatgatctctcctcccatcattccgttgctgatgagaagacatgaaggataagcggcgacggtggacattctgattccttcaagacgggatccatctttcaacgctgtaccgtccggtgttaacaaataagatcttaaacacctcgtagtgcggtgatacggtggggtcgaagacgatgcattctttgtcgaagaacccaaattatagctcgggttagtggcagggcaatagtggcaagctcacccacctccgagtggctgggttcaccacgaggagagagaaaagcaaaaggaggccgttacagtggcccatgatggtgggatttttttcacagaagtgctaaacatcagtcgactgaaaacctacctccaaatcttgcaaattttggttcactagatgtgcttcgtgattcatgctccagctgcttcttctccaactttgtcacacccagaaattcccgaatagatttccaaacagaatgtgcattaaaacccccgtctaggaccggctggggtacacaaatgacaaaattgacacacagattcacgtcttacaaacatcataaaagtcttacacaaatgcagcggaaaattgaaagataactggagctaagccttgacttggactgcagcgggaacaccactccacaggcatcctcgacggcacggatgaagcctactcctcggaaaagccaccatctgacgcgtactcaaactctggggttttgggggaaatagagcaagactgagtacaaccaccgtactcagcaagtcataccggaatagggggtatgatgcagggtattatcaaaggatagctagagtggttcatttgcatacgagcatttataaacagtagttgaaagcagtaaaaacagttgtaatagttactcaatattaaccatccactgtccaacgctacaccacgttgcaacaggcccaaccatccacctgagctaatcaattccattagactagactaaggtgagactaatcacggtgaatctagttgaccgcccagaacagcgggcacggctgttcgaatagttttactctgatcagaggtgtacaactgtacccacaagacacagccccacgacacgtttccgtgcgccgacatgccaccacgacataccggaaagaggccgtgacaggacccttcgcataaccccctctaatcaagcacaccatacctcaggtttcacccccgtccccagcgggcaacgggcagtcccctctcgtgcctaggtgaatccggaagcgacagaggccgtcgcagggcccgccccactccatcacgcccacccttgcctggatgcgtcagctagaggaaagctacactacaagcccagccgttgcccacgctggcttgtggtgagtacgaggaattcttccagggtttcccgcgaaccggtccttaagtgccatgggtgcgaccatcaaaaccatacacccacagcccaccatttagttaattttaattaaccaacaccggagcggtgacactaaaccaacatgaacactaaaacctgaagtctagtcattaatgtgattcccccattgtgtgctagttgaactaagcatggctaagcaatccctagtccaatatctagtcatgttatatcccaggctaacaaaggaacatggtacaaatatcatggcggtaacagtaggtaaacatcccatggtaacattataaaacaatgcaatatttaagggaaaacgatagagcatttgtaatataggttcaatatgttcaagtgacaagcatgacttgccttgctctgctgctggaggaaactcggcgactatttcaaagtacaccggagcgccggaagagccgcaatctaagcgacatacaaagcaaacaatacaaacaggccataagactactgaaacaaagaacaaaattatttttaatggattctttgcatttttcttgatttactgagacttgaatgggcttaaacagagctcggatgaattttctatgaattttagaagattcactaagtttttactataaacagaaaaacccttaaatgatttattgtgcaataaataaaccctgggagagagagggggcggcgccgacatgcgggccccacatggcagtgactcgggtggcggtccgcggtggaccggttcgacggaccgggaaaggggcggcgcaccacgtggagctaacgtggcaccgatgcaggggccacgcggcagccacgcgggcggccgaacggacggccccgatcgacccggggtggatcggacggcagaggggtggcacgtggccggcgcacacgggtggctcaagccggcccggcggccacggcgcgcggcgacgtggcattgacgcagcggtggcgcaaggcggcgaccggctggcggtggagggcggcggcgcggcggctaagcggcgcgcgagagagagagatggagaggaggatgggcctcaccgaagaatattgacgacggcgagcgacggagggcgatggcgacggcgggacgagctccgggatcacctaagggaacaaaaagggaggagttagagagggggagagaaaccatggatggctagggtgccggccatggcgaagctcaccggcgtgcggtgcgaacggggttcctgcggcggaaaacggcgacggagaggcggacggcgtggccctcgggctcgtgaacccgaccgtgacgatggcgcggctcgccatggcggctagcggagtagcggcggcggcggcggagtggagggcgatggcgctagggcgatggagggcacggggagctcggcgaaatggagaaaaagagagaggggagggcggtgatgcttaaatgggggagagggggctcggacgtggctgggagcggcccgatttcgctggccgacgtggggaggtggaggtggagagagaggcgggatttgaaaatcgaatcccggccgtctcgagcgcggacgcgggcgggagagagagggagtgggtacaggagacgaggggaaggcggcgacgtgggcgacgtggctccgggaggcgagagcggcggttgcgggacgcagcggcgccagccagaggtgggagacgggcccgacaggtggggcccacctgtcggtgaccctaggggagaggggcgtggggcagccggcttagctgggccgtggccttcggccggcccagtggggagggggagggggaggggaagagaatgggccggcggcccattcgaaaagaaaaagaaaaaaagaaaaaaagaaaaagaatttctagggattaaatattgcttgtgctcatttttaattggttaaaattatttctagatctccaaaaattccattaaaaatcttgttagcatatttcgacatgtagaactcaagaaaaattccacatgccaattccgattattatttacattactttctttagggtttctctcttgcttttacaccgatattttgttgagaccatttataaattccatttaggcttgggataagaacttcagggtgtgacaaacctatcccccttaaacggaatctcaaccccgagattcggaagagctggcgaagaggtgcagatgggcggccttcaactcgtcctccctttcccaggttgcttcttcctctaagtggtggctccactgaaccctgcagaacctggtaaccttatttctggttctcctttcactggtctcaagaatacgaactggcttctccacataagtgtggacccccatttttataacaggaatcaattgtgtaaacagtaccatttccctggatcaagtagtctggtacacacgaattcatagctaaaataccaagtgcacatacacgagtgtctagtacgaattattacatcataagcccgcaggcatagttttaaatcatcgaaccgagcggtccagaatacatcccaaaaatagaagtagataaggcagcggagttaaggcagcggcacgccattgccacaggcaacgaccgtaactaagacctactgagcgccatcgtcttcatcaccctcctggtagtaagcgtaggggtccaccgaagcttcatctccgacctctgattaagtttgtatattgcaagggtgagtaccaaccgtacccagcaagccaccacagcaacaacacacatgataaagggtattcaaggaatggctatggttcttttgcacaaagcaagttttgtaattcttttcacaagcctaagacctagcatagactgatcaagttttaataccagtgttcgcattagacaacgacggttctatccaccatccattgtgatcccaaggatagcttcccgccattgaatcgtcatggttttctgaggacgtccaccttcccgcctctcaggaagtggctccatcagtatagaaatcattatgcaatatcccatcccatacaagttaagaatttagagtctagccaagtgtaatacatgtcccggtgcttaataaccgcgagcacggctattcgaatagatttggtttactcacactgcagtggatatacactttacccgcactccacgattgcccaacacatgagcctcatcccaacacatgagactcgtcacggcaaagcttttcgataaccttgcattggcagtacccgctccatgaacttaaatcctcatgcactctaggcgtccatgtttctagcagtgagaggagttctggcgctcccgggaaagagaagtctcacacacatattaaattatggttcaagttaagttctctctcacacacactcatggcagtcctaccaatggcgacaccgatgtagggcacgcctctcggccctacctcaacggctgtcccaccgtagcgcacctgcctcactcggggtgaaccatctatgcagggatactgcctccgctgtcacgtcgcaaaacgactctaaaatacatcctctaaattatgcctagaataattaaaatccgtgtgaaagcctccaacaattaaaatgtggaaagttaaaagtcaaataaggcttggaggatttttgtatatttcctaaaagcctaaaatgcgtaaataaattttagtggaatttttagagcacaaataataattattaagaaataaacaaagttaaaatgattttataaaaagaaaaactctaaaaagtcccctttccctgcctctcccacttgggccggctcggcccatctccctccccctccctctcctctccccgcggcccatccggcctctccccgcgcgcgcgccgctgacggg

SEQ ID NO: 59263 - DNA, 7458 bp, Oryza sativa
cgcccgggtttgcccgagaggagagaagtgagagagagaagggagagaagagaggaaagagagtggctgaccaggttgacacgtggggcccacgtgggtcccacgctgactcagctaccacatagaccaaaaccgggatcaaaaccgccgaaggacctcgggtgaccggttttgtatagttaagggaccccgcatatctggttttgcggtttgaggatgcttttttaatctcgctgacaagttgagggacctccagtgcactttttccgttttaatatgggtcagaatggtatcccaacgaacatgtggcctgttctatacgggctggtccaattttgaggccgggaaagccgtgcggcccggcccgttcgatctatctctttccctcatgtttccttccttgagtttgttctagtctactggtgtcaccaactcaccattgattggtttatctttgaaaaaagaaattgtgcatgcttagatatattcaaggctgactattctcctgtaccatgtcaattatgaaaaaaaatattgatataaaaaaattattgaaagtgtccttctgaattttctcttccatgcattcagcaggccatggagaccctataagacagtgctccatggatgtccacatattgggattattcatttatttgaaattttggatatgccgtcaaacatattttgatgtgccttttcagaaatgtttcaaacgagcataagaaagacttgtcgagttgtcgcatgaatacagcgtgttagcaccaaagtcactgtccatcagaaaaagcaactgcgagacctcatgaattgaccatctatgagcagggaaacacacttgcattatcggaacaagcagaagacgcaaatatttggaatcacatttggattcctcggcgaggtctactgcaagtaagcaagttttatttaaaaataatactccctccgtttcgaaatgtttactttttatcacatatttgaccattcgtcttatttaaaaaatttaagtaattattaattcttttcctatcatttgattcattgttaaatatatttttatgtaggcatataattttatatatctcatataagtttttgaataagacgaacggtcaaacatgtactaaaaagtcaacggtgtcaaacatttcgaaatggaggaaataataaaattgattctgacctatactttgaagaaattatagcagttttacaggatgaataagaaaactactaaaaataccaccttgaagacaaagatcttcatctatggttggtcagaggatgcacgaccgttgtttctatcaacggcttacaagttatacacagttcttgtcctccaaacaaaaaagcagaatctccaaaaccagccgtcgatcgaatttctctcccatcgtcgctgacaaactggtgtcgaaccaaagtgaaacgtcggagattagttgagttgtgtaaatcagtctaacttgcaagtaatcaagttaattgatagtaattggctaatttttatgtgtcaaaatcttcaacatggtatggccaagtactagcttataacatgctgcaatttggatggcaggtaagaaggaaggcgttacatgatggtgagtatcagagctctctgaagagtgaagactattggtttcattaataaacttaattatatcggagttagaagctacagaaatcatagaggcgaaagtcaggttgcaaagcgaaaagattaagaccactgtcccaaaatggttaccaccagaagaaggtaataagtgaaaattaatgttgatgttgctatttcacgttctacaaaaggagcagttggagttgtttgtagagatgaaaatggtcttcctacttgagtactttggattaataatagtaatccctacttcctttctctaaaaaaaaatatatatttccctcatgttgccttcgttgagttcgttagtctagtggcccttcatgtcaccattggtttatcttgagaaaaaaaaagttcatgtatatatattctgagtcctctcttccatccaacaggaaaacaaaaaggagaggctcaaactataggacaatgccccatggatgtatacacattgggattatttgcaacgtgccattgtgaaacatattcactcgatgaaagaaagactcatcgagttgttgaatgtgtgtgcaacgttggcactagagtcactgtccgttagaaaaagcaaggaactcagaaacctcatactatttactccatccgccccaaaaaaaaaatccattcctagcatcttaaagtgaaataagtggagagtgagaatgactaaaatacccttaatcattaaaaaaaccgtaagagtgataggtaggtaaagatattgaagagataaaacttcttgttttagtgctaagggtatatgtaggatagtagaagttggttttttgttggataaaatttaaactctggaagttaagttttttttaggacggagaaaataagtatcattttattttattttatgaaaccgatccagtcagatacctcgtgatttgactatctatcagcacactcttcaattatctgagcaagcagagggctgtataaattttgcaacccccatggaaaataatattgcagatatttttaatacaaatgtatttacaataattactaccttcatttcagaacaagttaatctagtactggatttgacatatctcgatactataaatttagtattagctataaatttagtattaggatatgtcacatttctattagattaatttattctaggacgaaagactatggtacatttaataaaggccagcttctgccgtaatggagcggaggcccgtcgccgggaggcttgggccggagcgtagcggatcgtcatcccttttagagttccatcatatatatacctcttgtaagccgccgtgcggcgatgtaacctcaccccagatatagtgaagatattttgctggctggcatccgtggttttttctcttttgttttgggagggttttccacgttaaaatctcgtgtcttctgtgattgatctattattttttatcgtttatttgtccatcgtttcctaacaacattgatttactgcaacatggtacaatgattttgtagctctatcagattttgatatttttatggcagtgcatccttcattctcctagcatactcctccagccttttgagcccttgtttgggagaagctgcttcacctagctgcctcaccattgcactcccaatgatcactccatctgcaccccaccctgctatctgcatccatttacatttgatcataaatgagtcagattttgcagcaaaaatgttggaaaaagaaaaaactaaattgcaaccaaatcaaacattctgaaggaatttgagatattaataagctatttacctgcctaacatggtcaggggttgatatgccaaagccaacacacacagctttgtcagtgaccagcttgatgtcctgaaggagatgctcaacgcgtgtgtttacttttggacggggacccgtaactccattgacactaacctgcatatatattacaatttacaacatgtcatttgatctggatcagaaagctaaactttctaatgagcagtcaggtttctgcatatatactacttaattagcacttacaaggtaaacaaatcctcctgaagcttctgtgatgatcttcatcctctctcccggtgtagctggtgttgttagcagcacctgcagagattaacccgcacaaaatcatcagaattctgaacatgttgatcactggagtagtatactctagctaggttgcttaattaatcgatgaaaggaactaattatgttcataccagctctaggttgctcttaatggcttcactcctgaaagtacatgtgtccacataaggaagatcaggaactataaggcctgaaacacacgtgacaactgtgaattagcatttccactgtcaaagagataagttttgctgtgttcggtttatcatttattattagttactctccgactatatcaattatattggcacagactggtgttggttcgtaaacaaatattatttattacataagcacaataattcttgtaataagggaacaatattccaatgagcacttcattagacatcttaattaggattgtaacatcacaaccacccttacttcattagtatatatagtttaagagacctgttggctccatctaaattgtactgatgaagatttgatgagtttattattactaaaagacaatctaggacagggattggagcccaggagtgtcgcatatattcagcgaaacttccaaaccaagtcttgtcatgaacgtttccctgaatttgggtgtgtacgccaatctacagtatctatgatgtttacacttcactgttaattttttttagataatggacttcactgttaattaatctgcccatcatgttattcaacactgacactgacaggctaatattgttgtttttttttctaaatcaggtagtaaaaggcaaagccgggtatgttcagttttattgggtaatttctttcggtgtatgttcctcttttactacatggtactgagtattatcttcttcttgaaatactcctaaattacagtcctcctgctcttgacaaatgaagtataggtataagatttaagaaaaaagtggagatcatagtagtacaaattaagatgcaaatcatgcatgcacgtaaatgagtaaaagttaattaagggatcagtaaaagtgaaagattaggagagtaataataagttggttaaatgtaaatttaccttgcacaccagcttctttggctgcggcggtgaagttggcggcacctcgccggaggatggggccgaggtaggagaggagcaccaccgggcaggacagctccggcgtcacctccttgagcatcgacaagacggcctccggcgtggcgccggcggcgagcgcccgcgacgcggaggcctggatgacggggccgtcggcataggggtcggagaagggcacgccgagctcgatgacgtcggcgccgcaggcgtcgagcagccgcagcgcctccgctgtcgtccccatgtccgggtcgccggcggtgatgtacgggatgaacgccgtctgctcaatgacgaaatccaacacaattcagcaccgacatgaactcgttctacgtcaatgcacgctatatgtttgttaccttgcccttctccttgagcttggacatggtctgcgacaccgacatgcgccgctcaacggcggcggcggcggcggcgggcacgggcgaagcctccagagcgaccgaggctgccgcggcggcgagcctccgggcggcggcaaccctcgccggctgcgcgacgcaccggcgcaacaccggagccgaggaggaggaagccgacatcggcgacgccttcatcgtcgtgaaagccattgctacgtacgctcgtgcgacgctgtgtacgtgcagctcgagttgtagcctaggtgttcgacgcgaagaccgcgaggctgatgagatgatcgagttaattagccgtggtgtactggtgtggttgggttggggtagtgaggactgaggaggccatggcgggcgtttatatagatcgcggcgcgcgttaattacgagctgagacgacgaacgatgctggttaattagctctcatgagataatccactaccgtggagtggagcgtgtcacgtgtgcgcgcgtggttaggagatcgacgcgcacgcagcgcgcgtcgcgtcgttttcgcgtgcgtgcgtgcgtcgaggccctggcgcacgtggctgacgtacgccactttcgatcgatcggtgtgtttgtttgtttcaacttccaagctagttcgatctatgtattctctatatcttaatttgatcagctacacgcatgaactcaccaactgataactcaccatggttccatagacaccatactgtgtggtgtggagcgaagaatatatatctcctacgaacttcgaagcactgctagctgctcactggtggtcatccgcaccgtttacctttgttcaccaattgctaaacatgtaggagtacatcctctgaaatattgtgtgtgtgtgtatattagatgtttttcgtgaatacgcaaaaaaattacaggtcaatatattagaagacaatagtgtttatttacacaacgcaatcagccagaccggcttatgccaaaggaggagagaaaagacaaaaacggaaaaaaaaaaggaaaaatgaagagactactacgacggctaaacacaactccaattagcgggaaggagagcagagctacactaccttcccaaggaaatcccaaaagaagcaacgccagctaacgaccatagatgatcctcagtgaggatgtactctaaaactattgagaccgaagtgagagcagagtcgaaaacgctgaagttccgttccttccgctcgcaagtatattaggtgttaccaatatatggattctacagtacagatcgaatcacattctaattaacctttgttgtagctaattactcgcataaaagaacatggacatcatgcattggcatgcatgtaccctgcagacagaatcgagtacatgccaccacgtgcgtatcgtgcatgttcaatgtttttttttctttttttcttaaaaagaacatttgtgtgcactttgtactatatttcgtgttattgctatgggatactttcttccgattctaaatgtataaatgtaaagtcgttttacggttttctactctctctctctctctctacaagttagtcaatatacgagatttctttacaaattgctaccactctcatgtataatatgcttataatgtgtaataattccatgaactaagttattacttcagatttccccaaattttttttaaaaaaaactgtcaccacaaaaaatggggctgattttactcggattttaggcgcacgatttaaaaatatatctacatttagaacaagaggtggcgcatgatattgttgtcaaaatcttgggattcccgtttaaatatgaaccagagagcattgaggtgacattagttggacgagatgcgtactttcgttttctctctcctttatttttggaattttggcctttttggtaatcactgcaaacgacgcagggaagaagacgaagtcggtaacgactattgactcgttaagcaccaatataattaaccagagctttctcccgatcgatcgaccgagagggttcaattcgataattatattagtacaaatctagctactagaacatatgagtactggctaatataaacgtgtttcttgctcaatatataaataagatatatcttagccgttgacaacggtggaaaggtcggcaagtgactaattatttctcaaattgacaaaatatataagccagctcaggaaccaactaaaaatagtatatgtagcaaagactacaaaattgtctttctgca

SEQ ID NO: 59264 - DNA, 16015 bp, Oryza sativa
agcttggcgtgccattctcttacccctacaccgacggcgccgtcatccaggcgtccgccgagctggcgctcgccgcgggcgccacgatggacggggtcatgtcgatgctcgcgaaggtgacgccggagctttcatgcccggtggtgctcttctcttacttcggccccatcgtccggcgaggtccggccaacttcaccgccgcagccaaagaagccggcgtacaaggtatatgatattatccatccgcccctaaatatttgacgccgttaactttttaaacatatttgactattcgtcatattcaaaaatatgtaaaactacatatatatatatatatatatatataaaagtatgtttaacaatgaatcaaatgatggaaaatgaattaataattacttaaattttttaaataagacgaacggttaaacatgcttaaaaaaatcaacggcgtcaaatatttaaggatggagaaagtaatatactgtacctaacaattaacattctgtccatggtcatctgaatctaaaggcattctttttttttagttgtaacttgttgtagtagtttgctaatttgcagttgttacacatgtgtgttccaggtcttatagtaccagatcttccttacgtagagacatccactttcaggagtgaagccatcaagaacaacctagagctggtatatatctatgtagatttcattactatatgatcatcagtgaattaatctatttaattaattaccaataaattgaatctatgcgtgaattaatgggtgcaggtgctgcttactacaccagctacaccggcagacaggatgaaggcaatcacagcggcttcaggaggatttgtttatctggtaaatacactataacaaatcttcagaaaccctggttacttgttataagtttaagtagctttctgaaaaagaccaaataataacaaattgcttgctgtaaaacgtgtcatgcaggttagtgtcaatggggttacaggatctatccaaaacgtaaatccgcgtgttgagcatctccttcaggagattaagcaggtcactgacaaagctgtgtgtgttggctttggcatatcaacccctgatcatgttagacaggtgattaaattatcattttatcatgcatatatgtttgtaccatctaagtttccttctcaacgattgcaaattctgaaaaaaatgtaattgtaaaatggacacagatagcagattggggtgcagatggagtgatcattggcagcgcaatggtgaggcagttgggtgaagcagcttctcccaaacaagggctcaaaaggctggagaagtatgctaggagcctcaaggatgcactaccatagaagttattatagaaaccaggcaccagctgctaaaaaattacacgtgagattaattaattaatctctcggtgatcactacattcagatagggaagctgaatctgcctttcttatagtagctgagtaaatggacacagatagtagcaatataacctgttataagtcataatgtgtagccaccttagggaatgcaaaatacctcgtcattgcagaggttatatgttaattcttctattgtatgaatgaaataaaagtaaattatgttgacggtacaataatttgttaggtggatacaatctatctagtactataacttaaattgaacatccaaataaaataacttaaaaagtgggtgcattctaaacaagaacttaacaatttagtattttagtgtagctaagactcgtttggcacagctccaacttccaactccaacttacctagagctggagctgtgacaaatggtctagattcaccaaaaaatagagcggagcgggatgaatctctcctagaaattatactaccgagatggagtggcaaaaacgttgctccgcagatccactccaaaattaattacagctctacccaccatctttcgtcgaaattacaggaaaaatgccaccgccctacccttgacccacccaaaccgcaccgcccattccccccacccccgagccgcagccccttctctctcgagagcgacaagggaggcgataccgcgagaggaaacggcggaagcgcacgacggcagcggcggcggcgcacggtgcggcgtaggcgcacagcgcggcggttggggtggtgcacggcggcggagtaggcacacggcgcggcgcatggcgacggagacctccctcgtcctctcgacgcggcggttggggtggtgctacggctttcggcgtcattacagctcacagcagcggggtgatgcagcacggcgacgacggcggaatcagagcacggcaaggttccagatctgtgtacaaggtattttccaaaccctagtgatttggttcattactctgtggattgattgttcatatttgcaaggttttcacatcggtgtgcatgtttccaaatctgtgtgcaaggtttccagatctgtatggtagaaaatgaaacaagaaaattaactatggatgtatatatggatgtttggatgtacttaatcttacgataactatggatgtatatatggatgcatacagttgtctaaagttcattgtgatgcatatatggatgtaaccatgcgtgctgcatatatataagcgcaagtgtgatgtgagtgtttgaatgtatcatctgaaaactagtaacctctattcagaatgtatttgcgtttcagtttcaaaatgtatttcagttttagtttctgattgaaaatgacaaatgtgttgcctttcagttttggatctgtgatatgccatatgttatgcttgcaatgaacctctattacagatctctagcatgagattgaccaataaaaggttgtcaaatgtcagatagatctctaggatgaattgattgaagtatgaatttggttgcactgtttatatgttcataagtaaaacatatgcagttgggtcagaaaaaacgcaagttatgagttgtttgccactagaatgtcttcaaaagtttagagaatatttgagctccacttgatggctagtcattctactcccctgctttcatcccagaccaaaagatgtatttgtattttagtttgacaccgcaggttcttttttctattggattcattcaccactgattcagagtgttgcttgtttttcatgcagcaaactcatgccaattgcacgggacaacataaaagaatttatgtcatcctctaactggaagaaccttttgttgcctaaagatactcagctggcagctacttgtatgttgtgaacaaaagacctctcaatgttctgctgctgaaatattaagagatcgtgacagagcatattattaatatcagatctatgccatcgagcgagttatgtactggacctttgatttatatttcgatgacaatgctactattattaatgtactgaacatttgtattatttgctaattatgtcaactattttgtcaattattatttaacttacaattttgttgaaattctaaagaaaataaacaattatcacttatataccacaaaaacagcaaaaaccacaagggtactattgtcaaccactctcctatcctctcttttaggagttctggagctgacaaaactagccaaacacttttcagctcgctccagctcccactagagctaagctcctgttggagttggagtttggagccctaccaaacggggcctaagtatgtgttgttttcctcggaaaaaaaagaatgtacatgttgttttggttaacggatggtagatgagttttttttttcacaaagttaatattccaacacatagcaatccggcgaaatattaacttataattagtattgaatttaatctataagaattacactactcatccaatttgcaccaacaatttgtgtcacattctcaaatctcaaccgaaatacaagcatttctatattgtaaaatttaattgacttctaattactagaattacaaaatttaagtattctcatataaatctgtgcaagtatttaaaagctgaatgtgtgttaaaaatactcaaaataattaagatgttgctgcgcttcttaaattattataccaaaatgcaaccaccttgtaagttgctacttcttccgtatgctcacttattaagttcatgcactaaattacaccggcatatcaagttgttgcactagcatacttacttcttaagatttttttttcactaaattacacccacatactaaatttatgtaatgtgaatgtaatttttacacatattccccatccacccaaacctagccctgtcagctccttaatttgccattttgcctcaatcctctcctctccctctctcgctctctccatgtggcggcgagccacgcctccctgagattttaacaaatctgactgagccacctgctccgtgattggtagcaagagtttaacaacggtgatcagaggctgacctcctcaaactaggtaaaataacactatatttactgtaattttataaattttgaaagattagtattatttgccctttccaacaaataaaatttggagtttttggttatgtacactctgtcatcatgcaaacaaaaatcaaaatacccttaagcagtaagcagcgaaaaagcatctaagcagtatactacatgcatgcttctcgaagatatataattattatatactccctccatattttaatttatgacgtcgttgactttttaataaacgtttgaccttttgttttattcaaaaaatttatgtaattattatttattttattgtgacttgatttattatcaaatgttctttaagcatgacataagtatttttgtatttgcataaaaaatttgaataggacgatggtcaaatgttgattaaaaaagtcaacgacgttatacattaaaatacggagggagtatgtagtattaatacactattactagtcttcgtcgttgtccctgtcaagtgtatggctgtatgcagagagcagaaccaacctggttgctagattgttctgtttagggatggttgctattgctactccatagattgttgggttgtactgtactagttttcatggcaatagcaatgcatccctgttcgacgcatctaaagatatttggcaccacaaaccgctacagcataaagtttttttctatacacctagtacaatagcacccagatataagtagcggttttgtgcttgtgcatatgcattgcaggagcagaacatttgtttcttttttctttttttttttgcaccgagcagaacatttgttgcattgcaggtttccttgaaaaagagtcatgatacgagtcggggcttctttgaaacaaagaaaaaaattaaaaaatttaaaggatttgaactatatgaaaaattcgtacgaggctctttagaataaaggtttggatctctaaaatttgtttgatattcctataaaatggcatgtttcatgggaatttgggaggattactagcatgagctccaagctcttggaatttttgctttgtgttcatctctttctcctttgtaattgttctatgttttttattccttggaatttaaggtgtgatgatattcgaattacgtgatttttctattcatgtgttttgataatattacgttccaaaaaagtcataaaggttgcgttcgtttctgctaccactacagagggctaatctcttatttaccgtgagattgtgagaatgtttgtcaaaccgttaaatgatattttataattatttttatatagaaagttttaaaagttcaaatgtataatttttggtttttttaataattaatactcaactaacataataataatgcgctaatggctgtttcctttcgcaccgccgctaaacatccacaccaaaacgtacgaagaacgcagcctcatgagtaacatcgacaaacggcagtgagctgtgtgtgagagtgcgagcctgtgacgccatataaagtgaatatattatctgaatattcttgtttggttctcatctttttccaacgattggccttgttcggcggccacttttgccgtagccgcagcggctgcggcagactagccgttcaaagtctcttcaatctgccgaaattttgtttaactgcattgtctgcacacgttactacatatacaacatcgtatatacacatactcatgaatatattccctaaaacatactctgaaaaggtaaaaacgagtgacacatctctaatataattgataacattataattttgtacgtatttttcatgaaaaccagaatttaaatttagcgaataaaccctagcgaatagagcgtacttcctaggcacaattctatcaccacatcaattgtgtgcagccgtataagctgccaaaagaatcgttacgagagatgaacgaatccttctagatatgaccgcgccgacgatggagggaaccgagactgcacggcgtcgtctgctgccgcggccggctgcgcagcctcttcctcctgatccgtcttgttccccccttccgtcaccgctgcatgtgagtgaccatgcttctcgattagacccacggtgaggataaccatctcaagatactcccttcgtcacataatataagtattttgatattttatttgtactgtttaatcactcaccttatttaaaaagttcatacaaataaaaatacgaaagtgtttaaaatattttagataataaaataaataaaaattaaataataattctattttttaataagacggcaaacagtgataaaaaagtttaaatcttttatattaggggacggagagagtactaagtcaaatagcccatcactagcttttagctgatgtgctgtactagtactactgtttacgtcagcgtgttggataaacagcggagctcccaaacacatcttttgttcggattagtagttaatcctgctacgaattactgctccatccgttcaaaaacaaataatttatcacacatatcaatacaaaactaacaaactagaatacatatattttatcaaatcggaatacaactatttcataatttatctacttccagtatagttattcattgcttttacaaactccggtccaatgattatttacaataaacttacctagaataaatgatagaagttagaaataaaatttattgctccatccgtctcataaaaaaataacatagtactgaatgtgatacatcatactattataaatttggacatatctctatctaaatttattgcactaaaatggatcacattcagtgctaaatttatttactaggggattgagggagtatgatacagagaaagtagtacgtataacgtagtacctagtactagtactagtacatctgtacatgtgtcatgttcatgcagccggtggtccattcatccagaaatacatcgatgtagcaacatgaaacaccgcagtaatgcagtatggtgggagcgtcgccggtacgttcggaatatgaccatctaacttatttttctttggcttcgagacacttgatatgtggattcgttcgagaacggatcatatgtcagcgagacaaataagttagaagaaattaacaagggagtggattcagactctcatgagcacgttcccttgttatttgtatatcatttaaatgattatgaaaaataattcaacaagatagattaatatgtgataaatcactttacaaacaagcaagttaaaatttaacttctacaagttacaacaaaaaacaaatggaactatgactagttaacgtgtattcacggtcaaatttgtttttctcgttgtaatttgtagagtgatttatcacatattaatccatcttgttaatttttttaaaaaaatttcataatcatttggataacatgtaaaggataaaggaatattccctcaagagtttaaaatactttcccggatatgtgaacagttcctggtacaagtagtatactgaagttttttttagataatggaaatgggttacatctctaacctctgcccacaggcacacagccaaaaagtccagaagtgaatataaaagaggttaaaaaaggcgagatgggacaaacccccaacttctaccgataatatgatctactaaaatcatgttttttaaaatcacgtagagtctatcacaaaattctgtaggtactacgccatccaaactggagtaaaagttccttggctaccaattccaagcgtgtagcaccactgcgcatagtatcttgttgttcctgtgaaagcatcatacatcaagagtggagccaattggaacacatgaagataatctgcatgatgttaggcatttttttatggttaaaaaccatatcattatggcaacgccaaattgaccaacatagagcactagctccaaataaaatctttttttttgtctaggcactccccttagctagttaccaaaaatatcttttgcattgtggagagggggaatattgaaggcaaagaatacacatcgccaagcaaaacgtgcaacatgacagtcaaagaaaagatgttggatggtctcttgtgtattaaaaaacaacattgcttgtttcccctccattttctctttatgaggttatctttcgtcaagattaattttttgtgaagaaaccacataaatactttgatttttagtggtacgtttacctcccataagatcctcttgtggattctgttaacagtgaaatttggtaagcccaaagttaccatcggtttagagtcagtatcggcttcaaagttctagaatcagccgatgggagtcaagtcgccatgatgtcgtgttcttggtggagtcggatcaatcaaaggaagcttatctataagagttcgagttcaagaagaatgcgacatgacagttatctattaattaggcatagtttgtcattttccttttatccttaggaaagtgtgtttagtgtccgataaggactttatcttttcctttttaggttctttcttatccgacaaggactagtgtctccctatgggtataaatatgtacactcgaggtcattgtaatcaatctctacgatcaatacaattcggcgcatcgccaccctttttacttctacttttgtttttttacgttccggcggaacttggcacccgacgcggggctgcatcgtcttcgatatccggcgaagggataagtccaatgttccgtcggcccaggcaattgtctcatctacatcggcatcgttcaaggctgcatcagtacattcgacctcttagattgctctggtttggatgatatatttgcctacctatttatcatatgtctatattaatctagttttagcatatcaatttagctctatcggctgcttctcgttttaggatttctgccggtatcggctaaatcgcgttgctagattagattagcttagatatctaccaccctgaaaactcagtcaacggcttgattgtctagatattatgtttcttttcatacttagtgctgcatcagttaagtttgatctactaagtcgtgcttagaaccataatctctagcttgctttttgactgccaataaggttttcatcggggtttcagccggtgagttatctggacgttgcatcggctcataaggattgcatatacatataagttggatttagccgatgacgacaaaggtttcactgtttaatctaatcttgtggatttcatgacatcggacctccagctgatgtatgctttaacattcggatcagtgcttattatattttgtttctagctgattggtttctactggattatattgttattttattacatcatcatcagccgattgccttcatatcattatttacattggacatatagctgattgcttaaaccctatcgctatcggctggtatcggcatcggctattatcggctatcagctggaactactccatcggcttaacagccgattggctgttttgatctactatttgcatatcttatcagttgcaggatcaaactgactggcacgcccgtatctcatcaacctttggacctgcactggagctaagcagatcttccaggccggtatgttcgattttttcgtcaacagattcttacattggaattgatgatcacattatacatggatttgacccaaaaatggccatttttatgtagcgaccaaataaagcaatccttttcatttgacagggttatgttagctagtcgagaaatcaaatcattccactcaactaactttggtcctacaattgatcgtcggaatgaaacatttaatggtgttgtgctcataacctctgccaaagtagaatgtctctttcgaatcacattgtacagagaaggatattgatatttgagtggttgcaagcccaaccatgtgtcttcccaaaatcttatttctattccattaccaggtttaaaagatccatactgaaaaaattgatcttttactttcattaggctagcccaaaattgggatgttcctggtttgtgtgacacgtgggagaggggaatagtacactggagtggctggtctctgttgagcatcagtgtggccactgaaaaatgtacacccacaccatagagcactctggttaacacgtttctcacggcgcgcgcgggctacaccgagcggagagacacttgcaatttccaaacccgagctaattatcgccatcgcccgccgcgatctatataaactccgcggcaccgagagccgagacatcccatccatccaagcacacgcgcgcacacgcacgcacgcacgtacatcgcgcgcgccacgccacgccacgccgggtcacaccgttccaagccactctcacacgcacgcgcgttgccgccactacactctcatggctttcacggtcaaggcgtcgtcgccgtcgtcgccggctgcttcttcttcttcttcctcggcgccagctaagctcggagcggcgccggggagggtcgcggtcaggaagctcaccgcggcggcgacgtcgcttaggctcgatcgggcgcccgcggcgccggcgacggagcgcgggctgtcgtcggtgtcgcggaccatgtcgaggctgatggagaaggggaagacggcgttcatcccgtacatcaccgccggcgacccggacatggggacgacggcggaggcgctgcggctgctcgacgcgtgcggcgccgacgtcatcgagctcggcgtgcccttctccgacccctacaacgacggccccgtcatccaggcctccgccgcgcgggcgctctccgccggcgccacgatggacgggatcatgtcgatgctcgcggaggtgacgccggagctgtcatgcccggtggtgctcttctcctatctcggccccatcgtccggcgaggtccggccaacttcaccgccgcagccaaagaagccggcgtacaaggtaattaattaattaattactctctgttttgcacttggacattaatctttcatacaccctcgtcttttttttaaaaaaacttaatactagaatgtgacccataatggaacatcttagtactaagatgtgtctagattagtttttttttacggaggaagtatatatcagtgatgtaaaatatctaatactaataaacagttaagtacagtaactgtacagggatctgaactgtatatatagtgtatacggtacatttctgatttgcctgcacagtcattttgtgttttctgaaccaatgttgtcgttcaccttatcttgaataggattaatcttcaatcaaatcagatggtcttgagtcgttttcatttgtttttcacgtgcatagctgaggtacagcacatgtttggccgtttctggatcgatgcaaaacaccaatcactgtcctatatacataaagctagccatagattcttcaggccaagctaagccaaaaaaaatctgtgtctgaggttgtgatgtgctctccgatgagtgatcattcgaaatcatttatgtggacaagttacaagtaccattacgtaattagagcaagtttaatagtatagccaactactagttctaattcatatatggtcaatctaatagctcattcatacagtagttacatactacactattaatacctagtcccacctatcatacacacactgcgttttggagtccgtgctgcagctagctacaaatttgtagcccgctgcccttctctcttcttatttatctccttaaaatatgtttgcagctgccttatagcctgctattgtacctgctcttatgcacgtttatgcttttagagttttaggctgtgtttgagggagaggggattaagaaaattgggaatatacgcaaaacgaggtgagccattagcgcatgattaattgagtattaactattttaaatttcaaaaatggactaatatgattttttaaagcaactttcacatagaaattttttacaaaaaatacaccgtttaatagtttggaaagcgtgcatgtgaaaaacgagtgacaatctcaccaatctctccccagtctcctttgaaagaacacagccttagtattcaggcaaaattaatgcgtgctaatcggaattctaaacgcattcttttttttttgttactaataatttgcacacgtgttccaggtctaatagtacctgatcttccttacctagaggcatgctctttcaggagtgaagttatcaagaacaacctagagctggtacgtatagtatctatgttgatttcatcaacatataaccattagtaaatttgtatggtcaattaacaacaaattctggattatgttttgtggattaaaatggctgcaggtgctgcttactacaccaactacaccaccagacaggatgaaggcaatcacagccgcctcaggaggatttgtttacctggtaaagcacactagtaaatcttcagaaatcctgattaattacttaatagaagtttagcttctgacacaattgcttgctgtaaaacgtgtcatgcaggttagtgtcaatggagttacaggatctcgccaagacgtgaacccgcgtgttgagcatctccttcaggagattaagcaggtcactgacaaagctgtgtgtgttggctatggcatatcaacccctgatcatgttagacaggtgattgaattaccattttatcacaaatgtatttggtagatttcctaatcaaatattgcaaattctaaaacattattgtcaattgaaaaatggacacagatagcagagtggggtgcagatggggtgatcattggcagtgcaatggtgaggcagctgggtgaagcagcttctcccaagcaagggctgaaaaggctggagaagtatgctaggagcctgaagaatgcacttccatagaagctataaaaacaagttgctaaataatggcatgagagattaattaattaatctcttggtgatgactagctacatgcataaaagggaagctgaagctgcctttctcatagtctcatagttaactgtaccgcaaattagcactagaaagtgttatagataataagtgatgtataggcatccagatccttggggactgtaaaacacctcgtctgtgtagaggtcggatgttaattcttcggttgttcgaagaaaataattgctgcaaattgtgtgcatatttgtgctaacaatcaacaaaggcgcgaaacaaactccttaacaacaaaaaccatatacacaagacaacacatgtaaagcacatataccccgagttgagctggctcttctcgacgtggagacacgaggtcactcgtcataacatgacattgtaaatgctctaagtaatatcctatatatatctactatcttaaaagcatagtagtcctcttctcagtccaattccgcataaaaaaagcgctaaaagaaagagagaacccactctcataaatttctatttatcttaaaagcacagttatcctcctcctcttcccactccaattccgtgtaaaaaaaagctaaaaggctagagataaaatcaatcaggatttaagtcctgatttctataaatattacacccatatagttaggctttcaagaggaatttaagtcctggtttccattttttaaatcatgtgttaggggacgcgtttgtggatgtgtgagtatggatggtgttgggtatctagttgtgtgtgctcgtatatgtttgccgtgtaatcctaaaaaagttctcaaagaatcaagagaaaaaccgttcgagaaaaccgagagaaaaatatatggaagagggaataaaaagtttgaaacatgttccacggatcccgtttcgttacaagcacaggactagtcatatgactagtaaaaaaatgatttaagttttatttatcgccgaaaataaaatgcgccgactacccacaacttaaaccaagatagccggaaggtctacagtgcagtaacggttaaaagcgtcgcggtcgcgtgattaaccgcaatctcgttgataatgaacattccttatagtacaattaattaccatcacgctgtgtttgtttaagataaaagatcagcatcacaaatcgcaacgtccaaggaatggaagagaaaacaaatccaacacacgcaaaggcgtcgaataattaattaagcaaaccaatgaaaagaagatctaccagaaatgtactgaccttatctattgtcaccttgaacagaatgacactttgcgtcgtctaattaaggaaataatactaaatctgttggattttgacaggagaatatttaaacttggttttctttattctctccgtgttaatttcgctgttggatcggcggccgctgcgtcaatttatgtacgtatgcttttttttctctctttcttttggtgggatttatgtacgtatgctgatcacagcgatgacatgaaaatattagctgctctcacgcccggttggtaacttggtattggtcgtgagcctgtcgacgtcatcgatcttctgggctggctatactctagaggaattgcggcccacgaccctctcggatgatttcacctttgagaaaggaggagtactccctacatcccattaaagaaaagggttaaaaactaagatagtatcagatctgacacatcaaatctggataagagattggtttttaatgtaacggagggagtacatctgtgcgcaggttaaaaaaatttcttaggtttaaaagtaatttttttgtcataataccttatgtttcatattgtaagaatgttttgatctttttactagttaattttttaatcgattttaagacaagtatggtaacatattttcactacaaaacaaacatgtaccaaaatatattaaatgttatatttaatgaaactaattttatgttataaatattattaaaaaaactataaatttggtcaaacttaagaaagtttgactagagaaaagatcatactccctccatcccataatataaggcgtgcacatattttaagattaaacatttaaaacatttgaccaacacttagtttaatataaaataaattttatttgttaaaaaatatttcattggattgacatttaaatttactttcatatggttctaatttcgttgttacaaatattataatatatgagaaattaaaatataaagaatagatttggagaccgtgccaactttaaccacgtcttatattatgggatagaggaagtaacgttttataatatgaaacggaaaattatatactcaatacgggctcttgcaagtatgaaaatgttttagttttacactctgcagaaagacaattttgtagtctttgctacatatactatttttagttggttcctgagctggcttatatattttgtcaatttgagaaataattagtcacttgccgacctttccaccgttgtcaacggctaagatatatcttatttatatattgagcaagaaacacgtttatattagccagtactcatatgttctagtagctagatttgtactaatataattatcgaattgaaccctctcggtcgatcgatcgggagaaagctctggttaattatattggtgcttaacgagtcaatagtcgttaccgacttcgtcttcttccctgcgtcgtttgcagtgattaccaaaaaggccaaaatt

SEQ ID NO: 59265 - DNA, 38712 bp, Oryza sativa
cggcggcggcggtctatagctccatgtcacggtggtcgcgcatatggctccctgcttatgctctgtgcacgacccagtcgtggtggagatatagaccaccgccgccgcctattacatctagggaaattcatctcggatcaatttttatcacttgagagtttgcgtgcagcgtggtctatgttatgcatttgtttgcacataaaaaaacaggtccttatccccttgaaacaagattagctgaacaatgcctcaaaatacttatgaaagtctttcttctttacatcgttgtttttttcggtggaaaattgttatttttcttacataaaaactctatttctacaatcacaagcatgggcttttactattcgtgtagtctgtagatagtgcttctgtcatacaacttgttcaatggaactctgtagtcgctatgccccttactcttaaaaagtgcaataaatagaattttaagagagaagcaaaggccaactgccctgtttgcttgcccttaagtgatgtgttattgtgatatttgaattatttttttctttcgttctggaaatactttcgttagtattattaggtctttccatggtatcatgtctgacctactagcctttcatggcacagtatagtatttttacttgtttggaaccaatatccttcttatgtaccagaacataatattgtccttatattctggcaggactgcttataatctggcacttcacgaacatgggccaaagctctatgacaaactgacagaagacatggaagatcacctgcaagaaatgtgcgtatcgattgaggctgctcaaggtggtttaaaaattatagataggtaaaacagaatgactacaggtgttggttttgcctccaaaataaaataaagctacttcactttgctgacattgaatatttgtttttggtaggttcagtcaagagagtaccttgccctattatttgcttccgtttgtatgggagaacatcttagcttgcgctttaattgttgcagcagagtgaagttataatttcaggtctctattaattgatgccttagtcagaaatctgttactgcagtgctctttctggaagtgcaaaaataatatgattaatagcataatgtaagctggctagattttatggttgggtgatatgggaagagtcaattgcgttttctgtccagctcggtttctatcggtgaatggttgttcgtttttttcctgtgcttttctattgttggaggatggcagggttcaaggttttgtttagtgcgttgtatcatttttatattcattttttaatggttatgtggcgatgtttgggatagggtaatttatggtttatctggtttttaaagactaaaaaggtatttctcggtttgattgcaacaggcttcgttccaaacagctagcgtgtataccacagcactctatggttggtggcagcaaaagatggaaggaaaaaacgtattagcggatgggtgagtggacctacctagatcagtcgcataggccaggattataattatatttagatggtctgattaactttatggtcggtcaatctatttaactggatacatgttgaggccatggttaaaaaaaaactgtttggtgtggttcctcatagtctttgtgtttgatgcttatctaagatgagcaaaccatgtttattatgttaccttttcagttatgattttggcgttaccttttcgttatgtattctggtcctcatttctggctggttggaaactgtatgtgatgtgatatagattttgatattgcgtttgtatattgctctacctaaaagtttgtagttgggccttggggattatgtgtatcacaaatattactttggtattgttattctggttatgattaagtttgtaaaatgatgcttcttatcgtattttctactggatcaatttgaggcaaacgaataaatgagcttcctattgtctccagtgtgatggtgccgtacttgttcatcagagaaaactaacaaggtaatgcgctactcttcttgccacttattgtaagagacatgatgatagacccggccatgctaagattggttcttaaaacttagtgttttgttttatcctatgataatggtcataaatttaagtcgatgaaaaaacatacagattatcgttaattttatacatgactaatgctgtggaagaatgttgagatctggggaaaattgttgcctattaatgttcattaataggaaggtgaaatttgagtttcatgctgctttccatgaaaaactgtgcatgttattattaaaagttgctgctaaatggttgcacatttgattacatgtttttatatctattgatattctgatgtccagaaagcctttttatcataagagtgtggtttatatgatcagatacatgcgattttggaattgagttgcattacgaccagaattatcctgaatgttgtgcatgaaaattacatttcctgttgtttttggttctctttgcgcctgccctacactttgtgcatgctttctttttttttttcagctgctgagctttcaggatgcaatagcctcagttcaaatatatgttccactatacatatgtgtttgctaatgtgctgctttagaataaaaaaagagagttatgaattgttcacttgtttgttttccttctgccccgcatgagctataggtttacctctgcttttatgtcttcaccgtgttttatcagttccatgggaagatctttcgttttcttccagttcctttttttactaattttaggtttatacaggttttgttcacaagaacaacttaggtgctaatttatataaatataatccacatgcacgaacccaggatgtgtttttgtcttgcctgagcgttatatagaactagcttactatatccatgtagataacagacggccatgcataattcatgcctttgtatctatgttataagaacatagattttacatgaagatgttagctgttttgttattttatttacaaaagatgacatgttccaattttagcttctcgttggtcccttatgacattggttacgtataatgtcaatctattgaattatatttatgccgttctattaagcacatttgattatacggtttggtgtttcatgtgttgtgtttagacttttagcatttagactttgttcatcaatatatgtttttatgcatgaggatgcactgctacatagtagtgggatgtgcagttctgaccttctcatccaccttcattatagttaagttcattgtacactttaatttgtttattcttctcagtccacggcgaagctggggatttaactggcattcgtagatttcttggatttgggattggtttgcagcctgattcagactatatggacattggagggtgaagcttggtgagatgctatttatctgtattaggacgtgtgtatttcctgtgtgtttgttactttatataggatttagaataaaaagcgggcagttttatgtgcaggggtgcttttggaggcagatacggtcttcatccacccgacggtagatccgagcatgtgcatttgtggcggtgcgaggcagcaggcagcggccagtagcccgagaaccccgacctcgatgccctaatgggcgtcacgccatatgtgacggagatacgcgacgaattgggggtgagccagggagactgcgcgaaccatgatcttgcgagttgcgagcgctgggcctggccaccgttttcaggccgttgggcaagctaggaggcaagaccttggagacgggaagctgatctacttctccagtctccagttatgtcttgcaattcgtaactcccttcttggctgcggcctacagccctacagcgagtggtatgactttattctttctagatttctagcatctgatctatttgtcgattaaggggatttaacatatgttaattgatttactagcagttcaagtgacacccccaccccaaaataactagagcacgaatcaatcaaagagccttcgattattactttatcctaaagagatatttgctgatcaaacataacaaatacaatttgagaactatgcaattatgcttctaaaattagagatgaagtgaggagggcatatttgttgaatgaaccaaataaaacagctgagtaattattttttccatttcatcatgtgcacatcacattcgacatgtgtaagggcatatgcttcatttttgttttactgatttgaacttagggttcgagcccatcctccattctcaacctggatttgccactcatcaagcctcaaggaaattggtggaggttggccaacgtttaccttctactgcagaagcttggtcatcgactgcgtgccttggtgctgtcttgccatagctgcggctgcttgccttgatctgttcacttcttagtttgctaatttcaaacgcgaaattggttattagtggttccgttctaatagctaaatattagagattgatttcaccgagtctacagcttgccatattcatctattatattattaaaacagctttgaaaggaggcaccacattcgttgtgggggctaaaaatttccagtctatgtaggaatacaataaaaaaaatggctgaaattcggaattagaaataagcaatattgaaagaagagtccatataagaacctaatacgagattaatcaaaattcggaataaaaataaaataaaatccgaaattagaaaaaaaaaaagaagaggtccaagtaggaatacaatttaaaaataactgaaatttggaattaaaaataaggaatattgaaagaagagtccatacaagaatccaatacgagattaattaaaattcagaataaaaaataaaaaaagaaaaaagaaaagaaaataatagttcaagtaggaatacaatttaaaattaattggaattcggaattaaatataagcaatattgatatgagagtagatataagaacctaatagtagattaattaaaattcagaataaaaataaaataaaatctgaaattaggcaaattaaaaagagagtgaaagtaggaaaataattttgaaacaactgaaattgaaaataaaaaataaaatatcaaaagaacacaatacgaaaaataaaataaatactgaaattagaaaaataaaaataagatttcaactaggaatacaatttaaaaataattaaaattggtgataaaaaataaagacaactgaaaaataaagaccatctaaaacacatgacgagattaattaagtaacaggcctatacaggagcagagtggtggctgttgatgggacatctgataacttgacgattaaaaggaaaaacaacgggcaggtcgtgaagcaatcggtcaaggcggttggcgggactttgacttttagaaagtaaaaaaataaaccttggtgataatcatatttaatttttaaaatctcaattacaataaaaacgagaggcagcgggcctgtataggagtacaatggcagagccattgatggttggtgggtcttatagaaagtaaaaaatgaattccaatgatagttatgatcgatttttacaatcccagtggcaataaagagtatgcggcggacgggtcgtagaagagtatagtggtaatgtttgacgggatttctaaaaattataaaacagatgaaacccaacgagacaataaactctaaaaactataagatctaatttttaaaggttcgggcttctaaataataaaaaaaataaaccccaatgataatcatgtttgattttaaaaactcaatgacaataaagaagagcggcagcgagcgagccatagaggagtatggtgactaagtcgctgatattttggtggaacttctagaaagtaaaaaaaatgaacctaaacaataattatgtacgacttctaaaatagcaatgacaataaagagaagatgcggtggatggtcgtagaggagtataatggcagcgtttgatgggacttctagaaattataaaaaagaagcccaacatgacaataaacctatagtttttagatccaatttttaaaggttccaaggagaatgaatagaaacaatggtaaatcgagcaagcaaataataaagaataatatgacagatgtaagggtagcaacaggtgtgacttttaaaaaccacttcctccgtttcatattataagactttctagcattgcccacatttatatagattttaatgaatctagacacacattcatatatgtctagattcattaacatacatatgaatgtaggcaatgctagaaagtcttataacctgaaatggaggtagtataaaattagaaacacgagaatgataaggtttgatctttcaaaatcttaagacaacgagataactatttaataaaatttaagtaaaatcatattaaaaacatataagtttatatgggtgctagccgcgcaattgcgcgggccacccagctagtttattttaaatccttaaatttcattcttacaaatgattgggcgatgaatttttttcttgtgttcttagcaatgagaaaagaacaatgagccatgggtcctgaatcttgccatacatggaccagtatggcagtacatgtgcttccttatatacaatacaagaaccagaatgtagaatcatacttgtgcgcacctttaattttgtaggataattgtatggatgaagcaattaaagttataagtcttttgaagagttcagagtccctcatagagcttgcaatccaacatcactttatacctggatttagggtgcacatttttacaggcaagtgattagggtgttgccctcggtttagttttcagactgtcattatattcactagccatcaacccgtgcgtcgcacggactatttttttgataaacatcataaagattaaattacattggcttagattaaaataatagttaataagattaacaacttgctaatcaatagagaatacttaatggacagtgatatgcaacttcacgtcaattaattcttactaatgatttacttggcttaccaggttctgatattttacatggattctttctcgatctgtttgttttacagagtaccacaagttgtggcttatcggcaatgaatgagatcctatctggagccgtataggtgatgatttatcaggttggcgactcccattcaaaacttatgcaactattatattttctatgtatcaattcaatatccctttagaaagcttgatgactctgtgtagtgtgatttctgtgcaaataagtcttgcagcttagctaatggaaatagtaaaaaaaatcttcaatatatcacctcccaaccttgtccatgatttttatatcattgctaagttttgatggaatttgttcgtttgaaagcttgaagatagtggtgtttatgcttgcaattaaccttacctgatttcttttctgtgattttcgtgttaagaatccggctattagcattattgtttcagttgtaaaagaatatgttgattgttaggacaggctttcgaccaattaggctcctcatcttggcaatattgtaaggcaccgtgtctctccctattcaacatatagagaacagccatttatttttcttttagtagcaagagaaattacattggccagaatggccagttgtgaactgaattatcctgaacctgtgctgtgtgatttgatggtatatgcaggatgttttatttgtgggcattaccgtcttccctctttcatggacggtatgatgaggaactcccattgtgcaagctcttcagcatgcctaattgggtacgcatgtatgcaaaccactttcccaattaattaacactactgtttttacttccctataggtcaattgattggtgaagcattttatcccttttcgaacagaaccaatgaagcaacaacaagacagtgtggtcctattttgttttttgcaaatccaagccattagtacgacttactatatatgaaactcgcccctgcgtgctgtatgatatcctgtataaaacctacatcttgcgatgagcattgtaactgctttgaatttatgaaagttacttatctaatgcactgtgcttctaggaatctgtcaatgcttgtagcaatcaaacgaggaatatagctaggaataggaaatattgatttaaacttactgatccttgaagtagatcatttagccatattctgatttacaactgactatgctaacaatcagcatattctgatttatgactggaacaataattctaatagatcaacttctattaccatgttaatcccaaaatacgttaattgttagcatagatcagcttcaaatatgctaataatgcaggcaaaaattgatgtcctgtgaagagtactatatcaatgctatatgctatacccatccttttcctgtcaacaaactgcagtatccatccccatggaaatcaaccatttacaagttatggtactactgtttgctaattagcttttcatcttagatggtcatcgtgcacactgcacttctttgtaaatataacatacctcctacgtatctagcagttattagagactgctaactaacaagatgcttatgtgtagtgaacaatccagtatgttatcgttgtcttatattttgtttctgatatgtttatttacctttcctaattttcagctctttctgcaaatctactcaacatattatcacactcttcgcaccaaccacgcataggccttcatgaaacaagacagagtggttagctcttccgtttgctttaaattcttttatgccttcagccaacagctgacacccagttttcattacagtacttttcgacgaaatactccatagatcacatagcgccactcatggacagcgcaacagtggatatacaagttcaagcattggaaggcccttcaatcacaatggttctccacacatcaacggatcatcgttgcaacttaaaagatggatggacagactttgcagtaaacaacagcatgaggttgctcactatgcattttcatttctacaagaaaagcatttgcaagcaaccatagatatcttctgaagaccgtactggccctgccatacagtccttttggtgccatcagggttcgctctccatgaaacgtgatgctaatatcttatgatatcaatatggtgttaattagccttgtgccttataaggccatcgtgcagactgcacttgtaaatctactatgccacccacatatttagccactgttataaggaccaaataggcaacatccttatctatatatggacacctgagtaagttaacatggtcacctgctatattgctttcaacctgtttctttttcagtgtgcaagtataacaaccggattgttgctattcccaacatgtacgtgcaggcggcgcaccattggcgcgtcccaccctctagtacaatgtatcagacaagtcattcagactagaatgtatgaatggcaacttgagcctttgctgcttgctgaaattgctgaaatggtaatgaatggtgtcatgttgttttaaaaaaaatctggcatgcgatatcgttaccatttccgagtgtatcgttccgattccattttcgtgaaaataaaatgaaaatggaaatggtagagggtttttcgactgtttccgaccgttttcatccctcccaggcagcttgggagctcagtgctttgctacggcttgctcccccgtgataaatcaagaaacggcgctttacctttttttttcctctgctcgcggggcttagggccacgtggcgcaaatttgtagaactgacggaagaccaatcggctagcaccggaaaatttaactatttgccactattagctttgacaattatgcaaatatcccttttagatttacacaaactttttgttgtccttcttaagtggtggtttcttaacttttcttccacttttacctacgtggcatgccaaggtggcaatcagggtcgacgagggagaagatggaggggagatagagactgaccagtaggtcccacgtcgtttttcaccctagatatccacgttggcatgccacgtggacaaaagtggcaaatagttaagaaaccaccacttaagagggtctaaaaagcatgtgcaaatctaagaggggcatttgataattgtcaaacataatagtgacaaatagttaaatgtcccgttggcacaagaagcgctagctttagattattagatactagaagatctgcacgccctgttgacgtgccgcctaatttagcctgtaatatggttcatctgcaaaatatatattaaatttgcctatctctcattttatattatttgtcattgtagcaaaatttcacatcaaactaggagatgtgcaaattacactgctatgcttattaactacattatagttttcaaaagcaatattaactttgattaacagttatacatggcattgataaaatgtgaagatagaataccgcgatctaaaataataatttcaaatgtgagaatgaccagtaatattttgaaacatacagagtaatatattaatggaatttaattttatgtttccttagaattatgagaaaaaccaaattaagattgtaattaatgatgaccaatagtttggcaaatagttagatatttccatattggaaagtacgaattaccccccgaactattgcggtagtacgatttacccccaaactataataccagacatttaacaccccaaactctcaaaactggataaattataaccctaaatcgattcgaactggttttcagcctacgtggcacactcgtagcaatacagtcagcaaaaacaacggtagggcccacctttcagcgcttgttgtttctctccttctctgcccctctctctcttggtgaacagaaggcggctgcgagcggcgggtaaggagccgaggccggcggtgggcgggggtggaggcggctgtgggcggcgggtgaggagccgaggacgcggcgtactagacgtcagggtagcgctcggtcagctctgatggcagcggcggcggagagggcgagggcggcgggacgtggagcgagacggtggcaggatcctccttcccaccgtccaggcgctcaagcttcaagcttcagttgctagcagggttgcatttaccgcggtaaaccgcgcggttaccgcggttaccgcgcttaccgcgggggtacggtaaggggtaaaccgcggtaaccgcgtcaaattcaaataaatttaaaaaataatttgaatttttgataaattttgtacggtttgtcgcggtttgtcacggttaccgcggttactgtgcggtaaccgtgcttaccgccggggcgcggtaaccgcggccccggcggtaaatgaaaccctggttgctagctagcctgttacattgctcctcgttgcaaattgcaaacaggcgatggctgatctgatgcgtatgatggcaacgggatcatatcactgtagatgatccgaaaaccaatagtttctctttgtggattttgttggcaactttttgtgacaagtcgacaagcacgatcgcaacacctaaacgccttgcggtgatatggagtcgccaaccacctcgatctagccaaagggccaaatcaagatgggttttgtagaaaagcaactaaaccggctagcagagccgatttagagatcaaaatcagcctctaggccgatttagatcgatatgaggataactacccgtctcgtgggcaaaatggaaggttttcaggacaaacctaaaaagaggtgtcgcactctcgcagcggcggcggacggtttacggcgcaaaccgacaaagatagactaaactagagtaaaatagaaaaacatagtaaaagaacgattcaagtagattgtatttggggggttttacaatgaaccggccttgtcgcttaaataggggttggtcttgccctctacaggcccttctccatgtccaactcgggatagaaaccaaaggaaacacgaaacatgccttcccgagcaaggaaacccgagacccgacgaaaacagactcggactcggaccctgccggtctgaccgcccacatacctgcggtcagaccggccctactagccggtcagaccgcccacacacctgtggtctgaccggccctgtgaaggaaacccgtcactttccaaactttggcaattttcccctatttcgtctataggtgtcaaatttgggtgtaaacagatttcagattcactagcatcaacttttgccctaatttcctcgctccttttgacttgaactgtcttcttaatttatcggagacgttcggttctcagctggatgagagtgaaactgatcaaattacatttgttctctgcacttctgctaggctgcttagctaccactagccttttactacccagctgcagataaactaaaacatgtatatatgaacatgaattccctaaccatataaactaaaacgcctccgatgatcgaaccatatcttggtccatcgatttaagtggaaaccaatgatcagttgttttattttatttattatatttatagaacaattactccctcggttctataatataatgtacaaccactttctttatatgttccataatataaggcatgcattcaattaattatgacatcttcttcattaaattattaattttttaaacaattcactctcacattctctaattctattggatgcatgcattatatttattaggatgatccaaactacaagatgataataactatttctttatctttgggttaatgttggttgtgccttatattttggaacggagggagtaatttattagagtcacgtgacaacttaggtgtattttgtcggaacactactactaatagtctcagtttacttgtagtcaactactgttggttgtagcttggtggcatactctacctacctatcagttgttgatgttactcgcggagtatcgttctttatctttggtgctagatgacatgcatgcatgctcattggatatcagctgattcttatattaggtacattgtgcatgaaatgtcttgtaagcaatatgacttattagcgatcggtggatagtggtttgtatgtagaactcgtatacgtggggattagtgaggacatacgattccacatgtggaggggagtatcgtggtgggtatacctgattttttttctttgagatggagatctaatgggtaaaattagtaggtccaccgatttttttttcctaatttattagaacaccatgtggcggtttacgagcgtttgtaggagaccacatggcggcttgggagtttttgtaggaagttaatttaatgaacttttagtatatgatagatagatatagatgtacgtttacaccaggtcacattttctctgctgtttcctaattggttttactttcatgcctagttaattaattatattagctatagggttaaaccaatctgcatgagcacacagacagtaaagtggaggaggggattagctaacagttgcttgcacaagcaggtggacagaaagacatgcattcgctttaatcacactgctctgaatgtgacatttctgtcatgccgctcatgcatgattagtggccggagtaggagtacacgttactagtggaaggagaaaatcttgttgtcggaggctgccgcgaacgggtcatgtgcacacttaattaccgtgtagtcacgtccaaattccaaaaacatagtaagacgttgaagaggatattgagcaaaattcgcatacattatattaattattatactcacgtcacatgggctggagcctatttatacggaggaggagcaaaggatcggatgaaatcgaccaagatgacgaagatagcaggtgttcttattttagttcttgttatctgtccaactattacttccgctaccgaaacccggggaggtaaatccatccatccatctcatgttttctcacaatctagctgagcttgattctctcttcctaattagtagtaattacttgtgcatgtttgtattgtgttagcgcttctattcctaattaattacttgtgcatgcatgcgctaattaattctgtttgtattgtgttaacaggccgggatgacgaccttagtgacgacaaaatctggacatctctgattgcattccactatcctggattggtggttccgccaatctgcatcgaggacattgcaaagaaatgcgggtggaataatctgacccctgcatgcgtgatggaagagatggacagctgccactaaggcgaccaccggccactctccatcagtctcaggctgacaggctctcagccataataattaataagctgtaataaggggcctaattaatatgtactacttcatgcctctgattttgattgcaagcaccactagccatgcatgcatgtcgtatattctaatagaattaattaatggtaataatataaagctagctagatgtgcctgtgggtttgatttttaatcactaggagtaatgatagaaaaaataattaagaattacttcaattttttaaataactagcaaaaatgcccgtgcgttgcaacgggtaaaaagaatccaatgacaatatacacttttcatgcataaccatattaatgataatgtttatatggatcgttgtagttaccacaattagaaaattggatttttccgccccttgtaccatataatggttttttattatatacggacgacggaaacttttttaactttttaagtttttaagtaaagttagggattagagactagatctgttcccttttgtgattaggaatttagattgtttatttacttttttagaaataaaaagaaaaaaaagagatcgggagatggggaggagatttttttccacctccgattcgcttttgtttttctgttgccgcgtttttcttttcaggatcgctcttttttttaagttagacggacgacaaaaacatcataaattttttaagtagtaacagaaacgaacggtcaaatatatttaaataaatcaacggcgtcaaatatttacctcgccaactgccccgaggcttcctccattgtcacggttcaaatcaatagcagccacaaccttccaatttagcgaatgacgagtgaaacgacggccaacaggcaatgtaacagagcggccaccggtcgactccaccacaccagcacacgctctcgtgaaaccctaggctcctctcccgcaggccgcagccatgtcacagcactctgttgtctccatgctcatggccacgagtggccttccctgagaccatgccttcacacgacggtggaagagatgacctggccactacttaggggaggatgtgaggcgcatcatggtccggtgttattgctcggtgcgtggggatagcgcggcgcacatccgctcggctggatggggaatcggtgatttcactgtcgcattgttatcacaaagatatctacatccgtttctagccgttggatgaatagatcggatggctgataaaagagataggaagttttgtgtaggttctcctaggtgcatctagcaaagagaataactcctcctttttatatatattagtaaagatgagtatgtaggtttattagactaacatcataccacttaatatcactgctagacaagtgatctttagtcccgagttgcaaaccgacaccacaaatctaggatatctttagtctccgttggtgttactaaccgagactaaatattattttttttccttttttcattgtttttttttgctgcttgcatattgatcacagatccagaaatcatcacaaaaacagatccacaaaaatcatcgctaatccacaaatcatcagtgatccagatccccaaaaatcatcacaaattatactaccatcacaaatcaaaacagatccgcggacttcgagcactacgactcccacctcagcctcctcctccaccacaacaactgctgccacacccaattccacccgtcaccacacctcggcagctggatcgtcgccgtcggcgctcctctcccgcgaggcagaggcggatcccagcgacgactgtccgcgcgcctaggtcgtcatgcaccgcgacggcgagtgccgccgcctaccccttgtgccaccaccaccccgctcttgccaccgccgctgccgcctcccccctcgtgccaccgtcaccgcctccccccttgtgctgccgccgccgcctccccctccgccggatccagtggaggagagggctctgccaccgcctatcggtcccggctacgatcggagaggaggtgtaggagatcggagagaggaggaaaaggagagatagaaagagagaaagagaaagggttagtggatgagggggagaaagaaataaggacgacgacgcgcgctgctctctccctccccatgtggctcgactgtttttttaatttttcgtcctggttggtttagacaaccgggactaaagatagtgggaggcttgacaatttttgaaccgggacataaaaaatgatctctagtcctgtttgatgttaccaactggaactaaatatcaaaaaattctgttgggcttttgaaccgggactaaacatattctttagtctcggttcctattcgaatcggggctaatgtgatttttgtcatccggacaaatatcaattctccggtagtgtatattgatgtattaaaatggaaggggttggatattggctaccagaaattatttttctagctaggagaaaaagagctgcgatatctaatccattttttcgaccactaaagcatctagaaaccctgcttcactataccgaacaattcttatcaatgggaaagtctgtaatagttatccaagagttctgtgtagaagggctatcatgcaacggatcaaacgtgtggatagcacaccatggcaccacggagatcgatatccacttctgtcattccatgtaaacgacagctccttctcccctttctagagttggttcgatttggagaaggggattgaaaaaaaaaagagtaaattgcatcgccgtacatgaacttgttaggtggtagcaatctagtgtacgaacttataaaacgcttgttctagtgcatgaacttgtcaggtgcgtgtggaggaaggcgaaaagaacactacatggataatcttattgattttgtgattgtagaaaaagattaaaaaaaagagcaatgatataagggtgggaaagatatgaaatatcatcacttccttgatgaaggataaagtagtgatcaaatttataaataattgcagtcttatgcaaacgcactatacatatgcacgtcacaccctaatcaatatcagcttcgtaagattaatattgccaagctattttggctctcgtttgcacgaaactatacaagttcgtgtaccgaaacgagcattttacaagtgatgaggcatcactagattgtctgtacgcatggtttggtataacacacatgcacgtatgcatgtgcctggcagtaggggtgaaaacagtatggaaatttcctagaattctggctaccgtgtccggtttgcaccgaccatttcagtcggtattggtaattgtcggtattggaaatataaacggtaatctcttccggaaatggtagcggaaatgagatgggttttttccgaccgttttgttggtaaccttttttgatcggtaatttccgtcaaatttccgacaaaattccgaagaaggaagcttgggcggctgagcctggctaccaggagcagcccattaggccggaagaaaaaccctagggaatgggcgtcaaccagcgtgtcgcttctcatcctctccctgtctcgtgactctcgtatagctctccgccgcctctacctccgccgaccgccgaccgcccatcgtcgcaaccacttgtcctcgccgccacgccgccgcttgctagtcctagccgtcgcatcctcgcgcctcactgtgtcccttgccggagaagcatgatggcacctgccgaacaaaaatgccgcacccatctgctgtcgtctatcatatccatggcatgtggccgttattaaactatagtctcgtcaacttatcgatattgaagtatcgttgaactttgtttatattgtttgttgaccttattgtcaactcattaatcatcatataacagtgttatgtggcagcgtgatgatgcaagggtgaaattataaggtcatcttcatgcatagttaaatgtgggatgatgtcacagttcgctgtttacgacatgacttttcgacttccgactgatatcggtagattcccgttccggcggttctgtttccaatttacaatattgtgcaatgtcaatctggaatggatatcaaactgtcccaatttcaagaattacatagtagttttagacggtgcataatcacatcacacatatttttagagaaggtaaatctggacagtacatattatcaaaaaaattcgaacgattgttacaacaatctctaactcattcgcagtagtcggcaatgaaaataaacgacaaaccaaggttacaaatcagagcacggagacaagcaatttcttaccccacgactaactcatgccagttacaatctatcgattccaccttgttcctatctcatatcggggacgacggcatccggaggctgccctcggcgtcagcgagaaggggtgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacagtagcccctgagaccttcgcagtcgaaaagataatcttctctcgaaccatattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaaggaatttccaaagtattgggcatacgccatgcgcacactgctttaacagatgtgcttaagtccctagaagacacatggtttcaccacacctagaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactatttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacaacaaacgcaaccgacatgatgaagatgacgatgtcggtgatccagccaatagcagtgtagcaaccaatgaaaatgacaaagacgctcatcagcatttgcatagtaggtcaaccgtgaaggtgaaataataagtcagcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgttcaagtagaaatcctaaatattggagagcctcttgttgtagtaaaataacatggcatcgcatgccgagatgtcgaggctcacaaagacgtcgtggttggtgaagtagcaaaacttgcgaagtagcatcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagttgtataaaccagatgtagaagcgagggcactagtcagcagcagacgagacgaccggcgatgaagatggtaaggccaatcaacactggcagaatcatgcagccatggaagtgaagaaaacagtcggcagccatggcaaatgtaggcagcttgtgttgaagatactgatgcctattagtagtgacagcgatgtagccagccgtgaagaagatagcatcagttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcggccggttggtgaagacgtagacgcccaacaacggcggcataaaggccagccgtgcaggcggaaacaccagtcggcggcggcgaaggcaagccggtcggtgaagacgtagacgcccaacaacggcggcataataagtcagccgtgcaggcggaaacaccagtcggcggcggcgaaggcaagccggtcggtgaagacgtagacgcccaacaacggcggcataataggccagccgtgcaggcggaagcaccagtcggcggcggcgaaggcaagccggtcggtgaagacgtagacgcccaacaacggcggcattaaaggccagccgtgcaggcggaaacaccagtcggcggcggcgaaggcaagccggtcggtgaagtcgtagacgcccaacaacggcggcataataagtcagccgtgcaggcggaagcaccagtcggcggcggcgaaggcaagccggtcggtgaagtcgtagacgcccaacaacggcggcataataagtcagccgtgcaggcggaagcaccagtcggcggcagacgaggcggccggttggtgatgttctgactgatccattcctggagcgtaagagataagcttaaaaccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacactctgcccgactaatcatagccaccaagcactgggagtcggcctaagcacttcccaaacatgcatatgagtgtcatgagttcgtcattaatggaacaaagtttcacggatcggagtttactactcgggtacttttgcaattattaagagcagaaaataaatttatctcatctctatgcttttgatttattccgaatagtacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaaatatcatataaagaataaaataaatgatgacttagctttgtaatattccccttggtgatggcagaagtggccaatgtgggaacaaagtcgtccatcaataacaatgaagacaccagttggcggcgacgaaggcggtcgacggtgaaagcgaagatgcccactaatggcggcatgataggtcagccgtgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtagacggaggcaccaatcggcggcgacggaggcaggccggcggtgaagatgtagacgcccaacaacggcggcataataggccagccgtgtagacggaggcaccaatcggcggcgacggaggcaggccggcggtgaagatgtagacgcccaacaacggaggcataataggccagccgtgtaggcggaggcaccaatcggcggcgacggaggcaggccggcggtgaagatgtagacgcccaacaacggtggtgtgaccaaccaaccatataggcgaagacaccagtcggcggcgacggaggcaggccggcggtgaagatgtagacgcccaacaacggcggcataataggccagccgtgtagacggaggcaccaatcggcggcgacggaggcaggccggcggtgaagatgtagacgcccaacaacggtggcataataggccagccgtgcaggcggaggcaccactcggcggcaacggaggcaggccggcggtgaagtcgtagacacccaacagcggcggcataataggccagccgtgtaggcggaggcaccaatcggcggcgacggaggcaggccggtggtgaagtcatagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataataggccagctgtgtaggcggaggcaccactcggcggcgacggaggcaggccggtggtgaagtcgtagacgcctaacagcggcggcataataggccagccgtgtaggcggaggcaccactcggcggcgacggaggcaggccggcggtgaagtcgtagacgcccaacagcggcggcataataggccagccgtgtaggcagagacaccagtcggcggcggcggaggcaagccggtcggtgaagacgtagacgcccaacaacggcggcttgatatgccagctgtatgttgatctgctgaatcaactcatgcatgcatgaaatttctccgagcaagctataggcggctgctcccatgtgcccgtggtggcgtggtggccgcaacgcatccgtcggcgctgctcccgactgaagatttgagccatcgagattaatctcgccgtttcttctgtagtcgattccatcacacttttcgatgggtaattcgacgcagcccctacctggcgcgccaactgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacaaggggactgcagcagcggcggcggggggtggaacggcgatggcagcaccgccgtgagctatagctgggtgagggcgagagggggatcgcgacaggtggaatggcgatgctgacaagatcgatctagggcaccgccgtgagcaagagccggcgcatctcgatcccctttgtctcactgatctaaagaatgacccaggggcacattggtcacaacactcgcgattcggtgtgttaatccggtgaaattggaaaaacggcgaagcagcgtgttgtgcgagcgtggcgatagcattttagcgaaacaacttggcggaatggcattacagcgaaacccatccttacatgtggctaaatgtcaattttctcggacaatgcaccatgaaaaaagaaaagaaaagccattggttcattcactcgctgtttgttgatgctttttctcttggccaacaaaaatcacctaacgatttgcggtgtaatcgacggtgttgtcaatatcgatagatcaaaatttcaagattaattcactttcgtggaatcaaacgactaatttatgagcaaattagcaaataagagaaatatcgtacttacatgacgagaaatatcggaattacgttacgacaaacgagtagtttccgagcaaactagcaaaggataacctcctcgctttcgtggagaaacacaaccatttttcagtgcaaaacaacaaagattaaccaaatcctcttagccataaaaacaaaatagaaaatatcatatctctactacttaaaaaataagagatgcttccatcgtccgtcaaaaaaactggcgaaaaaaaaaccgggcgagcgaggaaaaaaaccaaaacagggcgagcgaggaaaaaaaccgggccaaaaaaaccgtaactgtccggcgaaaaaaataattcgattctgtgaaaaaaatacaaagtgtttccttcgtccgtgtaaaaaaagtccgactgtaaaaaaaaaaaaggccagcgcgaaaaaaaataggaagggtgaaaaaaagggcggcgagaaaaaaaaagcggcaaaaaaagaccgattccgacgcggcaaaaaaaacgtaaaaaaggtaaaaaaaaaaaggccagcgcgaaaaaaaataggaagggtgaaaaaaagggcggcgagaaaaaaaaaagcggcaaaaaaagaccgattccgacgcggcaaaaaaaaacgtaaaaaaggcaaaaaaaaaaaagaagcgccccaaaaaatcatctgattcctattcctatcgtaccataaaatttaaaaaaagggcagaaaaatgcaaaaaaaaaaagaggcgcagcaaaaaaaaaaagaagtcctatttctattcaacacggaaaaaaattaaccgcctttgaaaaccgattcgataccccaccatgacaaaaaaaacaagtttccatctaaaaaaggttcagcataacataaaaaaaatctgactatagaaaaaaaaatcaacactccaaattggctgtaaatcaaccgaacaggagttggtttaaatcgtaccaagtcctattcagcacacatcaggagatcaaaaccatatatctctatctcttctctactacttaaaaagatatgcttccatcgtccgtcaaaaaaaccgggcgagcgaggaaaaaaaccgggcaaaaaaaaaccgtaactgtctggcgaaaaaaataattcgattccgtgaaaaaaagggcgacaaaaaaccggcgaaaaaaaccaaatgaaaaaaaccgtaactgtccaataaaaaagggcaaaaaaaagtccgattctgtgaaaaagggcgacaaaaaaaccgccccaaaaaaacggacgagcgagaaaaaaaaccgtaaatgtccgatcccaaaaaaagggcgaaaaaataatccgattccatgttaaaaaagcgaaaaaaaatctctatctctatctctgtctctactacttaaaaaataataaaagatgtttccttcgtctgtaaaaaaaaaagctaaaaaaaaaggtccgactcctatccgattccctctcagaaacaaaaaaaaagtccgactatagatccgattcttaatctataccgtgatatctcacatatcttggtgaaacaaaatgatgtgccggattagagatctgtttaataaaacagaacctacaggtcgagagcattccatttttatatgattttaatttttgggtttgtacttttgcttttgagtccctataatttttatatttatatttgagttcctataatcttgcaataaggtacttggggccgtttttgttaaaaataataataaaagagagaacaaaagcagaaaggtgcataaaaagaaaaaggaaagctgcaaaaaaaaaagaaaaacaacaacaacaaaagttctgtttcccctatgtggcaaaaaaaaaccgtagatccgaacgaaaaaaaatctgattcctataaaaggcaaaaaaaagtgaaaaaaaatactagattcgattccgttaaaaacaggaaaaaaagtcggattcctataaaggtgaaaaaaaacagaaaaaaaatctaaaaaagtttgtccgattccataagaaagtggcgaaaaaaatggttcgtaaaaaataaaacgcttgttcgtataaaataaaaaatgcacacaggaaaaaaatggaaagggcgaaatttctaatcaatatatatctcttctctatctctaatataatctaactattttttaaaaaaaaatgcacgagagaatagaaacggttcaaacaaacgcgtgagaaaaaagtcagaaaaagcgcaaaaaaacacgctaaaaaggttttccatcttccataaataaataaaaaaacgcgcgaggaaaattatttccatcatcggtaacttttttaaaaaataaaacatgcaaggaaaaaactgtcagaaaaaacgcgccattttaacaaatggttttaaaaaaccgcgcaagaaaaaaacaccgtctattaaaaaaatcgctctgagtcggataggatccatcgattttttgccacctactacacggcttttatttcgtctatattctcttgtttttaaaaaaagcaacaaaaataacatttgaaaaaaaacaagcaaaaaaacacgcgagaaaataattggcaaaaaaaggcaaaaaacacacgagaaaagaaaagcaaaaaatagagaaaaatatggttttcattgtaaataaaaaagcaaaaagatcatgttagaaaaatcttttagaaagaaatgcgtcatttctgaatggtttgagaaaatcgcgcaagaaaaaaacaccgttcgtaaaaaacaagccgctcattaaaatacaaacattgccattgacatgattatttatgaaaaacgtatattatcattagaattttttcacccgttgcaacgcacgggcatttttgctagtaaaaataaaaagaggaaaatagtagattgataatattgttcggcggggtcctttctgccgacgccttgactaactttaaagcgccgcaggccgcatcaacgatctccttttttctgctccgtgggcccatccttccttcctatccggactggtataccgcatgcaatcaatcaggttgataatcctctataatctcgtaccgttccatgattccatctgatcatccctgttgcttcatccaaaattccaaatcatgtgcacgctattagtgctgctctccattctgcaccatctgcctgtgatgtgctacaatagaaacctgctcagcggcatccgcatagtccacatacatatatacatatatatattcctagctatttgtttttaatgtataatttaaccgttataatttcatttagcccgcatagtgtctcagccaatttaaaacattggttgctgctatagcatttgcacgttgcactttgctttctcatactaaattagtaataacacaaataggaccaagcagaaataggaaaaatgaaggtaaatctggataagtacgatatcttatggtgaaaaccatattgatatcctgtatttctgtaaaataaataataatcgggaaaaactaaataacaaatatgaagtgaaagattcgatgagaatttgtaatactaagaaccgttttttcaaatatgcactttagtctataactttttggttaatgaaatcgcaacaattttgaggaaacataactttaaattttataatagaatatctaaggaaaaagtatgaattacccccctaaactatcgcggtcgaccgaattaccccctaaatctgaaaaccagacatcactcacctcgaactttcaataccggacgaattacccccactggcacaatccaaagcggttttatcctacgtgacgtacacgtggcaatccagtcagcatttcctttttttttaaaaaaatggtggggcccacctgtcatctcacctcctccttctcctcttcccctctctctctctctctctccccccttctctcggcgagcacggcagctcgcggctctacgccggcctcagctacgcctgctacgcgtcatcggccacctccccgtccaccaacggccacgttcgtcttctcccgcgcggcgccgccgccgacgacctgtacgccacgggctgcttcacctactgcgccgagctcacgccgacggcgcgccgtgcaccgggacgggttgttgccaggtccccatctcgccggacatcccctacctcggcgcggtgttccacaccggcaactggacgaacaccgcgggcggttcacactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatctgtgacggcttgcacttgtaacccgtcacagatcgtctgtgacgggtcacaaccatggctcgtcacacatgacatgtcatctgtgacgggtgtagtattatgaaccatcacaaaagagaccactcatctctgacgggtcttttaactaacacacgtcacagataacgttatctctgacgggtggtagttatgacccgtcagtgatgagtgaaaattcaaatttttaaattttgcaaaaaaacctcggattgaaacatgtcctatataaaagttgtagctcttaatgatatccacaactttataactaacaacatttctattagagatcatttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataataacattgggttagtagtcaatatgtgttaagtaggtgagttggtaagggagctctatatggaggttgaggtcttgagttcgaatctcacttgtagcatccaagttatattgcgtgaaaaattgtgaatttgtaggtagtgatgtgtaaccatgtataggatggctagtaaaattcaaaatatttttttgaggttttttgttgcgtttaaaattcaaaaattgtatttcttgctttgtcatcagtgacgggtcgtaagttacaacccgtcagagatgagtcatcagtgacggtcaggtagttacgacacgtcactgatgactcatctgtgacgggtgacaagttttaacccgtcagagatgacttatataccggtcagagatgggttatctgtgacgggtgtttcatccgtcacaggtgattttgtcatcagtgaccactaatcactgaccaagaccaaacccgtcaaaggtgagggtttgggcccgtcagagatgacctggtccggcgtagtgtcaacccgtgcttctaagccatcggcatgctcgtgtactacaacgagaccttggatgccggccgtggcatccccgtggacgtcgacgtgtgcgctcaggtcgccggcggcgagctagaggtcgtacaccatacggaggaggtgccgaagctcgtagttgtcggcgcgggtgagcacgccgatgagaaggcggaagtcgggcttccgcgacgccgtgtacgcccccggtgtcgccgggccgcacgagctcatcatgagcgcctggacggtgggaaggaggatcctgccgccatctcgctccacgtcccgccgccctcgccctctctgccgccgctgccatcggagccgaccgagcgctaccccgacgtctagtacgccgcgtcctcggctcctcgcccgccgcccacagccgcctccgcccccgcccaccgccggcctcggctccttgcccgccgctcgcagccgccttctgttcactgagagagagaggggcaaaggaggaggagagagaggggcagagaaggagagaaacaacaagcgctgaaaggtgggccccaccattgcttttgctgactgtattgtcatgagtgtgccatgtaggctgaaaaccggttcgaatcgatttagggttgtaatttatccggttttgagagtttgggatgttaaatgtctagtattatggtttagggggtaaatcgtactaccgcaatagttcgaggggtaattcgtactttccaatatggaaatatctaactatttgccaaactattggtcatcattaattacaatcttaatttggttgttctcataattctttggaaacagaaaattaaattccattaatatattactctgtatgtttcaaaatattactggtcattctcacatttaaaattattaatttagatcgtggtcttctatcttcacattttatcaatgccatgtacaactgttaatcaaagttaatattgcttttgagaacgattataatgtagttaataagcatagcagtgtaatttgcacatctcctagtttgatgtgaaattttgctagaatgacaaataatataaaatgagatatatgcaaatttaatatatattttgcagatgagccatattacaggctaaattaggcggcacgtcaacagggcgtgcagatcttctagtatctactaatctaaagctagcacttcttgtgccaacgggacatttaactatttaccactatttggtttgacaattatcaaatacccttcttatatttgcacatgcattggtagtgcataaacttgttagatgggtacaatttagtacataatcttgtaaaatgctcgtttcggtacacgaacttgtctagttttgtgcaaacgagggccaaaatagcttggcaatattaatcttacgaagttgatattgattagggtgtgacatgcatatgtatagtgcgtttgcataagactgcaattatttataaatttgatctctactttatccttcatcaaggaagtgatgatatttcatatctttcccaccctagcttatatcattgctctttttttaatctttttctacaatcacaaaaacaataagattatccatgtagtgttcttttcgccttcctccgcacgcacctgacaagttcatgcactagaacaagcgttttataagttcgtacactagattgctaccacctaacaagttcatgtacggcgatgcaatttactcttttttttttcaatccccttctccaaatcgaaccaactctagaaaggggagaaggagctgtcgtttacatggaatgacagaagtggatatcgatctccgtggtgccatggtgtgctatccacacgtttgatccgttgcatgatagcccttctacacagaactcttggataactattacagactttcccattgataagaattgttcggtatagtgaagcagggtttctagatgctttactggtcgaaaaaatggattagatatcgcagctctttttctccttgctagaaaaataatttctggtagccaatatccaaccccttccattttaatacatcaatatacactaccggagaattgatatttgtccggatgataaaaatcgcattagtctcgattcgaataggaacagagacataagaatgtgtttagtcccggttcaaaagaccaatagaattttttgattctttagttccagttggtaacatcaaccagaactagagatcattttttatgtcctggttcaaaaattgttaggcctcccactatctttagtcccggttgtctaaaccaaccggaacgaaaaattaaaaaaacagacgagccacatggggggggggggggggagagcagcgcgcgtcgtcgtccttatttctttctccccctcatccactaaccctttctctttctctctttctatctctccttttcctcctctctccgatctcctacacctcctctccgatcgtagccgggaccgataggcgttggcagagccctcccctccactggatccggcggagggggaggcggcggcggcagcacaaggggggaggcggtgacgatggcacgaggggggaggctgcagcggcggtggcaagagcggggtggtggtggcacaaggggtaggcggcggcactcgccgtcgcggtgcgtgacgacctaggcgcgcggacagtcgtcgctgggatccgcctctgcctcgcgggagaggagcgccgacggcgacgatccagctgccgaggtgtggtgacgggtggaattgggtgtggcagcagttgttgtggtggaggaggaggctgaggtgggagtcgtagtgctcgaagtccgcggatctgttttgatttgtgatggtagtataatttgtgatgatttttggggatctggatcactgatgatttgtggattagcgatgatttttgtggatctgtttttgtgatgatttctggatctgtgatcaatatgcaagcagcaaaaaaaacaatgaaaaaaggaaaaaaaaataatatttagtctcggttagtaacaccaacggagactaaagatatcctagatttgtggtgtcggtttgcaactcgggactaaagatcatttgtctagcagtgatattaagtggtatgatgttagtctaataaacctacatactcatctttactaatatatataaaaaggaggagttattctctttgctagatgcacctaggagaacctacacaaaacttcctatctcttttatcagccattcgatctattcatccaacggctagaaacggatgtagatatctttgtgataacaatgcgacagtgaaatcaccgattccccatccagccgagcggatgtgcgccgcgctatccccacgcaccgagcaataacaccggaccatgatgcgcctcacatcctcccctaagtagtggccaggtcatctcttccaccgtcgtgtgaaggcatgtctcagggaaggccactcgtggccatgagcatggagacaacagagtgctgtgacatggctgcggcctgcgggagaggagcctagggtttcacgagagcgtgtgctggtgtggtggagtcgaccggtggccgctctgttacattgcctgttggccgtcgtttcactcgtcattcgctaaattggaaggttgtggctgctattgatttgaaccgtgacaatggaggaagcctcggggcagttggcgaggtaaatatttgacgccgttgatttatttaaatatatttgaccgttcgtttctgttactacttaaaaaatttatgatgtttttgtcgtccgtctaacttaaaaaaaagagcgatcctgaaaagaaaaacgcggcaacagaaaaacaaaagcgaatcggaggtggaaaaaaatctcctccccatctcccgatctcttttttttctttttatttctaaaaaagtaaataaacaatctaaattcctaatcacaaaagggaacagatctagtctctaatccctaactttacttaaaaacttaaaaagttaaaaaagtttccgtcgtccgtatataataaaaaaccattatatggtacaaggggcggaaaaatccaattttctaattgtggtaactacaacgatccatataaacattatcattaatatggttatgcatgaaaagtgtatattgtcattggattctttttacccgttgcaacgcacgggcatttttgctagttatttaaaaaattgaagtaattcttaattattttttctatcattactcctagtgattaaaaatcaaacccacaggcacatctagctagctttatattattaccattaattaattctattagaatatacgacatgcatgcatggctagtggtgcttgcaatcaaaatcagaggcatgaagtagtacatattaattaggccccttattacagcttattaattattatggctgagagcctgtcagcctgagactgatggagagtggccggtggtcgccttagtggcagctgtccatctcttccatcacgcatgcaggggtcagattattccacccgcatttctttgcaatgtcctcgatgcagattggcggaaccaccaatccaggatagtggaatgcaatcagagatgtccagattttgtcgtcactaaggtcgtcatcccggcctgttaacacaatacaaacagaattaattagcgcatgcatgcacaagtaattaattaggaatagaagcgctaacacaatacaaacatgcacaagtaattactactaattaggaagagagaatcaagctcagctagattgtgagaaaacatgagatggatggatggatttacctccccgggtttcggtagcggaagtaatagttggacagataacaagaactaaaataagaacacctgctatcttcgtcatcttggtcgatttcatccgatcctttgctcctcctccgtataaataggctccagcccatgtgacgtgagtataataattaatataatgtatgcgaattttgctcaatatcctcttcaacgtcttactatgtttttggaatttggacgtgactacacggtaattaagtgtgcacatgacccgttcgcggcagcctccgacaacaagattttctccttccactagtaacgtgtactcctactccggccactaatcatgcatgagcggcatgacagaaatgtcacattcagagcagtgtgattaaagcgaatgcatgtctttctgtccacctgcttgtgcaagcaactgttagctaatcccctcctccactttactgtctgtgtgctcatgcagattggtttaaccctatagctaatataattaattaactaggcatgaaagtaaaaccaattaggaaacagcagagaaaatgtgacctggtgtaaacgtacatctatatctatctatcatatactaaaagttcattaaattaacttcctacaaaaactcccaagccgccatgtggtctcctacaaacgctcgtaaaccgccacatggtgttctaataaattaggaaaaaaaaatcggtggacctactaattttacccattagatctccatctcaaagaaaaaaaatcaggtatacccaccacgatactcccctccacatgtggaatcgtatgtcctcactaatccccacgtatacgagttctacatacaaaccactatccaccgatcgctaataagtcatattgcttacaagacatttcatgcacaatgtacctaatataagaatcagctgatatccaatgagcatgcatgcatgtcatctagcaccaaagataaagaacgatactccgcgagtaacatcaacaactgataggtaggtagagtatgccaccaagctacaaccaacagtagttgactacaagtaaactgagactattagtagtagtgttccgacaaaatacacctaagttgtcacgtgactctaataaattactccctccgttccaaaatataaggcacaaccaacattaacccaaagataaagaaatagttattatcatcttgtagtttggatcatcctaataaatataatgcatgcatccaatagaattagagaatgtgagagtgaattgtttaaaaaattaataatttaatgaagaagatgtcataattaattgaatgcatgccttatattatggaacatataaagaaagtggttgtacattatattatagaaccgagggagtaattgttctataaatataataaataaaataaaacaactgatcattggtttccacttaaatcgatggaccaagatatggttcgatcatcggaggcgttttagtttatatggttagggaattcatgttcatatatacatgttttagtttatctgcagctgggtagtaaaaggctagtggtagctaagcagcctagcagaagtgcagagaacaaatgtaatttgatcagtttcactctcatccagctgagaaccgaacgtctccgataaattaagaagacagttcaagtcaaaaggagcgaggaaattagggcaaaagttgatgctagtgaatctgaaatctgtttacacccaaatttgacacctatagacgaaataggggaaaattgccaaagtttggaaagtgacgggtttccttcacagggccggtcagaccacaggtgtgtgggcggtctgaccggctagtagggccggtctgaccgcaggtatgtgggcggtcagaccggcagggtccgagtccgagtctgttttcgtcgggtctcgggtttccttgctcgggaaggcatgtttcgtgtttcctttggtttctatcccgagttggacatggagaagggcctgtagagggcaagaccaacccctatttaagcgacaaggccggttcattgtaaaaccccccaaatacaatctacttgaatcgttcttttactatgtttttctattttactctagtttagtctatctttgtcggtttgcgccgtaaaccgtccgccgccgctgcgagagtgcgacacctctttttaggtttgtcctgaaaaccttccattttgcccacgagacgggtagttatcctcatatcgatctaaatcggcctagaggctgattttgatctctaaatcggctctgctagccggtttagttgcttttctacaaaacccatcttgatttggccctttggctagatcgaggtggttggcgactccatatcaccgcaaggcgtttaggtgttgcgatcgtgcttgtcgacttgtcacaaaaagttgccaacaaaatccacaaagagaaactattggttttcggatcatctacagtgatatgatcccgttgccatcatacgcatcagatcagccatcgcctgtttgcaatttgcaacgaggagcaatgtaacaggctagctagcaaccagggtttcatttaccgccggggccgcggttaccgcgccccggcggtaagcacggttaccgcacagtaaccgcggtaaccgtgacaaaccgcgacaaaccgtacaaaatttatcaaaaattcaaattattttttaaat

SEQ ID NO: 59266 - DNA, 7123 bp, Oryza sativa
attcttttaaattatatgctacttgttcttgcccattctctctctcccttctcctcctcttgctcctccctcctctctctgtgtgtgactgcagagaaattgatggatgtttgctacatgggaaagcatcagcctgtacttaaatcagatctccatacaaaataaaagcacctttgtctttgtttcatactgacaattactctgtatttccactttattcaaacaaaatatgaatcagttttcccttgcaagaatcattctacttctgattcctctatttttctctcgtgaagtttttcacttctttcttctagacagtggtgctgaaaggcagttcccactcaccaccttattttcactgctggccttttattgatttcttgatctaattgtctatgtcagtgcaatccatttgtacttttgctatcagtgacagtgattgtagcttttcctgtctcttcttgaacataaaacttctatgtctatagtttaacaataatgaatagtgttaaagtcttagcaagatgaagatatgacacatttctaccatatgacaacatgtcttgtagatcccacattaaaatctctctcatctctagtttcctgatgagcacagtgtctccattaggcttttgcttgcttcagagcccaattacaaagacttgtatacttcctgatccccatcgatcgctccatagtactccttccgtttcacaacgtaagtcattctagtatatctatctagattcattaacatcaatatgaatgtggaaaatgctaaaatgacttacattgtgaaacggaggaagaagcaaaagaatggtgtgcattatttctttcgtgaacgatcacaccttcactcaaggaatcaatttgagagtccttttccgtctctgctctttcatatcttttggttgttaaactgtatcttgctttattttcgttagggggaagcaagcgatagtgggggcaaccaacagatttgggaaaagtggtcaacggatggcacagaaagacaggtagcgaagctgatggaagaagacatcggggcagcgatgcaatttctccaatccaaagcactctgcatgatgccaatctcgctcgccatggcaatctatgacacacaacaaacacaggatggacaaccagtgaagcacgaacccaacactccttcctagtatagtaatagcaactgtaagtctgtaacatgaatcgttacaacccctagtagacatcaacctatcaaagtgtaagataaaacagctcgttttgattcactaacaaggaggcaggaaaagacctaagagatcctctccacttgaagttgtaccaatggtatatgatgtcacctttcgttatcatcttttgttcaaaggtgctttgattgcaaggatatggtaagcaatagcctgctcatcctcctacacctttcaatgcccctatgagcgcgggtgattgagagagctactaaagagtctggcatgctctcacattgtctcttttcgagtctgtagtgcaccaaccatacactttgtggtggggactgcttttttggtagtgggtgtttggactaatcaaaagggattgatgtatgcctgtgtctgcagcctgcacaatggttgacggaatttgaacacaagatgaaatggaagatgattttgatggtgatgttcatttatctccatttttccaaagtggaggcggaggctttggtcaatggaggctgagcgtgcgctaagctgatcgctagtgggtctgctatctacatctacatgcactactgttgtatctattgtgacatactcttgataagaaactgcggtataaagtttaatctttctattggcgattaatccatagaattactttgtattttctgccatgagttctcaactacccacattatttgtgaagaacagctgttcttgtactgttcactgccctctaccacagggtttcctgagtttgtggacaaattgtgagaatctacagcaaggactattgagtttttttttgtcaactgacgatttgtttggatgttactgtaagcaattcacccatctcaatacttgatatgtgctcacatgttaataattcatgggttaaatatctggtcaagtttatacttgcactaaggttgtttatcctgcatctttgattttaaaaagtttgatttcaagtgtgattacttatctgggaactgttctataaaaaagtgacggctaccttttatttctacaggctgaaatattgatttgcaggaagaaatgaagtttgttccttccattcatatgtttgtgctatactgcagaaaactgctaccggttttagtgcttttggtactccaatggtgctatccttatctctctgatgatatacataatttttactcatcaagcttactttgcattttctaatggcacagtcaatggtatcatgcactcatatgctgtgcttggctggagaggaaactgctgggctgactatacagcagtcgaaattttttgtgctctgctcatgtctgaatactatggttcattgattgatttgtgtattgcagagctcctggtaaaccaggtaaatctgctttcaacacattgtgtcagactttttggtgttattctgcagtttttttttaaaaaaaaataactgaagatggctgcattatgtccggcaaacttgtgaaaatgacccatttgcccttgtcaacatagataggggtcattttcacgcaaaattggcaatttgtaaagatttactctctctttccaatgatatatttgtaaattcatccgaaagaatagcatcttatgagtgaccgtccataaaagtaccaaatagtcaaattccccatcaagaatcaggataactcacaagggatctgaaacttgggatcccctggagcctgggtcgttgagacggtggatttttattttaattttatatggttgagagagtggataaataggtgctttggccacggctcaccgaataggcaatgccatgtcgacccacgtgctgagactggagcctaagcatggcggccatggcccaatgagatgttgggccatatcgtgttaggctagtacgtattggggtacatgtgttgtgccggaggtctgtagcccaaattcgacatataccaagaaaaaaatgcgaatagtccgttgcatcctgccacacaaacttgggaagatctggcgaggtcctccgctcaccgatagcacattcctcttcctcctcgtcaagcactgtcatggcacttcgtttcctacttccttcgtctcgaatcaatgagctgccaatgatcgacacgctcagtggttgtgctcacgactgggccggccgcaccactatgatgttgtctctttttcatgtacccttttagtgtaatctgttggcaacacctggggatccaatggaatccaaatctggaattttatcagatggtagtattggcaagaattcagttcgcgcataagggctttttggaaatcttcttcttggctgcttggcatatctagaagcaaaggaatggtttcatcttccaaaataatcaccccaccttccaatcgtggagattacttttcaaaaatgaagttcttctgcatatgtgcagaatgaaggatcctctcaaatagctggttttagactggttacaaactatataggaatcttgttttcgtttccttttttctctttgtaactttgtatatattcttttcatttataaaattacactgctgggcaaagccctggcagtttccccggtcaaaaaaaaatgcctacgttgatgagcatccaccatcgctttcctctaccctgagccttggcttcctcaattcttccgttcttctttgctccttgctcttgctcggatgtcagttgctcaactgggggttgttcaccggtcgtcgatcgtcactgtgtcgcatgggccagggcatgccgtgccattcgggggccatgtcatgctagcttcccacatacaacttgtcgtgcggggttggggtggcggcccaagcatggtatggttagatgggtcgtgccatcatgacccatagctaaacagggtgtaccattcctgggtcgggaactatacatacatgcccgggctaatacggaaaggcctagcccattttatatcctataggaagattcggcaaactcatagaagatgattagtaagctagatgttccacctctttatcttatatggacaaaatttatggccccatctttttgcttatgctgatgcttatcaacaaaaaattgaattttcaaccttaaatttaaagctgattttgagtttttttcatcgaagtttatttttcagccttcgcttttaggtcgctaaaaacacgtatgtaaaatttttattcacaaattacttattgtggaataagccaaacaatgaggccgttagatgtctggtactaatcacccttcctttaaaacttacactaaggctacaccataagaaataaaaaaccattttgtatctctgtaacatccatatcggtttgaagcctgcatatgaaaggctaaaaatatttttttttagtgtgtcccaccttaagattaagattaagaaaagaccataaatattgtagcataataatgttattagtgaaagaccatctccatgaacttaaataaactgaggatgccctaggccgagcgttgaacgcggacggggagcaaattgcctgagagccgaaacgcgcgaaacgacccgcccgcccacgcggcccagcccaaccaggtcgcacaacgcaactcgcgagggcgagcgactgagaccgtctcctctcgtctcgtctccccgctagggttcaggccatggcgcacggccgcgccgccgccgtacgccgccccaagtcgtcgtcggcgtcgtccgcgggggcggctgccgaacggaagcggaagcgcgccgccgccgccaagaccgtttccctcaagaaccagatccgctccaccgagcgcctgctccgcaaggtaacttaacctacctggggttcgggtttgggttggaaagcgctgcctctcgctcgcttctgctgctgctgctactgctgctaattctgctcccatgattaacttgtttagtaatttagttagtagcttactatctactgctccggtgtgtggagtggtggtggggaacaacgataaattcgtctccgttgactgaattttgctttgattagtatcttctgctacttgctacggcggggattatggaatggattgttttgaggttccgagcagcttggctcgggttattgcagtagtttcgtgaatggtcattcgcctcacgaattgcaaccctcccgtggggcattgcttatagggggaaaaaagataaacgagcctgatgttaagtatgcaaccacaactagatgaatcagaatgatgttaatagaagtgatgtgtttgctcatttcagagtaggatggtaaaggttgggttgatgatgattggttacaacatacttgtaggttggcagctttaatgtaggaaacaagtagggattgagggacaattgattgtagaatgtagagcaccttgcatgctggtcatagagcacattgcatgcatatatgtctgcccaagctcgcatgtactatacccaagggtaacctttacaagattccaggattccactgaaaatcaagttaaaaacacctataaggctgtatgcaagaagacagcctactgttttggtcattgtaattcaattctattcgaggacactatgcttgtctgtgcaccagtgcttgatgtcaacggtactgacaatgcacgcatggtgtgttttttgggtaggcttgcaggaatcccttcccccccctaaaaaaagcaatgtatcaaatggttataaccatcttctgtggcaacactgctagcagttttaagtattcgtgcatgcttaagagttagaacttctccaagtattggggttgatcatttgttggggtctattctaatcggtatcatttcccttaacatgccttagtgccaattgttacatgcatgcattactctgtttttttttcccaggcctgttgttaaaatgctaatattgtatatttggtcaggaccttcctaatgacattagggtagctcaagagaagaaactggaagaattgaagcggcaacaagagcttcagaatcaactggctattcaacgaacagttcagctgagagatagaaagataaaattctttggtctgctggacattctgcttcattcttgctcctgtatgatgacctttaactgaacatatgtacttatcattttgtttgtattggtatttgaaaactttgaagagaggcgaaagattgagaggatgatcaggcgccttgagaagcagcaacgttcaaatgccgatgatgccagcaataaactgtcaaaattaaaggaagatcttgagtatgttagggtaagcttactgttctttatcccccttgctgaatcagtatctttgcattaatttactacttacctcatcccaaaaagagtttacttttctactcgaatatagacaagtggttgtccagattcgtgtagaaagtgaactctttttgggacggaggtagtacagtttttgtgtggactatcctcaagtctcattcttaaacgactcttgaaataggtgttcattatttttttcaaaattggataaaaaatcattgttccgtctgaacctgcttgaattccaagctaaaattatgctgttttactcatgtgcagtttttcccaaagaatgagaaatatgtctcactgttttctggagggaataccccagatatgttagagaagaggaataagtggcgtaaacagataaaagaaaatttgatggctgctgcagaaaatggaaaagacttggaaggtgtgtgtttacattaccgtttactagattacttatgttctatttgtattcttcatgcacttctagcttttcatttgaaaattgtactgcctgtttggctacatatctactctgaagtactaaattttatttttctcgtcgcctaacagagacagcaagcgatgatgatactgtggatgtgagtgatgacgacttcttcatgtcggggagttcaagtgatgaagagg

SEQ ID NO: 59267 - DNA, 17595 bp, Oryza sativa
  unsure (1)..(17595): unsure at all n locations
actcgattatttgttaaagatagcaccttttgagatcatagctgttttgtgcgcctggatcataggcttgtagtttgtccttttcagtctcttatgttaatgttgtacttagtctaaaactgcatagacattctgcagaaaaggcatctttcctgattttgttagtttaatgcagagaaccagcttccagtgcttcaggtaaggcagcgtctggcatgtcaagcgatgaaaagaatcaggttgttctctctatactggtatttcaatttacaaacttcttcaaatttccagtaggttgctttggtatgcttccctacatttaatcccgtctgttttgcttttcagcgtcagagagatgctcgagttcttatgccaccacctcgttcattagcaccaaatagaactagaccaggggtgaaacacgtgttatccagctcaagcaatacttcaaatagcacaagtggtggcactttcaaaaataggagagcagcaaatcagcctggagatcataacagcaacctgagttcaaattctgatgctcataaaccacgtcgcaaaaggagacatcggaagaaaaagaagctggtataaactttgcacccatgctatgaacttaattaaatttatttttcgtgatatctgtatttgacaaaaataacttgtgcgatttaacattcaaatgcaagttatatcgacattatctatgacctgcatacattatatttgcaattacgacacttatgtgaaatgcgtgctttgtgtgaaatacattatctctgaattttagttttactgaaattttatctgattgtacaaatgccttaaggattttatatgcacattgtatgttccaccacaagtgaagatcatacaaacagtaacaatattgaaacatgcatatcgtttttaaggctatagggaggaaaatatttctgcatgatgtgtgtataactgtaagttggttatgcttgattttttttaaacaaaagttgttgatgatatcattaggaatgataacttggttggtttgctttgtacattgtctgcctgagaaaaaaaaatggcatgcactatcagcttgtttccctgatattaattgtcatgctacctgtccatctcaacaggcatgaatattctggagcgtgaggtggaagctgattttattcccgcaccaaagtgtgtactaaggctggttactatcaaaagaatggagacaacatgtgtgccctgaggaagttgctgattttgtgcgccctctctcgatgtaaaatgaatctcctatcgctcttcactcaatcactcatttgttttacagtaaccatccaaaaagttccgattattaactgaatgcatgctggtctttaccatgaagctgtgcttttccttatttttttttccttcatgacccaccatcaatcaattcacgggtacctgaaagctgtaattgtggttttagggacagctccatgaattcagaatttcggtacatactgattcttgtcgggaggcaaatgcatatgcttttatcattgctaggctgtgagcggttgtcgttgtctgctcccaggtctgggattacatgacctgtaaggcgtgatatggatgttcaattgtctccctactgtctgatccgcatctatcatgtgggtctagtgcacgttgtctgtagtcactgtagcaccagcattttcatattctccctcccatcactttgcaaaattagagagacccttctcactggactgttgccacactgtatttttacctactagtatcaatgttatacagtgcagctacattatctctgtcgtttgctggcattttggccaggttttctcttgcagccatgcatgcatgcatcgcctatgtggtgtagtaggtcagtatcagtaggtcccggttatgacctgtgctgctgtgcacagtttgtgacattctgggctgcagtaaagttccaggtaccatcgttatcagtgtggctcactcgcctctgcatcctatgctatgatccatatgatgtgtcgtcattccatgcatgtagttttcccacaccaccttaaaatgagttcatctttaacctttaccatttgtactaaaataattttacttctttctttttatctattgcatcgatgagtttcatttcttcaatacccccatctacacatccattaatactatttttcttattaatagaaggtactttggtgtttttcactttgtattaatttgcattccaacgatgaaagatgaagttattttgggatagaggtagcttgtttttcttttgattttgccgtgcatttggatgcttctgctgctgtgatctctcttgatgggtactatgtgacgtctctgttattcttttcaagcgtacaccctgtgcaagactggaacgtaacaggagctttgggaaaatcgaatggatggatatgcatctctctctttggaaaattgaatgtactatccttgtactacaatttcctgcctagcaggtgtagtagttgagacttaatagtaggagcatctctgaaggcgattactcagtgagcaggtaataatctgatggctgatgcaccgtcaggtgcagtagttgcagtactgttgagatggtgagagagactgcatggccattactgccagatttgtgagattaatggacagtagatgcgtgattgattacaagaattaaagcagaatacataaatgagtagtatgctgagatctggcgccttcaagtgcttgtcgttcttcacttgtactccatatacgatagtgaacttcaaaggcatactacacatgaaaaaggaacagcaacgagaaaagaagattggtcttgtttcagagaaaagaaaagaagattgggagacaattcttgatgtgacaaggtctcgttttgacagttaacgtactgttcttgtttttttatgactctggtcagcatcagtaaatcacacagagattaaaaggaatcaaacagctgggaggaaattaaaatgaccaaacttccaagtttctctttcttcagctctcagatttcttcagtgacacaacagaagctagaaaaaaaaaagctttaaaaaaaaggcatgtgtacacaaatctgcagaactagcagttgccatttccaacaaccaaaatctcagctagattattctgtacataggagtactgcagctctgctcgatcgatcatatcctcctcctcaccaactccgatccaactgaatcctgaacttttttagaattcagatccttggatatctcatctacacatctacgtagaacaaaaacaagatgcatccacgtgtaagtgtccttcttggccagccgtccgatcgccatgcatgacgatgtccacggatagatctcatctctctcatgcatgaagccttttttctgtgagatgtctactccatgcatgcatcggcgaaaattttttcttcagctcgacgcctttcgatttcgatatatatcatctcgcctcagatcctcgcattatccgcagcttcttgcaagaagagatgaacatgctgcaaaagcacaaaaagattcaaattagagacaaataaacacacaagattttccatggatggataattaacatgtgtgtgtatggtgcttactcccagggcacgtcgccggcgagcatgaggtcgccgtccttgtcctcataggcgacggcgaagtgggcggcggaggcggaggcgtcggcggaaaagcagccgaagagcgcgtcgagagcgtccctgagctccctgtagccgccgtacatccggaggtcgaccttgcggaggtatggcgccccgtccatgctcaccttcacgtacagccctcctcccttattcttcctcccttgatccgtctcgccgccgcccttccccttcgccgccgccgccgtcgacgacgacgaagactggaacgtgctcctcctgtacgaccccaccggcggccaccccaccacctgcactctgctcacccacacaagaaattgtaagattggctgcaaatcgagctggcacacatggcgagagagagagctagagctagaacttacttggacgccggcgaggcgccgtcttcgacgtcccgggcgccggcgccgccgcagcaggccgtgccggaggcctcgctcttcaccgtcgacgacgccgaccgccgcttcttcgccgccacgccgtcaccgccgccgctgccgggcagcccgaggcgcagctccgcgtcgatgctctccgcgccatggccatcgatcgagagagagagctagctcgtcggcgttcgtcgctgcgacactgacctcgtcgtctcgtgctgctttggttgcgcgtcgcgttatatagagcggttagttagttgttgcgtgcgtgccctagcatgtgagtatgccaggtgggcccgggagacagggaggacgcatggttgggtgggccccatcgggcagacaggtggggccagacgcgatgggctaggtcgggtacttactcgggtcgggtatagattccccgcggtgggcgggggcgctgttcgtgcacgtcgggggcagcgcatgtgggggtgacgggtggggcccacatgtcggtgtggggggggggcacgcgtgctggcgggggtgccacggtgtggggctcacacgtgtcgtcgcgacgcgggcagtctggttttggttgcatggggccacgtcacgcgctccggtgtgcatgcgtagctggaacggataggcacctgtcattgccctgcatacgtcatactcattctcgcatttctacgccggtttccaagacgataatacatccctactccctcaaaaacccaattctcccgataaatttggagatacataatgtttaaatcattattattagaactaagttgtagagagcagatattattttttttaaaaataaagtacaaacgtagacgctcacaacacgtgcacactcatccctataaatacatgcacgtacattctacctctacgagcatatctgtaagattggacagtatattttgagattgtgtcagcatagaatggggggacggccctaatgttgtgttggccgggttgcgagcggataaaagcggacgtggggactcgggtcggggcacagcgtaactaagataagagagccattccatttagggcgagacagaatgggcgggcacaagcggtctggtgtccgagccgattggtcagacggtgaagaagttatcacgaacaccttattgtcgagagttaattatctgaatattcttttgattatattattgggaattgatttttatagatggatatagtccgaagttagtttttttttttaaggatcgaggggattggtaaattttgtagcacctttttgccgagagagtttggtgtggttcaaatccagatgagtgagtttattaacccaaactttcatgtgaaccgtgtcggatcgtcaaaggtgatacgcgtacgtgtgcatgcaaatatgcaatgcaaagcatggtatccagctaagcgcaaaacggatccgggccagacatgcacacgcaacccaatcgcccacgaaacttttttgcatgcatatggcaaacggaaaatatggcattcatatgtcttaattatcactgaaaaggcaaaaaaaaaaagaagaaaaacacactccctcgcttcatattataaattatttatctttttctaatcaaactttttataaaaatatagtagtattttcaatacaaaacagacatattatcaaaatacatttaatgttagattaaataaaactaatttgatattttatatgtttctaattttatctataaatttgatgagagttaatagggaaaaaatcaaattatattaaaacggagggagtagctagtagacgaagctaggtgaggaggatggtcacgcagttatcgtgttgcacggttgccgtgacaagcaaccaacaaacccaaccaggtgatctgtctatcccagatcgtaaaccggagggggaggtgcgaaccaaacatgcttttggtgttgggttggtgtgtgtcccctctcgacagcgatcgagccgtgcgatcgagcacgcacgccaccgcccctccatcgcgtcctacgtctatctgtatctgtcacctctcgcatgcaccgtgtgctccatcgctgtcacgtcaccaacagctaagctgactccgatccatctcgttaatctcacgaactactcctactcttcttctttttctgatgaagacgacgatggaatggatgcatgttcaggagacggcattgccatatgtaaaccgtggaaccaggatttaagtatgactgtatgagagacctaagagtatggtggagtctagagagggctaaatatactatatttagattaattagataattatatgtgaaaaaaattgttggaagagggtcatagggtgctcgtatttacggctcattattctttcagtggtaggtggcgtatccgtcgacagtgagacgcctgtggtgacttcgtcaatctcaagacatgtcggcccagtcttccgaaggtgctcatatggataagtgtgctcacgttgtgagcagctacgtttgtactgtgttcctttaaaaaaatgtggtggtcgttcccgttgtcctgtctcagctgccaatggcggagccaccacccgactaccacatatatggctgtccagactcatcatcaaaagttccattaaattttagctgttgaaaagaactattatgcaatttctataaagaatactcgacagggtagagctactgtgtaattactcggggtttaatgagtaatgaccccggtgaagtttcctaaatcccatggtaaatcatgttagtcaccatatataaataagaacagagtgactccatggtgcaatatgagtgaccccgtgaattttctgtctggatagatccacccctgatactcgatattgttgagttttgtcggggtttaaacatcttttccttctctgctactagtctgagagaggcgggcgatcgagtgcgagatcgtcccgtgattctggggagtttcgcgcgagcgatatattgattgctagtagctacttgctgttgatttatagctaaaaatatttatatttaaggatgaagggagtaggtggttacattgctggcattgctgcgcgatacaataatggatcgatcgatcgagttgcgccaatgcaacttgcgattattcagacatgtacattcagtgcagtgtgcaagtggccggccgtgtgatcagctagcaatatgtactgtttcgtgtcacgatctctgatgatatgtgatgatcagctgccatgcatttgttgcaatgacgctgcaggctagatacgcgcgtagagtctctctctctctctctctctccctccctccctctcgtgatctcgtgtctgacgattagctctcgcagcttcacactgcatatgaatagctgaatatgtagcgcgtaatctggcgaaaaagttccagggggagaaacacagtacagtacttggagggtgcatgtcatctgatcagacgtgcatagttagtgatttgacctcatgcgtccttcttgaacaacgtgtatttggatctaagcaggggcggatatagaacaagatttaagagaggactcatcttcttctttcttcttcagtctttctactctttattttctccctgtttttctcctttcatcttcaattctatcaatggtaatccagcgaggtaaggaggactcgagtcccctcagcattcacgcttgattcgcccttggacctaagtatgctcatggtgatggctagctgctaatagcttaactaattaagctgctcaatgacgagaaatgaaccatcgtttaaacatcccccaactcttcttcaaatgagtaaaggtatccatgatggagagatcgatcagaccatacactgtagatgacgattttttgccgtgaaatttgggagatatttatggctacaaaacgagggaaggcgatggttcctcgaaatccagacatacagtcatcattcagcatgaccatacagtatacacactatacatgagaccggcaacccatccagggttccagcgaatgcggcatcgaggcatggatcgttggctgctaattggctgcatcccatgccgcccccgggtcccgcccctgccggtactttggttccatatttattagggtgcagctatacaacggaatcctgttttcaaaccgaatgatcccgagtagctatcaggtgtgatacctatcaagtattagacgattctacacacgtttcaggtgatacttacaaatatcatgtgatacttattaggtatcatgcgatttctatcacgtatcgtgtgatgctcgtgaggtatcatgtgaaacctgtcaggtatcagacgatttcaaccacatatcgcgtgatactcacgaggtatcatgcgatacctgtcatgtatcagacgatttctaccacgtatcgcatgatactcatgtgatacttgtcaggtatcagacgatttttaccatgtatcgtgtgatacttacgaggtatcggatgatacctaccaggtatcaagtgattcctactagatataactgagcatcctgttgggggaggagcaccctgacacgcgcggcggccccctgcagccgtcccttgtagacgaggacggcaatggccgcggcaggggacgggtgcggcgacggcggcggtagcgggggacgggcgcggcggcggcggtgggggatgggtgcggcgtcgtcgatgggggacgggtgtggcggcggcggcggcggaggcgacgggggacgggcgcggcagcggcgggggacggcgacggcggcgggtgagcaggcctggtgcatatatggataagaatcgcgttatgaaggaggagctatcccgttgggggacggtatcgcatcccctagcattcccgtatttcttaacgtgttgagtaaagttagaattaaacttttacaactttaatgatatttagcttaaagttattacaacaatatatataaatttgtcttataaatactatatataaaaataaaagtttatctatttattgtatatattaaaatagaaaaatatagtcaaatatatatttcggatatcgtgctattatccaaaatataaaaaaattatgatatcagaggcagagaaagatatttttacccggcttctacatccaaccagatatatgcaaccttttaaatcaggaacttagccccttaaacaatccaatctgtaaattcgcttatatgaagagttgaactcgtaaccttgatgtgctattcaaatcatcgcacctactacatgctctttcgcatccatgatccacgataggtcgatccgatcagacactgtagatgacgatttttcgccgtgaaattggaagaaattcctggctacaaaacgagggaaggcgatggttcctcgaaattcaggcatacagtcatcatccagcagaccatactgtatacacactgtacatcaaaaccggcaacccatccaggccaggtcccagcaaatgcggcattcgggcatggatccaggcgcgcctgcttggctgcatcccatgccgtccctgccggtcgacgtgtacatacgcgcgtagtggtaattacagaaaatctatcgtacggtgtcccgtggtggctgtgcgggcggtcacgggataaattaaacgactggataacgttttacttcttatccattccttttctcttctctatccaaagctttggtcaacgccttcgtgtttgggcaggccaacacccgccattccagccgtgcatcgctacaagagaagctcaagagagaagttcccggcggcaagatggctgactgctgcgtgttcctccgatggccattgaccttgccctccctcctcggttaccgctccctcgacaacagcaaggtggccggcttgtcgtctccagcagtgacggtcgtcgttgagaaagagtggtaggtgttctccgtcgaccagctcatgctcgacagctacccatcccggctgctcctcgagaagcggtgaggaaggaggagagcaaggcgacgctcttcgtcgatgtcgccatccttttcttgtcagtgttatgtgcaaagtacgtcacgactgatacctaggtatcaagtttggtaccaagtaccaggggtcttggggtctgtacggcgtacaccatcacgcgcctgtacagcgtcttggggtggatgaggcctagccacggtggcaagaggaggtggtcgcgcgagcggaatggggagcgccatgctgcgggcggtgctggtgttcgtgttctctgccgccatgctgatacagctgataccagtatggtaccaactgcatggtacatagtacctgtgacacctggtacccaatacttgtgatacctagtacctgatacctgatacctgtggcacctggtactcaatacttgtgatacttggcatctagtacttgtgatacctagtacctgatacctgtgacacttggtacccgatacttgtgatacctggcacctagtacctgtgatacctagtacccggtacctgatatatggtacctacagcatggtgtacgctaatcaatcacacattaaaattgtcccgtgactttagtttttcacggtatcccgtgggctagcagccctcggtaattgcggcattgcgcgcgtatgttcgcgaggcgttgcatactaaattttggcaatttaacagtattgtcaagttttggcatgatttcttatatatttatcagagtttggtaaaagaactaaatagatacatatatttgaaattaatggcaccaatctaaacaaccactaaaaatacaataaaattgtaaagatatgtaatgtttgcatgatatttaaaatactctagataataattattagtaggtgatgatgtaaaatactctagataacgactgtttgtggatgatgatatgacacactttatggtaagctttaggagttactccctccatacttaaaaaaacctagttggtgatttgacaccacctaggacaataaatttgaacaacctcatgtccaaatttattgttattgttggtgtcaaatcgtcaccatgtatttttttttttgagacagtggaagtagttagtaggataagatatgagtttacttgctttgtatataagtacgttaactaaaaccactattaatatcatgttcaactggtgactttgaaaagcttggagtcttcttcttgtgcttcatctcttctaccttagctacctattcaccatccataaccattgcaccagaagcatcaagcgcgaaatatccataatgttctccaccatctattgacttggttttctagtagcgagaaacacccagtggtcttttggctagtttcacagggtggtgagctagccggcctggattttaaacctcactttttctatttatttgatattaggtctttctctattgtttgttttttaagtagtacctccttgattggatggcttacatttgtttttcttattttgtccttttctcaatctgatggtttatattttgttccctacgtagaccaatgaggtgttttaaaatcatttggctttcactattttagatttggaccgacatatatagtaccaccttcaaatcaaaataagtgtccttatttagtttaaatttaaattaaagaagtgcacttattttaagatagaaagagtaatatgttgacgtcaaaattcctagtgccaacctccaggagctatggttgctagctttagctgccatggttggcaagaggttgatgccaaatcttgttagcgtcagtacattgttagatttttatccagattcgtggtactaaaatatatcacacttacttaaaatacattatattttttaacggtgagtagtatataatagtttcgcttgcaacaggttacataagccataacacttagtgatttaaaaataatttataagtattttttatatatatttgtgtttttagtgatttaaaagcaaacgctgaaaaatagagtaagataaaaacccaaattaactttaaaaattatgctttaaacttaagttttaaatttaaattagctgataagtaaagaggaaagattgaggctgtatacgtcggcgccggtgatgtccagtgtagcgtccgaaaacccaacaggcctgccatcttgtttgcatatcacaccaacaaacgagccagcttgtttgcagtcagattatttttggtgttaatgtaacaagccaagccaatggaggtgggcagaaaaaaaccgaaccgaaagaccgaaccgaaaagaccgagatcgagaaatttaaacaaccgannnnnnnnnnnnnnnnnnnnnnnnnnnnnnnnnnnnntcagtcatcaattcggtcctaggtagtgaaagaccgaattttgttcggtcaattcggttagtctcctcaggtaaccgaatagactgaaaagaccgaattatcaaaaaatgtctaaatacaacctacaatccactatgtttaataggattaaactctaattttcacatccctacttcttctaggcatgcaacataataaaagtctttactcataagtgcttacgaattttttttgtgatttttgtgttgaaaattttcattatttctttgcatatatggaaatgttgttgaatttcggtcaggaccaggaccgagaccgagaccgagaccgagaccgaatttgtcggtcctgatattttttcactgaaattcggtcttcacttttcaaagaccgaaaagaccaaaagaccgaagaccgagaccgaaattttcggttagaccgaatgcgcaccctattcatctatctataggctttggcagcaaagctctcgaggtaccagcagggtcggaatttcggtccctatgatactattacttcgactgaaatttttcaactttttaatttttttcatgaattctgataatatttgcttaaattcaactaaattctgtttaaaatatcggaccaaaattttcgaaatttcggcatttcggtgagacccgatcaaattggccaccctgggtaccactcgacaacgtcgaggccgcagagatacgtccatctggaaagtcagcgccgagccgccggcaccggcgaactccttccgggccgccctgatcgcctccctcatcgcgcagtgcaccgacgacgccagcagcggcggcggctcaccggacgctgcatgccatgatggaccgcaaaacagtttcagatttcgagttcctttacgatttcaatgctcatgcgtttgagaacaaaaggatatgatatttcgagttcctttacgatttcagtgttcatgcgtttgaggaaaaaaaaaaggatcgaaggaagaagacgatgatttcacctttggaagataggacgcgcttgtgatcgcgggcgctgttgatgagctcgacgttgaactgcttgaggatggtgtccacgccacgtgccgtcgtggatgaccagcccatcggagttggtcgcgtactcatcattcgtgaagaagccgatcccttgcacgaacgcgccttaattccacctaaccaagatcaacaacattcagtttacatgtttagtatttacatctcattcttgcaatgatatgcaacattggggaaaatccccctttttttgtatgttattcaaattatcataaaaattaaaattaattaacataatatatcaatacgaggaatgtcattttctacaaaacatgcaggctcaaaatagacttacacaaataaaaaataaaaataacaaattttattgcagatattacataatattcacgttaaattttttatttttgtttctatttgtattggttgaatttgaacgtgcatgtttgtaaagtaatatatcacatattgttctatcttgtcaacttttttgagaaaatatgatggtttttttagcgacatgcataaagtgataaaacgatggaacgtcccctcgaataatgttgaaggtaattagtagattgactgactgacctggcccaagtccacggcaggattgaagctctgcccacagtcatacactagaaaagaaatgcagctttgccgcataatggcctagccaataggaattaaatatcaatggaacagcctgcacaacaatttaatggtcaattatatagagttttgtgctttaatttattaggccatccccaacccagaaactatctagtagtttccatatttgtcatgtcatatagacactatgtgtagaaactatgtattcaatggatggtgtcttcaaattaaattatcatccaatcacctctcttctctctccttttatccacctatccccttaattttattcttggttcttgtgtagaaatggtttcttgcatgagaaatgatttcttcatctttttacctctctcatcattaattctcttgccacataggatttttgcttatgtgtcaatgtatttaatgctatgaaaactagatgacatggagggttggggatggccttagtatccagatcaattccttctcaacctttctcattcgttctgatcaaccatcacccgcattgctatcagcttctacttccttccttacgcctgtcctctccggctttcattcgatgccatcggccgcctcacccaataccaggccctcctcctcgaggcagtattgctatcacagaaaaagaagctcgagtcatcattaccccctcctagtttaaatatgatggttgttttagctctatcaccaatagctatttttctagctcaactggcgaaaagtcaagaaaatgatgccctttatgctattaaataagcgattgccaacttaaataagagaaaacttgatgcccacatagatcactccacaggaacattagatttctagaagggttataatatgatatcgggatgtcgatttctatttctataattaagttgattttcatcgttgcaaatgatgtatattttatctcagttgattgtagtgtatctctataaatacgcaacccacccaacataacataattattggtgattagaaaatgcatttgtatatttataagtaataattttatgtattatttattaatggtacttaacttccttaaatttgcttttttgttttgatttttttctttatactatttcccccctacgtcttccctcctgcctgtttaccaataaataattcttctatgttaatttactttggtaaaaaaaagagagtaaaattaactataggaagttgtgcatttaaaattatgaatcatactattcatctagaaatttaaattgttccatgaaaatagaagtttacattagaccatatagctagaaggactagtattaatattggtaaaattaggagctcacactaacagcaaactactcacatgaaaattgcctaacgctccacaaaaaggaaatactggtactacaattttatagaacatgattatatatagatcacatgatagttcattgatatatgcctctcgatctacagaaattggcagccaactttattttatttctgtgtttaaaacatttttagtaagtccaatataatattgcatttatgcatataaatttcctttagttcagagaactatattgatggaggggagtttaggcatcaggccaatctaagctcttgtttgctcaaactaataatctaaagaatccatacttagttgttatgaatatttgtatttgacaactcacatgcctttttagagtaaacaaaatagagaattgaaaatggaacagttctcactagctattacctgagaaaggaacagaaacgtgaacttacttgctttgcccttctagaagttcaggacttgacggcaacaattgtgggcacgaacgccggcgtggcgacactatggtggaaggcgtgaactgctggtggagttgatgacgatggatcttagcaacggtggtggaagcggacggcagtggcaagggatttgggcgagtgatagcgccgatggtggaagtggatggtgatggcggatggatttgggtgagaaatcgatagcgcttgtgctggtgatagatctaaccgagcgatggagcaatggagagatcgatagctagctggattgattgttatgtgtagagtaggaatagtaaccttctccttcttttactgccctatgcatggaggggaatgggatagtaaatagtcaccttccgagtatacaaagattacctcttcatcttctttaggtaacttctttacttttctaaagaattcatggaccaactaatttatttatttatttttcttcctagagcattcatagatatagtacattggagcatctcctcggagtggacacatggcagatattgggaggggacttttgctgatttctatggcgccacgtcgcccaataagatgcaagatcttggactctgcattaggtctttaagatgagcctgctttaggtctttaagatgaggtcgctccttaggatggtggttgctcctgtcagcatatccacttccacctacaatgttcatatgtaaattttaggtcaagctctgagatttggtttggcaaatgcattttcagagcttctgttgtagtactaatatggatcagggtatttgtagtgcgtacctcactaaccgcaggtccatagttcaagtagctagggaacgtcgggtcaggggtccagtacgtatgctccgtcagcttcacactcgccatgcttgcctgaaagcggggtggagcaaattaaatcaattcccattacaaattacaaatttacaatgcatccagaagatgatcattcagaaaataagatcagcctactgatgcttgcagttgaaaaaaaaaagattcgttttgaaacggaggagcagaactccccagttccatcaatggaaacgcagcagattgatcacatagaaagaaggaaattatagccacgaagatgtcacaggaattggatttcttttttttaaaaaggacatttacaaggcttaatactcacctgggcaatcaaggatttccatggtagggtaccagccttctccttgatggatcatgctcagtgtgtcagcctggatgaggatgacatggaccttgtcgagatcatcgcacaactggcccagcgcgaacgcggtcatctgcttcacctttgtccatagcccctgaccgatctcgaagccgccggcgatggagccatcgttcatgatggacaccttccccagagtcgtccggagcctcacgtcgtaggtgatcggcacgcaagaaatgccccgcgcgcttcttccaagctgcagcagtagcagcaagggagagagatggagcagattaactcaccggctggcaacgccaactaggacggcgccgttgtcgctgaccaactccactggctgcgcgtaggggagtgcgtcccctctctttttgacggccgccaccgcctgatctggtgctagcaagtggtgaggccgccggatctggcgaaaaggccctcgccagcctccttcaagagtaggccacgccaccccactgcgaggggagggggataccggcgccagttccgacgctgctgaggggaggacgaag

SEQ ID NO: 59268 - DNA, 12803 bp, Oryza sativa
ctaatcccgccggcgccattgatggagcccgagagcgccgcgccggttttcttcccctccggccgccctctcccccttccaacccaatataaaccctccccgcacctcctccgttcgtttccgcctctcgccgcccttcctcctcgccggaatcgagctcgcgccgtcgctctctctctccgccgtcgccgccgagctccagtccgccgccatcgtcgccccggaccacctcccacctcggcgccgcctccttcggcttcgccgcatcctcgccgacctcgtccacccctccgtttcgctcgtcgaccgtcggagcgccgccgtccccgtctacccgagccgcgccgccgccttcctccgctccggccgccttttcgtcgtcgccgtcgacctagggtgagccgtggaccgccgcctcgtttccccctttccctcccttctctcggccgccgctccgccgtgcctatggccgccgccggcgaccataggggcgcgggcgcgccgcctcccgccggccgcgccgccgtggccgccttcgggcgcaccgagcggctgccgcgtggggcccggccgtcagccgccggcgccctcgggtgcggctgacgcgtggggcccacggcgccggccggtgtgagcccgggtgcacccggttcaccgtggaccgtgaggctgccgtgtgggccccactcccgtggacccggtccgcgcgccccctcccctcggctgacgcaataaacttttgtttaaattaaaatttaaatgaagaaattcgcaaatattcacttaaagagcatataaacttcaaatagccataacttggccatttgaactcggaattggaccgttcaagtctctaattttttcttaagaagtcaagaacccatttttgtgctttgttcctgcttgttatatggagtttattagagtaaaagccttttcttttccgttggtcgtgtagacgctgcagcttcggaagatccgctcttcgtgaaagttgaagccgacggttgggaaagcgagcaaggcaagtcacatcatccttgaacatattgaatcccagtttataaaattatgttgatttaaattattgcattatcgctttgttcaccctagaataaacaaaaccccaactagtggacactctactaatggtaccactagtataattttagatagatgcttcgccgcttaattaggcaacattaggtggttttacaactctagactttgggatattcatatcacctggacactatggaatggttggattattgtgtaattggattcacacctccccatctattcaaaatcctcaaaatggttttaggctggtctcggggtgcatggttttgatagtagcacctcggccataaaggaccggtcttcgggcctctgttgcaaagcactaccgtagttccacatgtctagtgggtaaggcttagtttgtggctcagtctggttataaacaaaagtacacggatggagatggacgaagtcgggggtcgatggacatctctaggataaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtctgtataccgtggtggtatgcggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaaccttcttaacaactaaaatgtggaatggttgccctaggttggcttggaacgagctgggacccagggtcgggttgtcagttcggtctgaatcatcgtaggccttgggttaaggcaggttcgtgtgggttcacggccttgattaataatattgtatagctctggaatcgtgtttacaaaatagctttgagcaactaagtgtcttttaatgctgtttactgcaaaccctaaccctttatattataacccccttgtactcccttgcatttatcctgcacttgtgggtgtgtcttgttgagtacggtggttctactcagtcttgctcaatttttcccaaacccagaaaaggagcccctggaagatgaaggctttggtgtctagctcgtgcctgccatcaagcgcctgtggtcgtcgccctagtcttccgctgtttctcatttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacatccgctcggctatctaatccgctaggtctatacccattcaagaagtacggttgtacgggggtcgtttcatgcttaacttcatggctcggtccttaattgaccggggacggtactagccttttccatatatcaccaaaatcctccgtccgccccagtcgaaaacagttgtttagttttatttcttctttcacaaatcatgtcatcaatatcatggcaatgtggcgctcatgtcttcacatgccgcatctcaattaccttcccaaaggtaattacccaagcatatatcatttgataaatatgagtgtgcatgattctagaatagcatttctaagcaattgtcataattgactagggactcatacgtaatcatagttacaaagatttaaggataaacaataatcaaggcatggcataatcacaagtgggatgtttatcattgcatgtaattttatttgtaaacaaaatagtttcgcaattgggatcaatatgttcaaggaatagtgatgacttgccttgctcaaagtcttgcgggtcttgaccttcgcttggatccgcaactccctcgggctctatagttacgtgcgaaaatctatttgaattcagttataattcaaataaaaatccaagtaaatccaaatggaagtcgaatgcgaaagtcgattcttttatattaactttactattcgcgaactagggcaaacccaatttcgatttatacatcctaaactattttgcgggtataaatattttgttatcataagtttttaatctaatctacccaagcattatatccatataataggttagaaatttctatcgtgagctaaatatcggacgaaatcctaaaattatcttataatattatacgatttaatttagtctatgactaaacgattaaatataatatacgtctaaaattcctagtaattaaatccgagtatctaccgggaattgatcacctatagagattaccaaaacaatctataattatattaaattttgcaattctacgactataattgatctataattaaattctaattattttaaattttctaacttccctaatctccctctaatttctatttatttttccttttctttttctctcctcttttctttcttttctttttcctccctccatttctttcttttctcttccttctccctcccggcttctcccttcctctctctctcggctcaggctacccggggcggcgacggcggcggaacgagggaaggggcgacggcttaccgacggtggcggtggcgacggcggcgcaaggcgaggcgacgctcggcgcggcacacggcgcggcgcggcggcaccgagggcggcagcgcggcggcacgaggacggcggcgcagtggcacgaaagcggcggcgcggtggagagggaagaggggaggaggagggaaatggagtgggggaaaatggagagggggtggggtatttatagggaagagggggagaaggagaggggaaggggcggcggcttaatggcgacgtgacggcggcgcacggggctcgggacgacggcgacgcgcgggcggcgacgcgatggcggcgcggggctcggagcggcgatgcgacgggcagcggtgtggggctcaagacgggcgacgcgacgggtggcgtggggctcgacgtggcgacgacgacggcgcggggcgtcggcgacggtgagggcgcgcggcgatgggacggcgatgcggcggcgacgggcgacgcgacggcgacggcggagcggggctcgagacgacggcgacgcgcgcggcgcggcagcgggaccggtgacgcgacgcggcagcggcggcacggaagcggcgacgcgacgggcgagcggcacggcggggcgcggggcgcgaggcggctaggggacgggcgagcggcgtgtgggcgcggggcgtgagacggcgaggggacggtgtgcggcgacgggacgacagaggggaggcggagcggcgagcgacgcgcggggcccgaggcagcgcgacagaggaggggctagggaacgcgatcgaacacctagggagcaatgaacagtgtattttcctatttttcccattttagtctatttcttatataaatttgattccacaattcctaatttttgcatatttgaatattactcaatatttgtgttatcttaactaatgaattcaccctaaatcaatattactcatattttatttatataatttatttgaatttttaattagggttaattcttattctgtcgcatttaaatttaattgacactattatggtcgcgataatattttatttatttctatccttacataatctttattttaaattataatttatttatttctttaaccaacctaattttagggttaattcctaattaatttttcctctatttgtgatcgatgaactccgagatcataatccaataaaatcatcgaacaaaatcggcatgatgcaatttatttaaaaagttttcgcaggtccatatttttagagttttgtttttattggtcaaattttcagggtgttacaataagtcaggtcctcctgaatgtcaatgtgctccgaatcggcttgttctttgggtaccctcaagcacttctttaactgggacacatggaacacgtcatggataccagccatgttggatggaagttctagctgatatgcaacttatcctcttcgttccaagattttgtatggtcctacaaagcgtggtgccaacttgccttttatctggaagcggtgtactccgaggagcggagtgacacggaggtacacaaaatcccctgcttcaaaagtgagctcccttcggtggttgtctgcgtagcttttctgtcgagactgtgcaattctcagcctctctctgacggtcctgactttttcctctgcttctattagcacttctgttccgaacagctgacgttcgcctatttgatcccagaagagaggtgtccggcacttccgaccatacaatgcttcgaacggtgccatttgtaaactggcctgatagctgttgttgtaagagaattcagcataaggcagacttttatccaaagctccaccaaaatcgagcgcacaagctcgcagcatatcctccaagatctgattgaccctctcggtctggccatctgtatgcggatggtaggctgtgctgaaattcaaacgggtccccaattcttcctgcagcttctgccaaaattttgaggtgaactaactccctcgatcagatacaatcttcttgggtaccccatgcagacacatgatccttgctaagtacagctctgccaatttctttcccgtctatgtggtatgcactggaatgaaatcggcaactttagtgagtcgatccacgactacccagattgaatcgtggccagatgatgtctgttaacgaccaaatttggtaacctcaatatcggagatgaagattagatcgaagtggaatccaaaaccaagattgtttcggagacagagtaagaatcggctggagttcagatcggctacgtcaaaacacggccgagttcaacttagactgggttaagtgattgtcacgtcctgataaattcatcccaaaataaaaatcattttctaaaaggaataatagaattaattaaaattcgaaaagaaattggcaaacactaaaatacgtacaagaaaaattcgaatgtggtccggagaatttttgttaaattctccttggtctaaaaggagccctcaaattttacttgaattttcatagcaccggaaatatttattaaacaacaacaacaataaacaaagttgaaaaggttttataaaaagaaaaaccctaaaaatcccccttccctctcttgggccgaatccggcccatctccctccccttctctcctctcccctgcggcccatctggcctctccccgcgcgcgcgccgctgacgggcgggcccgcccgccaccctcgctgacgggacgggtttcatccccttcctcccgccgcttccgccgctccgcctgcgccaagcgccgccgccgaatccgccgcatcctgtcctccccgcgtgcaatcaatagggggaaattattccccgtgattccctccccctttccccctaattttccctccctctctcccttggattcgtttggaaaccctcccctaatcccgccggcgccattgatggagcccgagagcgccgcgccggtttccttcccctccggccgccctctcccccttccaaccctatataaaccctccccgtgcctccctcgcccgtttccgcccttaccgcaccgtctccccgccggaatcgagctcgcgccgtcgccctctctctcctctgtcgctgacgacctccggccggtcttctctgctcgccgggaccgtctcccgccccggcgtcgcctcctccggcttcgccgcaccgccgtcgaccccgtccaccccctcgccgagcccgcggaccgccggaacgccgtcgaccccgtcgacccgagccgcgccgccgccttcctccgctccggccgcctttttcgtcgtcgccgtcgacctagggtgagccaaggatcgccgcctcttttcccccttcccttcccctctctcggccgccgctccgccgtgcctatggccgccgccggcgaccataggggcgcgggcgccgcctctcgtcggccgcgccgagtggccgccgcgtggggcccggccatcagccgcccgcgccctcgagtgcggctgacgcgtggggcccacggcgcaggccggtgcgagcccgggtgcgcccggtccaccgtggaccgtgaggctgccgtgtgggccccactcctgtggacccggttcgcgcgccccctcccctcggctgacgcaataaaccctttttaaattaaaatttaaataaagaaattcacaaatattcatttaaagagcatataaacttcaaatggccataacttggccatttgaactcagaattggaccgttcaagtctctaatttttccttaagaagtcaagaacccatttttatactttgttcctgcttgtgatatggagtttattagagtaaaagcccttttattttccattggtcgtgtagacgttgcagcttcggaagatccgctcttcgtggaggttgaagccgacgtttgggaaagtgagcaaggcaagtcacatcattcttgagcatattgaatcccagtttataaaatttttttgatttaaattaatgcattatcgctttatttaaattcctgcgttatcactgttttatttagccatgcctatttacctttgttatgaccttattattattgctaatgttattattaccttgttcaccctaggataatcaaaaccccaactagtgggtactctattcatggttccactagtatgaatttaggtagatgcttcgctgattaattaggcaacattaggtggttttataactttagactttgggaattctcatatcatttggacactatggaatagttggcttacgttggaattggacacacacctccccctctattcaaaaccaccaaaatggttttaggctgggctcgaggtgcgtggttgggttttgttagtcgtacctcgggtactataaggattaagctcgggcctctgttgcaaagcagtaccgtacttccacatgtctagtgggtaaggcttagtttgtggctcagtctggttataaacaaaagtacacggatggagatcgacgaagtcgggggtcgatggacatctctaggacaaatgaaggctacacgagctgcggcccggtagtcgagatgtcatggcacagggctggtgtcctgctgctacgggctcaatcctgcctgcctgtcccggaggttccggccgtaggtggggttgggtcggtactcttgtttatggctaggatgggttgggaactatgtcacttcttccgtccgtataccgtggtggtatgtggcacgtggttacacgtgaggaagatgtgtcttgtgggtaaagatgtacacctctgatcagagtataacctattcgaatagccgcgccctcggttatgggcaagcctagcaatgtacccaagttagtaatttaattcttaaaattggctcaacaactaaaatgtggaatggttggcctgggttagcttgggacgagctgggacccagggtcgggttgccagttcggtctgaatcatcgtaggccttgggttaaggcaggttcgtgagggttcacggccttgattaataacactatgtgtaacatcctgaaaattcaatacaataaaaatcactaaaattttgaactttttaaaacttttgcatcatgctggttgttatgattgctattgcttgccaaaccataaatgatcacaaagaaagtaaagtaaggatcgatatttaaacaatagatataatttatgagaatatatttaatcctacaaataattatgcacaagatagtaaagtcaaatattaatttctattacaaattacaaatcaggtattagatattcgaaccatgattgatagcttgatgtcacaattagctaaagaaatagtaagattaaatctaattcatttgaatcgaatctcacatgaaatataagaacacatgaaatgatgatcaccactatagtgatcgtgtttataaataagtaattcaccggaatatatagattgatacttgcaacatgtcgccgagttacccatgacagaaaaatcactcatataaaataatggtcatataaataaattaatccttatatataaacaagaatatgtgagtgtttaaaattagattaatgttgtaccgagtcttaatatactatttatagaataaatagattcaacctatccgtgtaaaatatattgctataagttcattcaatgtgctattgtaataataagggccacactaggatattttagaaccctcaaagcctccaaaattatctaggctaattttagaattagacctcatttaaataatacaatagaaaaatatatataagaataaaatatgggtaatattaaaatttggtaaactttcatctaaattaaaacatatattgggtaaacctcatttatgtaaaatttggatttatagaatgaaatttatacaagggataaactaaaatcgggttaaatagaaaatggcactgttcattgcgcctaaggtgttcgatgtggtccctagccttccccctcctctcccacctcttcccctagccgccccgagcccgtccatcgcgtcgccgctgccgcgccgcgtcgccgttgcgtcgccgtcatcacgtgccgccgcaccgccgtcgccgtcgcgccatcgccgtcgcgtcttgtcgccgccgccgcaccgcgcgtcaccattgccgctgccgcgccgcgccgccgtcgcgtcgcctcgcgcctcgcgcccgcacgccgctcgcccgtcccgtcaactgcgacgcgagcctgccgtctcgcgccccgcgccgctgctgtgcgccgtcgccgtcgcatcccgtccccgctgccgcgccgcgcgctgtcgccgtcgcgtagccatcgcagcgcgccgcgagccgtcgccctcgcgctgccgcgccttcgaagccccgagccccgtgctgccgcgcgccgtcccatcgccgtcgcatcaccgcccacatcaccgtcgccgtcgtcggtcgcatcgtctcgagcccctcccctccgcgcgcgctgtcgccgtcgctcccgcgttgcgccccgtgccgcgtcgcctcgcgccccgcgcccacgcgccgctcgtccgtggctccgccgcctcgcgccccgcgccgcgtaatcatcgcatcgccgacgtgccgccatcgccgcgcgccaagccccgtgccgcgccgcgccgtcccatcgccgcgtcgccgtcccgtcgacgctccgccgtcgccgtcgcatcgcccgtcgccatcaccgcccgccgagccccgagccgtcccgagccgcgcgcccgccacctcgcgccccacgctccgcgcgccgtcgcatcgccattaagccgccgccccttcccctctccttctccctctcttccctataaataccccaccccctccccacttttccccactgcatttccctcctcctcccctcttccctctccaccgcgccgccgctctcgtgccactgcgccgccgccctcgtgccgccgcgctgccgccctggtgccgccgcgctgccgccctcggtgccgccgcaccgcgccgtgtgtcgtgccgagcgtcgccttgccttgcgccgccgccgccgtcggtaagccgccgccccttccctcgttccgccgccgtcgccgcccggggtagcttgagtcgagagagagaggaagggagaagccgggagggagaaggaaaaaaagaaaagaaagaaaggtgaaagaaaaagagaaggaaaaggaagaaaagaaaagagaaaagaaaaaaaagaagagagggtagagtgggccccacctgtcagtcactatagcttgtggataaggttgtagtataaataaatgaattaggaacagtagccttttacaatttttcggatttattccaatttgaatccataaactagcgtaacttattcgttttaactccgattcgagtgaaacttgaacctaaattcatctaaattcataagcttaccaatggtatacaattaactatttaataaaatatatttataattataaattaattaatatcaaatgattagataatagttaacctaaatagtgtgccaataaataaaaatggatattgtacagtagaataattatccttaatatgttttgtcactgtagcaaccacataaattaagtataatcaatgtttgaaattaatggatatataggaaaatattagtgccatttattaatctatgtccaaatataattaaaacccacgacttattagttatttaaatagagttagccttataattattaggtaagtaaaatatagatacacatagatcggtcctaagcttgtttatggcaaataataacagagctagtgtgattaaatcacctatatgaaattaatcaacgacatatcccatataatagcatatattaggagaggtgagcaacccttagttaaccaagcagtaaatagaaactattcaaataaatgattcaatatattaagatattgtgcacacgtatattgtacatcccattatagatatatggtatcgtattaatttgcttgttgcatatattaatttagagggagtataagacaaacatgaatattagataaatactagctatacatcttgtcctcgtataattacagatcaactgtaaatttggattattcattgtaaaattatgtgatgggataatccgtaaccataatatgattaacctaaacaattctaacatacaaagcaggggtaattgttaaccttttataatttattttgacaagtgaaatatgtacataattaaaataaagcctccattaataaaataataatacaaatgattcacagtaattatttgaccgatccaaaatccatccggcaacagaacctctagtgtataaccgtgctatgtagataaatgcatgcctagccataatccttccatagccatttgatagactaaaccaccgattagccaaatatatatgtatcctataaatgctatgttggttaactcctaaataggccacgttgacaatagaaagattaagaaaccttagcccctagcgagattggaatccattagcagacatgaatagtatattttgttgtgcatatttggttgttatttgaatattggtttttcttgcgtattatagaatttatgtatcggttagtcgtgaggcaacgtcagcaacttccaggaggtgaaggttgatcaagaattatatcaagaataaggactatcctgagcaaggcaagtcatcactattcgttgaacatgttgatcctaattgcgaaattgttttgtttacaaataaaattgcatgcaatgatgaacatcctacttgtgattatgccatgccttgattattgtttacccttaaaatccttgtacccatgattacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccg

SEQ ID NO: 59269 - DNA, 2430 bp, Oryza sativa
gtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgaattttatgctgatggagccacttcctgagaggagggaaggtggacgtcctcagaaaaccatgatgactcaacggcgggaagctatccttgggattacaatggatggtggacagaaccgtcgttgtttaaatgtgaacactggtattaaaacttgatcagtctatgctaggtcttaggcttgtgaaaagaattgcaaaactagctttatgcaaaagaacctgaagccattccttgaaataccttctatcatacgcattgttgttgtggtggcttgctgagtacggttggtactcacccttgctatttatatatcttttaggagagtgttgaagagaagcccttgtcggtacgcctgcgtatccaacaagatgatcggagtgcaatttcgttctaggtctcgttccccagtcgactgcctgtggcatgttaaccgggcccttatattattttgtcttccgctgttgttctctgatagttgttggcctacctggccctaatgtaagtatttaactcttttagcccgaattcattcgtgatatgttgtgatacaactatgtatgtgtgtaccaactactgatccagggattggtacagataaacacagaagatttccgatttccaaaatcgggggtcgacactatgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcatttttgctcaatcttttccccccttcagtaagagaagctttggagaagaagtcttaggtggagtcctagcttataccccagttgagcgcctgtgaagatggagccgtaggcccgctaatccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacagtaatacagccgattctaacaatgcgacttggtgtatgacatcgggttgagttgatatgcttcaagatgattgccacgcatggatagagtcctgagaaggcaattgtatctattaattaggatattttaagtaatttgcttagagatatgtttgggcaaaagtctgccgtaaagacttatggtatcttagagtttgttagagataagagtcgtgtccaatatggacattgtttgtaatttttgggtataaatagaccccgaaccccatgtaataaaacaacacatgttcaatacaatttcggcgcatcgccaccctttttgctttagttttatttcgaagagttcttgctttcgggttgagctgtatcagtttcgatcttcaacaagaggtaaaacttgttatggcggcttgcgctctcgggattagtgcttctatctttatgacactctaatcttgtttatgtaattcgtcgagttatcttatatcttacataatctccggcaatatcggtatcaaacctacaattggctaacatctgtcaatagaaggcagccgattagcctaaataccagtgttgacttagatcatatatgatatctaccactctatgacacatccaacggcttgattgtctagatattgtccttcttttcatacttatagctgcatcagttgagtttgatcttatgcatcgtgattagaatctcaatctctagcctgtctttggttgccgattagggtagtatcggggtttcagccgatcttatctgatttagctatatttgtcctatatgcctcattgacatgttaaatccgccctttatgtcgagatcttattgcatttaagtatattaggcttttgtttagtatattctacttgccttaatatcttaatatagagtgatatcggagtattagccgatacgtgctagatc

SEQ ID NO: 59270 - DNA, 18673 bp, Oryza sativa
aatgcttgggatctccgtgttgacttcgatgtcgatatgaggtaagggcagcaagaagccaagggagtatgatgtcgataggatgtgggcttgaaagaatcatgcaactacaattctcttcctattgttttagtttcttttacccctcagttccttgcgtctgctcttctgcaaggcatcccaggcgattcttttctccttttcaatttttctaaaggcatgcgtgcccatcgtttccattctatgacaggggtaaagaacgaggaccactgttttcttttctaaattaggaccacagttgcttaatcaactacggagtaatacgagtgtttgctttttctcatataggaaaaacatttatgtgaagtcgtgttcgtcgtccagccgcacaaacgtcgtccacaattctcacgcatctggacgaggctactgatgcagaatgtttgctggtacgaatgtttggtcccttcataaaaatctgaaagctgttaaacaagaactagtgctgcttgtagcataatacagtatcatttggattccgatgttatcaatcagctgacgagccgtgcgtatggagatggaataataatcggacgcgcacgctgcacgaatcgattcgattcgacccatctcttgtggatctgtgtcttggccgtctcttcttcctcccaccagcctcctcccctgggtctgcctgcagagtgcagacaaaaccctcccatctccagtggatcctcttctcgtctctcgaccccacaccctccactggaggcctccaattattggccaacgcacgaaaaaaaacgtgaatactaaaaaaaatgatcggatgggacgtttactataaatctggatatggacatgtagtactaggaaacgtcacatccggttatatgttgttatattctgagatggagggagtaattagaaggggtaagacttcgaatatagaccggctaacctaccaccttttcacaaggctatccggaagactcttgagtgtttctcgccaacgcacgtctctatcgcatgagtttctccccattctaatacggataatttcaaatttctattccatcacttccgtcttagtgtccggatttctcattgcctaacgcctctgctgcatcttgtgctgccgcctgcgtcaggtactacgaactactcaccacggcatagattaaaggagatagagagggacagaacaaaataatggtttggtgagatgatagtattaatcagtatataaaccagcttatgacattcctgcgcgtggagaacgtgtgattacgaactcttgtcgtcaaagacccactccacaggaccacagccttgtctgtgtattttttttttagaatgaagaaaaaatgaattttagaatgaagccttgtctgtgtattggaaaagaataaagatatttttatttgcctcgtattctcgtgtaatggcatactacacctactctatacaattaaatggtactgtgttaaggaatgaggtaaacatggcatgctgattgagtttatgttcaggtaagctatgagaaaatgactcactgatttgtttagatgatcgattaattgcattacttgtttatttagtttatttaggctgagttcttttctgcatctccaaataacaacttcatttccgttatcatactttacgaactactacacaatatatttcgtgcaacaaatttctatatatttttctaaagtgaaataaaatctatttttaattttatagtagttaataattaattaattatgctctaatgaactttatcgttttacgcatggctgaatattctatgaaaaacatgcagaaataaacaggcccttagccatgctacagtgtgtttttcttttaaaaaaagacgtggacataaacccgtttataccctcatcatgtacttgtttgtttactaaaattgtaaacgagaatctcgggaatcagttgaataaggcaactgaatctcaaagctttcgttgtatcgagcgtacatgtagcaaaaaaggaaaatattccttttcccaagttgttttctcctcctctttcttctttttaatttaactcggctatctttataccatggtaaaaagtgaaaccctccacgtggatcgctataagattctcctccccctcgctctcctcctcgcctccccccacagcggaagaggattccaacgagaaggcgagcgagagagaggagaagaaaccaagagagcgagggcggaggaagcagtcgagctctcccagcctcggcggctaaactccccccccccctcgctttcttcccctccttcctcaatctccaagcctcgatatccgtgttcttctctgaccgaatccgaatcccgcgtttctttgttgcgcgcgcgaccgcccgcgggaatcttggtggttcttgggcgatcgtgatggcattggatggcggcggcgaggttggcaggaggaggaggaggaggggatggggaggcgggttcccgagcctgatgcggcggaagcaggtggactccgaccgggtccgcgccgccgagggggaagggcaaccccagctcgccaaggagcttaacatcccggcgctggtcgcgatcggtatgttcatcgaattcctgattcttatgttttttaatgagagaaatgatttgttggctttcttttttcttttgtatgacgtgttttttcttttcttttcttttttttttgaaattttgattacttgtgttgaaattagtttatgcatatattcattgtgaaatgtttatgaatgtacagccttttggaaccagagaattattagatgtttattgtggtttcaatgtttagttggttggcctatttaaaagtttgaagattcagctggcaaatttatatttgttctttctttagaagtttcattctttcattcatggagttggaatgactagcatcatacattggggaatccattttttaatagttctccagttgtttattacatatatctgaatgctctgcattagtttgtgacagaaattcattaagtgtataggagtaagtgtgtgtggtactgtggtagtatactagtataacgctatttctagctgctgtgcttctactactttttagttgtctatctccaacttcttctacttgttagttgtctatctccaagtctctgttggtgttatggtgtatctctcatgatctttgactttcaaaaatggaaaatgatcctccaactttagacctgtaaattccctcaaacaaaaaaaactttagctctgtaatacataaacacttgtttttgtgggaggcattaactaattacactgtagtgaacttctttctacacagtaaattaatcgagctcataagttctacgcagtaaattaatctagttcataagttgatgcaaggtgaatgattgtaattctacctaggtgtagagaaatactccctttgtcccaaaatataagcatttttagagttagacacggttattaagaaagtaagtagaattaaataggggagagttgtgattggatgagaagtggatgtaggtaggaaaatcgaatagtggatggttgtgattggttgagaagagaatattggtgtagaagttgttatattttaggacaaattctagcggctagaagttgttatattttgggacggagggagtatttgtttacatgaactgtccatgttacatgaattgttttagtgagcgtttgtgttatctaccaggtgtcggttcaacaattggagctggggtatatgttcttgtcggaacagttgctagggagcatgctggtccagcattgacaatttcatttctgatagctggaatagcttccgcgctctcagccttctgttatgccgagcttgctagtcggtgcccatctgctggaagcgcctaccattattcatacatctgcgttggtgaagggtaaattacttacaccataatggaatacacactcttcatggaagaaatattgcacctttgatagtctgtgatattgtcaaatctattgtcataaaggaggattaacaatctaagatactgtaaacagatgactagagtttctcacatgactcatttttatttttctagtgttgcctggttgattggttgggctttagtgctggaatatactattggtggatctgctgttgcccgtggcatatcccccaatcttgtaagtgtcgtttttccttcatctagttctatggcatttgatcaatattcgaactacatgtctcatatattctattttcataagtttcgctcgtctttcaggccttgttctttggaggaccagacagtcttccatggattttatcacgccaccagcttccatggtttgatgtcattgttgatccctgtgccgctgccctcgtttttgttgttactgttttgctatgtgttgggataaaagaggttgttacattggtcgatttgtaagtttcctattctttcatctgcaaactaggattataggactgttactaattattctatttgaatctgttgcagagttcagctgtacaagagcttataacagttctgaatgcttgtgtgatgatatttgttattgtagctggtagttatatcggcttccagataggatgggttggctataaagttactgatgggtaatgcaaaaaaaaaaaaacagttgattgtattttgagagtaattactgatgcacttaccatttgaacatttcagatattttccacatgggataaatggaatgcttgctggatcagcaactgttttctttgcatatattggctttgatacagttgctagtactgctgaggaggttaagatgatcctaactaaccatgtcgtccacttcctgtatggggatgctgatttttccctctttcaacccttataggtgaagaatccacagagagatctaccactgggaataggagcggcattgtctatctgctgttgcttgtacatgatggtttctgttgttattgttgggctggtaccatatttcgctatggacccagatacgcccatttcatctgtctttgcgaaacatggaatgcagtgggccatgtaaggactcgctctccttttgtttattcccatatatccaattatctataatggtcttgcaacgtgcttatttagtctgtcactatgctgttttgttttaggtatattgtgacaagtggtgctgttcttgcactttgttcaactttgttggggtcacttcttccgcaggtatacaaacacatccctcgatataaaaaaaaatcctaataattcccaagctttaaacaagacagtgagcacatagagttgattctagtcgtctactatatgcttggtccataaggaatttgcgttctaatatcacagtcaattattccgcattatattagtgagagtggtcttctaactagccaaagctgaatctataatccttgtggaaaaaaagttatttttttgttgtacttctcacttgtattctgatttctgaatctgaatcaaactgcttggtccataaggtcaattattctgcagtacattagcgagcagttgattgcacttttcacttgcattctgatttttgaattttaattaaactattcatataatgattaacgttgtttctctccttgcaattttgccgataggctctgttttgacaaaataaactatagtacctgcaaatgtatattgaactaataccatatcaacataaatgaaatttgtagcacacacatcaacactagattgatgatgtggcatgtataccagtacttgttacatttgagctatccctgattgccttatacgtaaaactgatcccatgcctacacagacaaactcaaatgagaacacaaaaacataaacttagaaacagacacccacccgcccactctttccttgcacattattatgtgaaactgagaacttggggatgcattaccttgttttttaaaatacattttaaagattttagttgccatttcatgcagcctagaatactaatggcgatggcacgagacgggctgctgccatctttcttcgccgatgttaacaagaggacacaagttcctgtaaagagcacagtcgtgactggtctctgtgcagcagctctggcttttttcatggatgtttcccagctggcaggaatggtaaggaacttacccggctgttatctttggatatactgatggtcttttgcaatgagaggtgcattctataagaccatacttgccattaagcattacagagattgtaaggtggagataaaattaaatactcatttgttgcaggtcagtgtaggtacactccttgcattcaccatagttgctgtctcgatcttaatactcagatatattcctccggatgaggttcctctgccttcatctctgcaagaaacattctgtttgagccaagaatatgatgaggaaagggttagcggtattcttggagatgagagatgcaaaacatctgaaacaaaggatgtgattctcgcagaatctatggaggatcctctcattgagaagaaaataacaagtaaattgcattcccatttttcttataactgctgtattttatttacttcagttatccaacaagaaatcttctgataaactctgcaggaaagatggacgagatgaagcgtcggaaggtggccgctttcagcataggatctgtttgtgttggagttatggttctcacatccgcagcttctgccacatggctgcctttgtaagtgtcaatgatgcacaaaaacagtatgtagtgatagccaggttccttcctgtttcgagaataacctctatctgttgttgatgccagtcttcctatgtgtattggctgcatcgttggcgctctgttgcttgtagccggtcttggcctcctctgctggatcgaccaagatgatggcaggcattctttcggccaatctggaggtacatagcaaactgttctctctttttaggaaggataaaacactgctttattctgccagtacattcggactaaacagcacacttcttgtgcaggatttacatgccctttcgttccacttctgccagtcttgtctatcctcgtaaacacatacctgttgataaatctggggttcgtgtctgacttacccaaattattactccctccgtctcatattataaaccactttgggtttgtgctagaaaaatgtagtaacatctgcagcaccaatttagtttcaataaatccatattgactatattatatttttatagtaaatttattttttgttggagatattgatatatttttctgtacacttgatcggactagaagaggtttgacgtaaaaacccaaagtgacttacaatataaaacgtatggagtatttttttttctttttccataccactagatgcctttaatctcaccattttctctaccatccatcatgaacattaattcattttgcattgtcttgttcagtggagaggcatggatgagagtaggcatatggctgctgataggcgtcttggtgtacattttgtacggacgaactaacagctccttgaaggatgtcatctacgtccccgtagcgaggccgatgagatatacaagagttcatctggatatgtgtcctagaaaaaaatattttttagtttgcactattcttcagtgacaacatgcctcacctgtctgcaattggaagattagcctggacagaggagatgctaaatcattcatacttggggaaaaaacatggatgcaatattatatttaggatgtgcataggtgtatatataaacccaattggacagtggaatacatgattttgtgtatataagccctttgtactaaatggtaaactgaaaagcagttatcgatgaaaaaaaagtgcaatagacgaagtactactatacttatatccctattgcattatctttgctgtatttgttttctttttggttgtttgttcggtggaacacgtatgggttatacctctatacgatgcgagttgtagtagtatacgtacgtactgcatgatcccagtccgaatcgaagtctcatatatatgtgttagcctgtatttttacatgcctagctagtcgatcattgtaatgtaataaaaaaggagttgctgtccgtcgacccgttccaccaatacgtacgtggagatgatggaggaggatcaaccggccgacgaggtggtgctgctgctaccggaggaaatcctcgccgagatcctcgccgcctgcccccgcgcagcctcgcggcgtcgcggtgcgtttgcacggactggcgttctaccattgactcccgccggctgctacgtgcggacctcctcccgctgtcgctcgctgtcatatttatcgacttctggggccttaggtttccggacttcttctcccgcccaacctcatcgacctcaccgtcgacgatcagcggcaagctcgacttcttgcccatcaaaatagatctccacagcatctacgccataacaggccactgcaacggcctcctcatgctccccggcgtcgtggtgaacccggccactcggagatgggcgcgcttgccaccattgccacgccacttcaccgtgcctcaaggattgttttataacgaattcatcatcttcgaccccaccatatcgctgcactacgaggtgttcaagatcccatacggtgggacgacggactacgtcgaccggatggatcccgtcttgaaggaatcggaatggccaccatcgtccctcgtcctacgtgtcttctcctcggccacaggccaatgggacgagagatctttcaccagagaaggggatgccacaggaacacatgccgatgcacagaggcagccatggccgtggattcaacacggacatgcttattggaggggagtactttatgtgaacacatgccatgtaatgaggtttgatctctttacactatttgtttactaattttgtaaatttcaaatccttacaagttgaaatcttttttatgtctggtaatgtgtgcatctctatatctttgttctttgcaggatatctctgtctgatggaaaatatcaagtaattaaacatcccacagtttactacaagaagtttaaaccaaattttttaattggaaaatcagagaaaggggtgtacctcgcgtcacttgaatttgaccataatctttcaatttgggtccttaatgaatcatgtggtcattttgagtggttaccgaagcaccagaacaaccttatgcctttgttgctacgtttgaactgtggaaaacaagctcgccggccatggattttacagaatgttaactatcatctttactgtcaaaagtttcctggtgaatggaatttatatgattgggagtatgatccctctcatcctgattatcaaagcgatagtgatgacgacgatagtgatgaagcattggatgaaaataattttaaatggaattttgacgatgatagtgttgtagacactcaagaatgttttgagaactataaaagtggcagtcttgatttcctcggctttcatccatataaagagatggtttttttagttcctcgaaaggattggcatatcattggaatagcacaaagctccaatatttgggaaatttatgcccgaaacatcgtgagtacttcgttcgaaatggaaatataaaccggtcatttccatacacaccatgttggatggacaatttctcagaaactagataactcaatcaagattagcatgcaaagctgtcatttggtgtaggtttttggtttgttatctcaagtaatgattctaagttatacatatcatattgtcttgttgctgctataatattttgttgcataagttagccatgtcaactgacggttgattgtgaacgtcaattttctatagtcattttacaatacctcccactaggggtggcaatattttagtaggaacaagggcgaattaagccaggatttgagaaagaggagacaagccaataagccacgtccacgaaaaaaaagtatatgcctttattatagctaatacataaggaaccaatatatgtaaaagcaatcatccggcttcttgttcatcttggctagatgattcgattttaataagtggctgatttttttttcaaagaacataatacgtgactgaattgtattatcagtggattggctccattctcttaggaactaggaaaattagagctcaaatatttagggtattaagacagagcataaacccgtggacgatggctcgactctggcaaccccaccgcaataccttcgccgctgagtaggaatagatctcactgttgattttgttggtcctcagtcatttgcttaagtggaagggcaatttagtcgtcgtgatcgtatcattggccaagcatgccagctttgcaggtccaataatttcgttccatcacaagttgttgaagcaggaggaacagccgctggcataatcttgtgctcgtggccatagtctgccgttgcacaggcagagtagtgccacccctccttcccccgaattcagtgtgcaccacggtcaccgtgggttagcccgcataagagtgtgcccaaataacaatagcaaagccaaacaaaaccaaaaccacaagcactaatattggtaaataatcggatctaacaactataggcctaaaacaaatccacacataggatatatcaggattaacatgtgttcattaatacagcttccagggatttaataggtaagtacaatactaaataagaactcaacatatagccgtataggatgtgagaattaacatgcgtttaacacttcatttttcagggacagaacaggtacaatactaaatacgaacaccatttttttttcttccagcttcatgacacataattctcaaaaggcaatgtatatattttcctcttcatgatgataaaccagccgcttcatttgaaaagcgagaaacaaactgcttccagcttcatgaacttttctggtctaactccatatttccttcaccatacatacattaaataaagttagagtggacgaattgctgatccaaaattactatatgtacaagatcctgaaggccaaatcacacactactgaaagtcaaaatcatttctattgagaaccataaataacaagatgcggtaaaatcatgcatgacaacatcctgaagaaaatttggctagctgatagaagtcatagaacaaaatgattccatcagtgatttcaaattcagattttcaggagcccgatatttttttcctaactactcaactgcaggaaagcttactataaaccactaaaaaaaattaacgaaagcattatatgttgccttgggaatgcatcggcatgataactatattatctactatccccaaagtagcaaacgtattgaaggatgataccagggatacagtctggatagtttaactttctgtaataccttgattagaaaattctcaatcccactcttcatatatgtgattgacatggtggcactcactaacacacagacgtcaccatagaatatcacatcagagcattggaatggtttagaatccgtctggacctatatgacacacctaagataaatccagagacctaaaaatacattttgtgagtttaggaatctagatgatacacccgtacaagtaatctagatgacacacacgtacaagtataggaccgtcaatgtacttcactcttctactacatcactacccaatctaacatgagcggtagtaacagatctggtccattacatctactacaatagatgactcatattcacgagtggtataaaaagagaaaaatctaatttctacggttgatgcataagatgatctacttgactccatgagtgtggtattctccaggtgtgttcgatggatatggctgcttctatatatacagccacaccagctacatcaaatgcagtaaaatttgtattggcttgtaccgtactgcagccagccacaactggctgcaatgtagctcaagcgaacaagccaaaactttcaacacacctagtttacctcatcatcgagggagggataatatactcttttttttaattctaataagctagcttttgtgactaaagggcccaacaaattccatcattagcatgttatataaatttatcagagtaaatttcataaaaccccacctattatagttcaggttacacaaaaccacatggatctcgacatgtggcatataaccctagttattgtggtcataaaatttcacaaaaccgttaatcaatttgacgtactcctatatcaaaatataaaataccatatttatatttatatgtatgtaacatttgtataatagataaagaattcgtaaattcgagatgtgatcgtaaactgaaaagtgaggtagattaaagtcaaaatgatcaatagtgtgatttcttgaaactttattatcataatgcctagggttatgtgccacgtaccaaaaaccatgtggttttatgcaaatagaccacaataccagtggtcaagtgaaatttacccttctgtgatatgcctcacgccactagaaaaccatttttggggacaccacccatttatttctactatcggatttaaaaacatgtacttgtgaaaatgcattgaaggggtttccgatcacaaactgccagtaaaatttgattttcattggcagccgctaaaacgctctacatgagaaaaaaaacacgatactaaatcgcagtctcctagatgcgagagccagctaaatctatcttctccccaagtctctcctccttctcacctttaccactcccctctctctctctccgtccctactccctctagcctcctacctccaccgcagtgctctcagcaatggtgccacggcggcgatggcgatggcgatggcatatgtgacagcgacgactgcaacacgccaatacgggggtggtggatccgccgctggtaggttcgggagtggcaaattcacaggaggagcttgtccaggcattcggacggtggatccggcggtggggggcacataggtggtggatctagcaggggagagctaggctcacaggcagtggatccggcggtggtgaggctcgcggggcatatatcctgctattgagctcgggcatgaatgctagcgggtgacggagttcaggcaacaagcagccttggtggggcgttgggttcattttgttactgcaggtaagcatagtatcctaggactgatatcggcatcacggttatgcacgagacagttcaccattccccaatggcgtaccctcatttgcattgtctatatggtggtgtcaaggtggggtgtgacatggatgaagacgaactttatatgaaaattgtagctctagaatagatctacatctttgctgtagaaagttttttcatttgagattatttagtattcaaatattcaattgttgcatgtggttctacgtatgaaaaccgcctttaaaaatgagagcagtagtagtacttaaatataaaagaaaatcataactcttttaaatgaagtcggatgatgacatactttgtatgaaaaaattgatctacaactttgtagatgaaagtttgtttatttgagattgtttacggattcaagtatttgtttttctatctcatatttatttttcttttatttgtaaacgaccgcagatggatactgtcgacgtttgatgtcgcgattccggtatttgcatagtatggggatcgttggtactaggatatacgtgagactgaggtaaaagagacagagacgatgatttttatacaggttcgggcccctgaattgttaggtaataaccctacatcctgttggccgaagccggtattgctcttattcaccataatcacaccagtataatatttggggtagcctatctaactgttgtcgacatggcggtctgaagttctgactcgtaatcgacaacagggtagtcttcctcctcgaatccgtgcccggcgagattagagatagcgctttcgtctctcctgacagtatccggagacaccgtaggggactagccgtgcttatccctgaagtcgatatccggcgtcttgtcttggcgtatgttggcttgtatgttgatcttgtgtcttgatctattgttccgtgtattctatggtgggtgtgtcccctctcctcctagggggtcttgtatttatacccataggtgtccccttgtccaagtagaactaggaaaaccaatatggatacaatccgagtagtccttgtcgtttccatgtagaactctggttgtctttccttatccggaactctctccatatccaaggtcagtttccgtataaaacatggtatgtggtgggtcttgccgagatttagtcaactactattagatatgtggtatccataaccctgacagatacgtattatatatgaaaattgtagcccttgacgagatttacaactttgtagttaaaatgttctattcgttttttgttctcagatctatttttgaatttgtttcttttagttttttaaacgaccttggatagggacatattctatattaaaattgtagagctcaatgatatctataactttatatttgaacttttttttcaattgagattgcttaggggagcaaatattcattagaaactctctggtatatatgtttataaaaaaaattatttttttttcaaatgagcttgaatggagatatgctttatattaaagttgtagagctcggtgtggtttacaactttttagttgatgactttttcattttatattatttagagtgtaaaatatatgttgcaagttttatgagaggtagagtaaaaaagaatagcattcaactcatagtcagaagtgcttcatatgtgagatggtaaggagactatgcactaaatgataggacttaggttcgaatcctattcatgtgtgaaatcatgtgacttgtgacataagagagatgcctgctaaaatacgagatttttttttgagtttttttccctatagagatcaaaaactaaaaattcattttcacgggtaagtacttaagagagtcacccgtgaaaatttccaaggatggtcggtattccgcccgcacaaatcatgtgatatctacataccatagctacatgcatgtctgaaaacacctgtgtaaatgggttattggccgtatgcacaaacgcttcttaaaagtagtggatgatcttgggtcgtgacctcaggccattgctccactgttgagttgtagtcttgcagattcagattcagtttgtattagaaacaaaaatgaaaatatattttatttttagcatttttacagttatatacatgctttggaaaaaaatataaaaatatacgtgtgccacgaaatggtaacacgattgtttggcgcaatgtgaaggtacgggaccgtctgctgggacaatccggtgtcgtggacgaacggtaccgtgttgcattggtccatggcttggccgtgcggcactgcagtcccgcgggtcagccgcgcatgcggcatcgcgagccggctgagtaatgccgcgagatggctgcgcgcgacatagcctcacacatgcatgcatatatctcacgtatacctcatgcatgcacatagtatttatttgcatcttggccggtgtcacattgccagcccaaggaactatgcggtgccgaacagacagccagcccgggacccaagcggtggtccacatttttacgccgctccaaacactctgtcccgcgtttccacctggcggtacaggcatattttcacaattctgcttaaaaagaagtatataattaaaaaaatagaaataatgcatatttttcaatttttttaaggtgccatgctgtgtgattcgtgatggaatttgtgacttgtagtttctgtaattgtgtggtgtgttaatttatggatgacaataactgcaattttgttccgtgatgagcatattgattatgttggatttgttacaataactaattgtcatttcgtgcattttttaatggaaaaatcggctcgattaagtcgagctgactcttttttgttttttttcttgtggaatcaaaatatgtaggtgccggttctcaaatcctcgtgtcctcattagcaccactttggtagtgcctgcatcagatccgacagtaataaaggtacgaactggtactgtttatatgttctaaagtggtgatcgatcacagcagacgcaaccattttcggtataaaccacctgaaaatgcacctgatccgcatgctaagttgctgctactaatcacacttctgtttacatgttctaaagtggtgagcgatcactgccgacgcaaccattttcggtgtaaaccacctgaaaatgcacccggtctgcatgctaagttgctgttactcttcacacttcatgctttttgagttgttgccatataatgcatgcatgcctgatgccttcaacaaccaagcaccacatgcatgcctcaatgaccagtgaaattcacatagccacacctaactccacgcctccacctcattatgtatctatatatctctatatcctcatattctcgttgctcgtataacttctcgtgtgttaattatcccgtattaatataatggggcacttgcactcctcatgtgcatatggattattttgcttgatatcgcacactccgaagacgtggtggtggcgcagacagttttatgcgacagcatggatatgtctttcgaaatggagaatgcttgcttcccaaacacaatgcctagcatcgattgttgcatttttgctgtgcatgtcattgacatggcgattttaaacgatctagagtgtctctgcggtttgaaggatgaacggtcattctttgataacggtttatccctacaggatatggctgatttctattccagtagtatttgccagggtcaggatcttataaatgcccaggttgtcgtcgacgcatgtgaaggtacgcacgtaaaattatttccacatattaccccccctttattgatcgtgagtatattcattcggtccttgcatcgatatctttatcgccttttccccctccccttttttctttctttctttctctcttttggaaactttaatcttgaaggtagtctcctttcttttggttctctgttaatgcgaccaagcgtgcatcgttttctgtataggtatggagcaacgtagcaagatgccctcaatgcctcctcagcggttgctcgaaagcagggtccgggtcgaggctagccctgccgactcgccaactccgccggcttctacctgatttgctccttggaagaattgttagctggggctggtgatcatatgcctgatcagttctacttgagcaaccgtggcccttttcattaatgtagtttagtaaatcgatttttccatgctattatttggttcttgtatcctgggctccgcccaatctatctttaatcgtgctagctgtgtccttgtagtttagtggaatctatcctcttaaagaaagtggttttcgatcaccatcctcattgtaatcgtgttttgtcagttgtcaaataactctggtgttttttttttctttcagtagcagttatttcagttccagctcctcgattctgtcctttgctcccttgtttagtttcgtttggtttccacatcctttttcactgtcaggttcatttcttagtttcttttggcggcaacttgaatttcttttctgtttagtggatgacaccgcgtaccatgtcaacatgtccgctctgtttgatgaaaagaaaagaacaaacacagaaaaatatgataaagtctacttcatcctttgaagtattgaggttggtttacttaaaccctctagtatgaaaccggatattttattccctaaaatatagaaaacggtttaaataacctcatacagtggttttataggtggttttatggtaaacatgacgatgcagcagtagttttagccacatggactatatggagtggctatagcgatagactcgattaagttttatatggagtggctaatgacatggcgatagactcgattaagttttttttataagtggaacatcttgagaacgatatcattactatagaaagtaacaaaggatacgacactatagatgtcggaataggtaaaactaacatctacagtgcttttcctaccttcaaaggatgaaaaaagaaaaccgccacctttaagcaactataaatgtaggttttagagaaaaccggcaccaatgctataagtccttttttttaaaaaaaacgaacacttttaatatattatagatgttggtttattaaaaaaaaggcacatataatattattatatatgccaattttaaaaagccggccccataaaaatcgagtcgggtcgagccggcgggtaggagaaaatatttttggctagcggggctcagatccacaaggaggagaggataaggccactacggcactacctctcctctctctatccatatccagccacaacctccactctctctatctatctctctatctctatcgtcgctggcggctgcgtcatccttgtcgctcgatgaccaagtcatccctgccatcctcgtccggtcattgccgatgcccagaggcagccatggccgtggattcaacgcgggcacgtttattggaggggagtactttatgtgaacacatgtcatgtgacaagtatttacttactaactaataatttctaaaagtcggg

SEQ ID NO: 59271 - DNA, 14088 bp, Oryza sativa
cacttgtagccatggttcgtaagtaagataggcctcctccgtagttctgacattatctcttctttttcaaagttacagcttgcacaaggagactgaagatgaagcattataaagctcacatactctatcatcattgtattggccacattagcttctgtactgttagacaaagacaccaggatgtgattttttataatatcatgtccagacaacttccgcactcccatcttcagcagaatgtccatcaggtcgtttgctcgcatttcttctgtgagatacttgttttgacaagacacagatagaaggcggggttttattgtccgaaggttactatatagaacaggaaagttcagcatactacttctggaatcaggttttgaattgagaacatcataaggcaaccatatgggtccatctgctatagagctaaatgaaccatctgaaagtggaatacatggtatttttctgagagcacacaaaagatcttcagggcttgtggttaatggaagatttttggaagaatggtgcatcaatgataaatgaagagaaatgaaccaagcacatagccattccagccccagtgactcaatacaaccatcaactcgacaaatagatgatatgatgtcaatcaaaacttttggtccatactcatgaatacctagggcccttgataatgtatcagatatgattatatcttttgataggtacccaagaccaagatgctccagaagtaagctatcagaaattaatattctagtctgttcatcccaacctcgaagagtgttgcatgggtagacccatcgcgaactagagccctctaaaaccatgcaacgggtgagacgtaactttgaaaggatcaagtgaggtagctgacaaaagaatccatgaacttctcccactagaggaacaaaactcatgaaggttgtaacagcctttccagggcaaccctggaagcaaggaagagcacaaaaggattcttgtgcactgacaaacaaagaaggaaattcagacagcaaccactggttccatgcattatcagcatccacctcctctctggaagaaggtaagacaaaatccccttgaagaatgaatttaagaccataattccttagaggtagaaaagcaaatacgggttgttgcttcaagtaaggctcatactcccccatctgagtctcctgcaaagtaaatgccacagctatctctgtagagcacacatcattgcgtacaattgtgccctgtaacttcttgctaactaccaaccaactcatcatatcattcccatttgaaattctcacaatgccgttaccaagggccttccttctcataaccaatagcgtatcattcatcatgttcttaaacttgatgcattttagccgatgaaggaacaggagcagagatgggtggagatctgaaaacatggatgcaatggagtgcatgccggtaccctccttgaattttgatctgaatggaagcacaatgcaagtattccagaaggaagaagagtccttgacatcttcaacagataacattctacttacagaatcagtattgtaaggtgcaactgcagttggcaatacaaaaccaatttggccttctgtaatatcaaatttcacgtggaaaccatttgaatggatctcgggagcatcaggggatctgaaaaagatataataatggaatgaaaatggaaccattcctacataactcaaaggtcctacaaggtgtaaaagtataaacaatgaagcaattaactgttacgataagatcatgtaactacatataagaaggcatgcaaccacagaatttacacagcactaaggtaaatatagttagaacatgattttaccctacccgaaatactgatttgaatccaatgcccttatttccaatataaccctggttggatcctttctttgttgagctaccaatatcacaaagtgctcgaatattttcagcggagaagccactctcgttgttgagaacaacaataccattgtcttgaagaataaatgctaatgtgggttcaacatcctcaacataagtattatcatcagcattctgtacctgattagagtacattaatgtcagcaaaaaagaaatccagatgttcatgctatcgcctccagagcaagcgaagaaaacaaggcagtaaaaacatgcagggagaagtttaccagctcaagaagtaggtgagaatcctgggagtatagttcttgtgagagacaatgaagtgctctgccaagtcgagcatgctgctttttcaacaaactattttcagtgcaacttaaggactgatccaaaccaaattcttcacggcgtatggtctcaataactagagttgcttcctcaggattcacttctcccaaggtgggagatttgttagtaatgaattctgcagtatcaagctttgctgtgacgatatttaatacattttggtttttacttacagcaacaatttgattatccttgccaggcaatgacttgctcctcttcattatatcaacatcagtagcattaagcaagttagagttttcgcatatagcaactccagatgcagttgatggatgcctagaagaagcatgcatttctatatttgcatgaatttcgtcagttaaacataatctgcgacaatcttcagcccattctgctactccaagtgataacccaatatcatgaagcatgcacagctgcccggtttcagtggcttcaagcaagatggctgaatagcaattcttcgtgatagttcgaagtcctgccaataaaacatctgctgcaagactccggaattcggaaggtagatgaccaagacagtcaagtacaaatttggcaaccagatgaactatgtcgtcaatgtcttttgacatatcagaccaaatgttccttgcactaaaggatttgccttcagatttagtgttcagcaaatcattaccgttgtccattatgatgcctattgctcgttgtgcataacacttcaacaaggaaattggagtgttggtagaaccattataaacatgtagcaaggaaagcagcttcactgccacttggaatggtgaacattgaataatgccttctaaaaattggtcaacagtagcagatggatcaactctaataaacctaccatctgtggtcacgatgcaagctagatcttgaactgggcctgtattcagcaaccagtgcatgaaggaacccagagagggagcaaacaacaaatcccaatgcgaccaagtaagtagatctgacagcattggagccttaagcaaacatttaattgcttcttgtgaggagactgttacagaacaagattgttgaatatcattcattagcccatcaacggtatcatggttacctggaacaataccagaccaccgtttctccaacaaagacatagaaaacatgatattatttatttctatgtttttcctttgtctctcaatagaatcaagaagtccttctccagatttatcttgcacaatatcaaagctaatagttggaaattgccttttgagaagcttagagaaactatcctccgaaaactcaccatcttcaagccaattacccccagcttggcagagtaaaacctcaatctgttgctgcagtacagaaacttccactgaagaatgtgttaactttccgactttcaagaaactgctcaacttagggggtaaatgttgctcatgtttccccaagaactcgaggaaagtaccatggccaagagcgctaaattggttggctgaaaatttagcagttatgcatgtttcacaatcgagaagtgttctcaagaatgtagattttctcacttgcgaagcatcggttctggacactccacgattggactcaaaaaattcagtaattctcctgattacatcatcagctgtgacacctgcaggaatatatgataaacgtgaaaaaggtggtatttctttgacttaggtgttgcaagtttcgaaaagcaacataaagggaatttcaatttctttcagttccatggcatggcacagaattctgtgtgaagatcaaacaaaacaaatagtgttgtgtgtgtgtgccacagggggagagagagagagagagagagtactgcatccaggatccttgctgccaacattggtatcattgtctcctttcgcgacacattttgattttcttttacttggtggtggctccacttccataagctcagtggtggtaccaggaatatttgatgatgatttattctcattaaagacattgatcgcatcataaagactatccagcagaccacatcccatcgctctaacctgcatatccatgttgcagtacataaaacaaacaccccaaaatggtaccaaactattatagcaaatggagaaagggaagaaatgctcttaggcaagtaaagtcggtttgtcctgttcaatgtgtcccaaccatagtttatggctgggccagattttgctggttggacactgttagtcctttaaaaaaaagtctatttacttaaataatgcaagctgttaaaacacaattcaatcctttattggctctccatagaaataatacctccaccaagaaaggtaaagcaaatatctccagggagaaaacatgtgtaactgcatgcaaaatctggctagtcatggatgcttcaggacaatatatattggaatttatttatttagtgcactaccatatgaatactagacagataactacaagaaaataaaaaaaatcaacacctcatttgttatggacatcgttggtagaggtccacgaactgatgaagtgatgctcttgtgtgctgtggtaaactatctctaaggcctatgctaaaaaaagggacatagtcaccaggtaccttgtttctaccacaacctattttcagccactttattgtatttttttaacagtcacttgattgtaaaatgaaaattcaattcacataacaaccacctgtcaattgaaccatacctcgcccatccctatgcttaaacaatccccaaatgacccctacgaaagctgaaatcaacagcttgagtcttcagaaactgagtgactagcgtatttccgtatccctgcaagtataattcctttaacatttaccatggatgcgagcgggactattacttactatttcatctaagctgtttcatctaagtggaagaatcctggatttatttttactaggaattctgctttagtttggtttttctccctcgagaaaaagaatggaagaattcttcttattccattattcagaagtggcaaagaagagatcttatcaattccattctggaatctggaactggctggaatgtgcagtaccaccacccaaaccagcagaggaggctgtgtactagcagctactatgctggttattccatcctgttccgggcagaatcagcctttccactcattcaaataccagccaaaatctgaataatgttttctccattccaagcccaaatgaaataatcaagctaaaatgacaagaattaaacacataactatcataagtattgcctccgtcccatattacttgtcgctttgacttttttcttgaaacgtttgaccattcgttttatttaaaaattagtgcaaatataaaaaataataagtcaagcttaaagtacttttgataataaaacaagtcacaaacaaaataaataataattccaaaattttttgaataagacgaatgatcaaacattacaaacagaaacttaaagcgacaagtaatatgagacggaggtagtatcatatatactcctaaattttatttattactccgttttcaaataactgataatgggaactaatcttttttaacctttgaccactagtccttttttgcaaaatatctaaaaacattaaaaaggttgccatgttattaaagtgtattatgtcctcaatacaagcatgaaactttttctgcactttagcccaatcatttaagagtaattagtggtcaaagttcaaatcaagagtctaggttattagttatttgaaaacggagttacaaccccaaacgctaaattgaaatgggcaggtactggaatactgcattccaaaagccgaatttgaattttctccaggatgaaatggacaaatatgggaggacaggagataaaatagtacagatgagcacacacataggattgatcaaagacaaacaaatctgcttgtcaaacacaaataatgacagtctcgaacacacgcagacatagaatggcccactcaacagaggatataacttgcaagtcgcatctataaatcctatgagttcattaacccgctgtcttaaaatgaattaggtagcaactaaaaggttaaagccattttgtgcaacatatttggatagtatggatagtagataatagatacaagtaaaacgaataagggggatgagtaaaggagaagaaatcaactcacggcaacatttaggaagccaatgccagggtactcggagaaaaactttattattttcttcttctcctttggtgtttccgcatagtaatttgctagcaactctaaaaccttcatggtgaaatgcaagacaatttagtttagaaattggaaatgtctagactaaacacacttacctctttctaaacaatcaatgatgtgttttcaaataagtaatgaaatgaagtacattgtacgaccaaaccatcaaacaagtatgacaaatatcacaaataaatcgaaagaaacttgtatatcagtacatagagctacataattatggtgcctgtttgtttcaaacaaatattggcatcattcaggttaacaattacagaaagaaaacaaatatgatcatgaattagcatacctgttgaactggatgttcacggcatgcttccttccaggtcgttatgaatttctccaacttacctatactcaagaaacaattaggtgataactcatgcttttgcatttgaaccttttgcttcttcttgggccgtttgcatgaagaggtggggctcccattctcttcagatttccttttttctctcgtataaccctttttactactctcttttaccttgctactatccaaaggtggttttttactcgtttcagactttaagccaagacgctccatttcttctgtttttgaaggatatggacagctactaacacgcttatcaacatccttgttatcaatagcagcagaaccagttttactctcactgttatcaactgcatcaccctcagaactagaatcaccatcagtttcatcatcggttgaatcaaaatggatgtgcttattgatacctggtaatttctttatacgactagttatagcactgaacctctcatccaatgcctgtttgctcaaatgaaattttctatttttcaccaaatccttctcacaactaccatcacctgagccactggtgttgccttgaactttaacagcagacacttcagttctcctggcctgccggagaaaggaaatatgcaacctacaaaatctcccaaattagaaaaagaagaaaattctgaagaaagaccaaaggaaactagttatttctatttcaaccttgaagtatgcaccactaaaaatgttggacgcatgggggaagtcaataaataagtacgtgctcaattctaacattcatacctcaagctttgtattcgtacaccaaggttttcctttccagagactgacttttgctccgcaagataatccaagaagttttccactgtaattttctttttagagttgtccataaacttctgaagccaatttataatctcgtcactactaagcttaggtaccaaggacaaatcggcaggtactgaaaaataatgtgcaacaagtggatgctgaagaaaaggccccaaccccaactcttcaaactgtccaatgctctcatttttgcatatctcagactctaaatcataaactgaaacaattttccttgctgcaacatagcaatggatgaatgtattcacctgacaaaaaaaaggccatgcccatgtgaaataaataagcagcatcacgaagtaaaattgaaccaaatactgatgatttgatattaacaacaaaagttcagcagctttatgctcactcaaaagtgcaaaggaaaagcaaataaattcgatacatattgtaaataagcgacatcaaactaattcaatatcacagtttcacaataatgatgtttgcatggaaaggttcttaatattcagcttgttttatatcagaagtagtttgctacttttagaattatgttatctcccatatcatacatcattccacctttttgggtcctttgcatcaaatacctatcacggcgtcacctaatcgcagtactatatataagtaactgattatctatcttctgccaaggcatgctatgcaacattgactttggtaatttatttaactgcttaattctttcaccaagagctgaaacaatttgtaatttcaggctaagaaagtttcaaccgtttgatatttgttttcctttcttctgtttcagaagaagaatagaacttgtaccacttgtagtctcgttccattccaacgtaaagggacaacattatagcaaaaacataaaagaaatggaaattcagcaagtgatacaattatataacaaaagaaacaatgtaaagaaataaacaaagatggcaagttaatactaaaggagaaacgtgaaatttgcatatgtcgacagcaacgcacccagcacagtgcagaatttcatacctatgctacaattttctcatgaaacttcagctttagaatttagcaattgcacgcaaattaagactgaacagaacatatacaaattttgcagggatacatagtagcaacaattaattgcaaactattgttgtccctgcagctaatcaagcaaaactgaccttgccctcgacgaggaagaggtcgcgcaggaggggtacttcatggagctggacaccaagagagccccaggaatccactttgagcgccaccagcaccgcctgcgctatcttccaccctgtaacgccctcaccagccttaatgatctcgtcccgcaccttcctcgccgccgcctgcgccctctcaagagcccccggctgctgctgcggctttggctgctgctgctgctgctgctgcggtgggggcaggggtggcgggggatgcgcctgcggagccggctccttctgtttcttcttcttcttcggctgaggctgccccggcgcggccgcggctgtcgcgggggcgacagggcggtgctggatgctaggggcggccgccggtgctgctggtgcagggacggcagcgcggtgctggagattatgggtagggttttggtggtacgcagatgaatggaggagttgctggtggtggtggtactgttgctgctgctggtgatggtaggcggcgagggcggcggggttgtggagcacatgattgaggacgagattgagagggttgggggcgtactgggggttggggacgtagatgtaggggtttacccccgcggccgccgccgcggcggcggcggaggtcgaggcgtcgccctgccacgcggcggcggggtcccgggggtcgtagcctcggtgcggcggcggccattggtggttgtcgcggccgctcatcggggcggcggggtcggggaggaggggtagcgtgcggcggaagaaggagccagcaactcgcttggggcggcggcggcggcgggggagggggaggggtaggcacgcggcacgccgacgggaggcggcgggtttcgcggacacgcgtggcggtgacaccgggggcgccttgcggtcgcgggttttattgggatactagtacctctttgcgttgcgtaggggaattccttgcgtagtacaggtgccaaagtcggatgctgtttgggctcttcatattgggccgagaagtactacaattgggccggatagtgtttgggttcttgatcttgggctgagctagtagttaagtggaataagttcacttcatgaccctcaaatgtgatcgaaatctaaaccataaccctaaactacaaaaccagatatctcgacccccaaactcctaaaaccggtacaatttaactccctgagcggttttgggaggcaattttgctgacgtggtgccacatggcacctacgtggcaatattgacgagtcctttcttacacgtggcaccaacgtagcgatagaaataaaaaatatgcgtgggacccattagtcataaatatgggcccactgacatgtggggcccacatgtcagaccttttttctcttccctctctcccttctctctctttctctccacttcttcccctaagggcggaagcgtgcggggacagcgagagcgagcggcatcgccatcccgcggcggcggcgatgcggaagagaaggtggacaaggaggcagtaggtgcggagggagtggggggtcgacaacgacggcgacgaggaggcggcccagtagaggaactcgcggggggaaggctcaccggctcgctggccgtccgcccgcgggggaggggctcgccggccgtcagcgcgtgggggagaggttcactgaccgtccgctcgcgggggaggggctcgccatccgtctgcacgcgggggaggggctggagctcgtcggtggtagggagcgccgccggtgccggtgggaccgtcgccgaaggggaagaaggtaagagaaagagagataagggagtgagggaggaggaagaaggactgacatatgggccccacatgtcagtgggcccacatttctttttgtgtgaatgcctaatgggtcccatgcatatttttttatttctaccgccacgttggtgccacgtcaatgccacgtgtaacaaagactcggtcaatattgccacgtagaagccacgtcagcaaaaccacctcccaaaaccgctcagggagtcaaattgcaccggtttttgaagtttggaggtcgagatatctggttttgtagtttagggtcatggtttagatttcgatcaaatttgagggtcatggagtgaacttattcctagttaagttgggccttctttgtacaggttcaggtgtctttctgactcgatcctaccctctccctcccataaaaccaaccaagctcccataaaaccaaccaagtatcgaatgtgagttttagtaccctcttcctcccataaaaccaaccaagtatcgaatgtgagtttttaatagtacgaatctgattagtactagtatgtactagcttcgtaatttataggacagatagaatagtttggtctgttttcctagagcttttttactttccatcaactcaaaccaaattaaaattcagtcagttaattcggtaacaaacaattaccttcaactgaaagattcgatcatcttcagttaaaatataaaacaatatggattaatttaaatttgaaactgaaatggttgtattaattattgaatctgttgttacaactttacacaacaccaatactctatactaatctagcaactggagtatatttatccacaacattcaaggaaacatgatacttgtatgcgtatataggggtggcgcacatgtatttatactgtatttctcgacaaaaatattatatgtacgtacatttcaaattaatacgtatgaacactcgagctgcagcgatacaacctgaatctaaaaacaagaaggaaaagaaaaatctgatactccatgaactcatgcaagatgtttgcagccagaactaaatacatgtcataacttatgaccatgtcaaatcaaaaattctgcgacaaattgagtaaaacgccaagatgttctacgtacctgatgggttgttcatgactttcaaccacaatcaggcatatcaagagtagcaacaatttcaactaagctttctacccttcacatgtacagatgaagtccttgagcagttctattagtgcccactgaacttcgtattcattccctgagttggtttctagctgaaagtttcgacggtcatctctacatgaaaagcaagaaactatggccatttgttagtcatctgaggacttaatttatcatcgcaaaacagtccttcgatcttgggctcaggatcatcatgtagcaaagaagaatgaccactaacacaatcgaaggggatcgatgctgccagtttcattgtcgctatctcatattgcaacattgtgctttcccagactgcagcttatcccacaaacatagcatttgcctcggtgactggtaatgtgcagtgtagtaatcatctatgcatccaaattggcagaacttgatactgtgaacatattgaacatgtctggtgttattgaaccgctcaacccacatgcccatgctcacatcttccatcttgaagagctgcaaaacaagcaaatgtgaattgagtgaattagacatctgccatcattacttcattagtatgtccaggttgttttcttctcaacctacgctcagattattccgaaacatgacatcaaaatccacagtagtttgcttatgtgttatgtacaaggaattcaatagaatattatatgatgaatatcccattgttgaatccaagttacccctatgtgtcgcttttagcaccacaaaaaacaaccagaagcaaatcttctgagcttacccttaatttatgagctgtaaattctgacacaatggaagcagcaatatcagaagatataacgtagccaggaccatttgcatatgttgggtaatcctcttctggccactcctgtaaattaaaaagataagtgcaatgaattcatggcagactttaggcacccaaacctatgttggtataggtgaagcagcaaaagagaaaacgaaattggatagagtacaaaaggacacagaatttgtaggacgtcaattatttccattctcacaatttgtaggacgtcaattatttccattctcctatgtaggttcatacataactgtgtaagcccaaggatgcaaggaatgtagattaccacctagaaatacattgtacatgtacaaagttggtacagaactttcctaggctttgaattttaaacaaattcagatgattttaaactaaaaaggctatatgacaaaggctactattcataagtggtccttggcactagaaaagaacagtgagattaagtgtacatttttttccgtagattgacactatagagaaacaaagttaactggcccagaacaataccaaccataaccaaagactgcaccactaatatgttgaatgcccagttacaaaaaatatcatgttagatccaacttccaaatatatttttcaaagatggaacacatgcacctagttaacaagatctagttaaaatggcggaaaatttagtcaacatgtagaaaatatttcttaattttaactacaacaatgtattgaaacagcttcacaaattgtaggccctgataattgattcatcaaaaaggattcaaagttataatcattattataccaaaaatactaagcatctacataaacagttagacaaaacgacagaaaaatttgaaaatagcagcataaagaatgaacggttgacagcattgctgttttctcagagaaggatcaataagcttgtgcatatggctacaagttaatgcaactacagtcagcaatgggtatcagcaacataagttctataccattgttatgctaagtttcgctgtatggtttacagtaagtgattatttgttagatgcctcaaaagggtgaaagattgagtaaagtacattagcatgccatattgccatgaatactatattcttctgttaagatttcaatgaatcagcaaaaaccgcgtcaggcaggccaaataacttttattgaaatgttctctacagcacttcaatcaatgataagacatataaggtcattgtaaaataaaaacatgcttacctcataagtgacagcccacttcccagtgcgcaatggcttgtggtgataattcatgtttcccacatagagacttttacctcttggtattttcttaagttcatccttcactgattcaagtctaacaaaattatcgtcatcacacttcattatatatcgagcggaaacaacacgcacctgacaaacagttcattagatgttaatagagcagcttgaaagtagcaagttcgaaaatatgtaccaatcttagacat

SEQ ID NO: 59272 - DNA, 3878 bp, Oryza sativa
cggtggtggagctgacaccgaggaggacgcggctcccgcgggcgtgcaacagccggcccaaggtgcctccccctcccccgcccccgccgcggcaggagcgggcgaggccgccggcgggggcggcggcgggggaggaggaggagacgacgccgaaatgccgcgtggtgacgccgctggtggcggagcccgaggcgcccgcggagctgccgcggtggaggctgcgcggcatgtgggagctcgcctccgtcatcaacttcctccacgtgagcgccctcttgctccccctccccccactggctaggattcatggggtttaagggtgtttcgcttggggtgttcggtatttgggcttgacatggctgctctttctccggtgccgcaggtgttccggccattgctgaacattacggtggagttcacggcggaggagctggaggaggcgatcctatcgcccaacaatacattggatgacgttcatatgcctctgctgaaggtgatcgtgtagtttctgagttcgtttgattaggccgctgcgtcttagcctcttatggaatggggtttctgagaacagagtgttttttgcctgttataaatgcaaaaaagatgtgcttttgttgttcacatgagtattgaaactcacaaccaaggaattttggctatttgaatccaaaggtgcatgtagtacaatgctactatgatagtcaaacgtattgttatgatacatactgcacatttactacaacatactactaacatcatgttactctggcaatttgctaaggatatctttgtaagaaagtgtccttgatagctagagacggatataagaacatcactttgtagaataatgcacaacataatgccgcaaaatctgtttgagtcgcccatcatgtatctagtatgagtatctactaactacacattctataaacagttttggagttatcttatttttttcatacttaattgcatcttgcagtcgattcctccagtaactcgaatggctatgggacgtggaacatggataacagtgttatgcaggaaattgaagtactggtggaattgggtatatgattttgtcctttctaagaacattttgtgtggaacagtactgcattcagttgtttagctaataaagctagtactgcaggttgcagaaggtgatcttccaattgttgcctcacacgggtgagttccatacccaagcgattcttgattgaatcgatgtttagtgttgtatcttgaatgacttaaaccgattttccttgctcagtgcggaaattgaaatgtacaaggcacttgagccagcaacacgattagtgatccttaaagcaatatgtgatatacgtgttgaggtatgtgccctatgattccagctatctttttgaaatggtagaattgaatctcatagctaatgtcctatatcaatgtgtagtaactatcgagacctactatcttgccctagctgcttgtcttgtattacgtgttacatataattccctcacacccagcttcttagtggattctgctaggtattccattctacaaaggattagtacataagctatgctgtatttccagacacaagctctttttgtaaagtattttggtcttgatctttacactcaaatatattatgtttactgatgatgctttgttatatgaaagttgaaaacagtctcggtgctaaaaagaaaaggtgaagcctaatcgatattccaaaaatggctggccgtgttagcaattataaaattttataatttatagtggatccttgtgtaaaaggaatattaattgagcatggggcaggggcaaactcaacacttattccttaagattggattgagcacaaacatagctgcaagtcttattgttatgttttcaaggcacatggtttatttatgtattcttgcaagtttggtgacaaaatgtctgatctgtaagcatctaattttgcagcaagaggatattcggaacttcatagatagttctttaaagcgtggttatgagcttcctgtgttccgtaaagaacgtattggaggagattcatatggaatctcatactggtgtgcaacagccaacttttgatataattatgcaattaaatttaagaacatttttttgtggccaggagcatctctaatcaattgatgtgctacaggtatgacgaggatcccgtccttggacatcggttatatcgtgagattaggcaagtggagtatgagaaggacccaaccaaaaaagctaaagggaagggaatctcaaatgccccagttgtatcctatcaatgggagactgttgcatgcaactttattgaatttgaattagcagcagtaagttttgagtgaaccattaccatatgtatttctttattatgcaatctatgattgaagttcttgaatagttatagttcttctgttctccattgactcacacattataaggcacagtgttgattaggtcatacaaatgagaatttctttggatatccttagttaccgttggtacatggtattaccatgccatctctgtaaaatatatccagcagactgtaaaatatatccaacctccatacctctgtaccataactaaacagtactccctcggtttcatattattagtcgtttgacttttttcttagtcaaagttctttagatttgaccaagtttatagaaaaaaaatagcaacatttacgacacaattaatttctattaaatttaacattgaatatattttaatacaatgtttgttttgtattgaaaatgttactttattttgctataaacttggtcaaacttaactaagaaaaaagtcaaacgacttataatatgaaacggagggagtacttagtattgttgattccaacttgggtatatgtataacatgtgtttcatgcttatgtagcaattgtgcttacaataaaattgaattcgtgggtagtagcaggttgtttagtatagcaaatggccttgttagaatagaacttagattgcactaacatttagtattaacaatttattggtgcatgttctgcaagttagcagagggaaaactgtcatgtatttatcaccacaaatggcatatatgctcctaccaacctaccaaacttaaacaggcaactgcacgtgcatgggtcctttttagaaccgattacctacaattcaccacaggatgctatgtcatctacagtgatctaacttgagatagagaatttaccaaggcgacaaattttactcccaattgatgttttagaacccatgaagtcaacttttttcgaaaacaactcgagatattttttacaacttttatgttgtatatacaacaacttaagtcctatatatatattgtaaaagtactgttgtatgcttatggttttgttattttgagggctgtggttgtttgaaattataaccttgaagatcttgaataatgagtgacaccaccctaaaagattggtggatcgtatatttgtccatgctttaacatcttgctgtggagattgatttggagaaaaaaagttcttctcacacatgtaaaaatggttccaagatttgctattccatagtgtggctggcggctgctgtatattgcattggacttttgttagaaaaaggcagagcctatacagatggtaacacaacattgtcattggatatagtttataagaacatttacaaaacaattgtgtatattgtaccctgacgatcgaatatatggaaatttagtgatagtagttcttttctgcctatcttatgtaggaaaaactcttttcaagtaggaacaggactgaggtctcgcttggcaagaagttgaagaacaattatcttccagagatggaaaagattcacaaggtatctaaccgtaggtctcagagagtt

SEQ ID NO: 59273 - DNA, 15247 bp, Oryza sativa
taaaaggatgcttcacataacaatgattatacaatagtacataatacataaaagacaaaactgcgacaatggtgctcaactggaaagagatagtgcgtgaaatccaactgtaacgtacaacttgaatcttacttcatacatggtagctggcattgttgcatagaatagcatatcactcaacagatcaagaaagagaaaggggttttctagaaagagtcacacaatgctgatattcccaaaaagtttttttaaaaaaaacattagagataacatacatggtgttgattgatatcttcctgctcatcttccaatgaaaaataaatatcatctgcatggagctgaagatctgagataaacagataagaataacactatgaataggcaaataaaaaaatgaattcttataccaagtaattacattgaagaaataactagttgaacttgaatattaaaaggcttcttggttgacaaccgcaatacattgtcgcatttgcatgtggttaatttctttgatatggctttcacaaaggtgcaaaaggatatgtaataaaccaaaatatcatcttattttaatcaaaaccccaaaataaagttagaaatattgaagaagaaaaatacttcaatcaaattttatttgaatgagatccataatactagacaaaccattccttgatcttatagctcaaatttaaccaagtaaaacatcaagcaaagctcctcctttgcgatgtcagcttactagtatactagcatataaaggttgatatttttatcaagtttgacctgatagccaacatttttatggcggcattaaattagttcaacatattagctgattttacagtaatgtaggatttaggtggcatcatttagcctccatgaagtgaaacacaaaccagcggaactaaaattctggtcagttgcttcaacaactatataactttacatccacctaaaaagaatcaaaagtcccaataaattaaagatataacccctacaaaaaaacgagccatttttctctcacatataactctatattagattgcaacaacaggcagatgtgaataaaaaaaatcccattccatcattaccaactttaatggttccatttcctattagctcccatcttaataacccaacttagtttagcaggattattgactttcctttgcatatggggcagaaatctcagttgtcctcacatataaaccttgatcgcacttactggtgaaattcgcaagtaataaatgaaggcatgatagacctcacgcgataatcttcattgaggcaaatgcccccaacatatataggccattggctgtgtacaacaagatatgatctatattagttaagagctaactaacactaactactaattgttagactaaatatcccgtccagctagaacattagaaaactacttaaggtccagcgcaatcattacttaccagttaacaataaaacgttccaaattaacatttttcacctgccatgacaacggggaagtggcgctgcgcaattataacgttttcgcgctaaatcacagatcagttaaaagtaggcagcaccagttatgcagtaatgctattttctgaacacgctcaatgctgttttctgaacaatatctcactcccggagtcactaaacataaacctcatccgccccaagatgccacgaaacctagaacaccatgaagctactttctcccgacttgtagctacagtaaaaacccaaacccaagcgattccagcatcagatccctagagtcaatcaaccgatcagcgaagtcgaaggggctcacagttggcgttgacagagttgaggcccgccggggggggggcacgggggaggagcgcggcggaggccttgtcgaagaggagcgcgcggacgcggagctggaggagcaggagcgggcgagggggtggggccgcggagccgccgccggaggaggggaagaggaaggcgtcccaggtggagggggtctggaggtgctgcgcgagcgcggcatgggcggcgtccccgagccacgcccgccacgcgccgcacgcctccagccgccgcgcgaggtcgtaccccctcccgtcctcgcccagcagcagctgcgccgccgccatccgcgcgagggggcgggggcgcacaccggaggccccgcgtgtggtgcggcgtggagcgagcgccgccgccgccgccgccggcgggatctcgtcggtctcgccgccggagtttctgacaccgcctagtcggaacagggcgaagcggaagcgagagtacgagacagacaggttggtggtcatagcacacaggtgagacagacgacgcggaggaggaggagctcgagcctggcccaacatcacaaatgtctcggcccaaggcccactcatgagtcctgacgtggattttcttcgatgcaagaattttgtgctagcatgaaaattctgcagagcagcaaataaaatttgtgagctacagtagtattagtattgatctagtgcaattaaaagagaaaataatagaccagttatacgttggttctatgaacctacatgcgcacttagccaaaataaatgaataaataaataagataatgccaagtccaactttgtgatggatggagaagttagttttagtattcacaaatcacaacaccatagaacaggggagtatgagtagcactatcagtctatcacattagaaaagtaattttgactatatgattgttttagattatgatttgttatgatatggacctactacctagtataagttttttcccttttaccccattataaatatttaacatatagaataagattcgaccaaactttaaataaaaatttcaaagatcaataacttctcaaatgcttggttttagaaaaagaaatagtatgcatagatttgtcttaaaatgtatcaccataatattataatattgttaaactttattaagttaccctaatataaaattattgaacaaagtttaaaaagtttaacttaaagcttgctcctaaggtcaaatatttaagaaaaaaaggtactagtatattgtaccacttgcaatttggtagccgtaccagtacatatcgacttcgtttacctgcattctatatctcttcgcattcgctctttctttttgcatctctatcgtgaaatgatgtcatctgttgccaacgttgcaaatattacgtggatccatccgtcagcgtgcgcgatctctatctgaaatcggtttgacctactgttgtagattttagtgggaaatagctggtttggtaggtagtgggctcctaattaacaaactaattcccaagcttaaaacagaggattacgcccctaatggcctaatcaacgacgcacgacgtctcctgttacacacacatatattgtcaccacactaccacatatatccatccaagacatatatagataagcacaaactttcaatggcaaagtttcagtaatcaacttaattcaataatagtagttttgagaaaaaaaaaacgtgagcaaagggctaattacccctacaattaatcaaatgctgcctccatataacaaaatcctatatatctatataggtaaactttctcacctttcaaatggtgtgtctgcgcgttcggaacctatttctctctttttctgcgctcatgtttttcaaaccattaaatagtatattttttgaaaaaaaattatacagaagttactaaaataatcatattgatctttttttaaaaaaaattagctaatacttaattaatcacatactaatggaccactcgatttaccgatttaccgtgcggaagggattactgcccatcccttgctgcttttaaagtagtagtagtaagagctactaccaaaagtccaaaacacgtctcgttgaacgccaccgcccaccgcgccatattccaggtagaaacgcccaaaaacgtcgtcgtcgtgcagcctgctcgtcagtctacccttcgcggccaagaaagaaaaaccgtatgcatttcaaaagctggaaaaaaaacagaaaaagaaaacccgccccatacctcgtcgtcgtcggcattacgacacaccccacaacgtcaccaattcaagcagagcgcgagattaagaaacgcctagcatttgatccttcgcccaaaagtaaacaacagtggagtactagtctatccagtccactaccaccacatcacaagagaacaaaaacgttcatgtcggcttgagcagcagctgcacatgcgagagatgcgacgacaacgacgactcgaccaccacaccaccaccattccttaccccctttccaagcacattccgcccgccgccgcgcccctataaatccacggcgcgccaagtgccaaagcctccacatctttccatatccatatccacccatatcacatctctgatcaatccttctgcgtgttcgtgaattgggaaattaatttggttttgagacaaatggaggcgacgtcgtcgtcgtcgtcgttgttgaacgggctgaactccggcgtggtgctgagcctgatcgcggtgctgtggacggtggtgtggcagaatctgcagcggctgcagctgcagacgctggtggggcggcacatgaaccggcacgcgcggcggctggcggcgctcgtcgacccgtacctgtcggtcaccatccacgagtacgagggcggcaggatgaagcggagcgcggcgtacgaggaggtcaaggcctacctcagcgcgtcgtcggcgcgcgacgtgcgccacctccgcgccgagggcgccaaggacgccgacaagctcgtcctcagcatggtcgacggcgaggaggtctccgacgtcgtcgccgccgacgacagcaccgacgtcaccgtctggtggtgcgcgtactccacgccgccgccgcgcaccgatggaggcgggtactacggctggggcggcggcggccgcgcgcaggagaatcgccggtactaccgcctcttcttcctcgaccgccaccgcgagctcgtcatcaacacctacctcccgagcatccgccgccagggccgcgccgtcatggtgcagaaccggcagcggaagctcttcaccaacatctccacgcacaactggagcgacgtcgacggcctcgtccggtcggcgtggagccacgtcgtgttcgagcaccccaagacgttcgacacgctcgccatggacccggccaagaagaaggagatcatggacgacctcgacatgttcaagaacggcaaggactactacgcccgcgtcgggaaggcgtggaagcgcggctacctcctgcacggcccgccgggcaccggcaaatccgccatgatcgccgccatggccaactacctcgactacgacatctacgacatcgagctcacctccgtccactccaacaccgacctccgcaagctcttcatcgagacgacgagcaagtccatcatcgtcatcgaggacatcgactgctcgctcgacctcaccggcgcgcgcaagaagaagaaggaggcggccgacgacgacgacggcggcagcaaggacggcggcgcgccgcccaagccggacatgaagaaggacgcaagcagcaaggtcaccctctccggcctcctcaacttcatcgacggcctctggtcggcgtgcggcggcgagcggctcatcgtgttcaccaccaaccacgtcaagaagctggacccggcgctgatccggcgaggccggatggacaagcacatcgagatgtcctactgctgcttcgaggccttcaagttcttggccaagacatacctcgacgtcgactcccaccgcctgttcgccgccgtcgacgagctcctgtcggaggtggacatgacgccggcggacgtcgccgagaacctgacgcccaagagcttggacgacaatgccgacacgtgcctcgcagcattagtgaaggagctcgagaaggccaaggagaataaatcaaaaggaaaaaatgctcatggcgaagacaaagacgaagacgaagacgaagaagatgacgatgtagaagtggtcgggaaggataagtagctagccgccattggcgccttgctggagtggttgctagcttctcgttttttctagtccacgtagcttatgatcacagtaatagactaagtttttttaagaaaattattttcattgtggaataatttgaccacatgttgtgctaaataatttgactcgattttcttagtgaactgacaatctgcttaatttgaatgttaaattctctcaagtgaagaacgccgacaacaatttagagcgtgtacatctctgttgcagacgccctcgctgctcctgatttgctcctccacctccggcccaggctgtcggcggcggccacgctcgagctagccaccgtccaaccggtggtttgccaccatgtgctagactctgcgacgaacgaccggcgcatctcgtcctcggaccaccccctcacaacaagaacaacttacgacttaagctactcggagctcacaaatgatcattttgccgggccaatctgggacaaccacgcttaagtcaaatgcaaaatttcctttgaactgcacataaggggcgcatcttcaccaatgaaaggcgagctcgacgcggattagcaacatccgcatgctgccctttctgccccctcgatgaagatgtggagcacctcttcctacgttgctccggtgtagcagctgtctggcacgcctttggccttgacggacaacagatcgcctccctaccacgtctggaagatgtctgggacatccccccacccaagcacgccgtccctccacgaatctggcgcatgtaccatcctactagctgcaatatggaatatttgaaaacggcgcaacaataaggtcttcaattccttagacgactccactccgtcagttctccggcgctgtgctagcgacattgacttatgaagcagcttcgtaattgggtctcaaacctgtaattagttcttaatttagttctctcttatccctcattgtaactcttccccctatatgtttctttaattcaataaaagttcaggctggtgtcgacgagtcccgccttagtttccctcaaaaaaaaataatttagagcgatactgcgcgacatgattcgattaattagcttacattgtatttcggaatttggagaattcaggtcaacgtccaaaacatcacctgttcatgatctaccagtatgaagctctatattgaaaatggctataaattaatgcttcaatcagatcatatcatgtgcgtgtatattaagttattaaccaacacagtggtgacactaaaagggcgatgaaaaaacaaaaggaacattggtgcatgacacaaccacatggtataattaagctaatcaagttcgtaggtatgtctggtaagtgtcttgttaatgcgcatacctacgtagcatttccggtcaaagacttcgacgattgatcttagccagatgacgacgataggtggtgcctttgcacaccccaatgcccaaagacacctaaaaaactttcacaaatatctccagaagtatataaagtaggagtagtcggcaatagagagtaaaatacgccatcagtccttaaaacttatcttgagattttacttaggtacacgaacttgtaaaacgcacgtcgagatccctaaacttgtttattgtatcatcccggtccaaagtctcgtttgatcgtggtcttgtctacgtggcacgccacgtggacgatgacatagaattttttattttttttctcccttctccttttttttcctcccttcttcctttttttcctctctggcggccgctgcaccgcgagctccacagccacgccttcatctccttctccatcagcctccgctccacttgccgagccgtcgtgctggaggcgcgcacgcgacgggagggaggacagtggcgctgacgggagggagggggacagcagcgcatatatgtcctactcgatctcctccggggtgagctccaccaagaacggcgcgcgcttccggcgtcgggacaaggacggcatgggcaccgctgccacccatgacatggaggcggctgggcgccgtcgcgtccgctgtcgcaggttccacggcctcactgcaccgtccacttgcggctgtggtagggcgagatgtggaggcggaggcggcgtcttgagatcaggctcagagtccatctccacaggtaggctctcgggcttcgtcgtcgtcgttggcggtggcggcggtggaggtggcgggggtgggggggctaggctggggcacgtggagacggtcgacgggtccaaaaaacaagggagaaaaaatttcatgtcatcgtccacgtggcgtgccacgtaggcaagaccacggtcaaacgcggttttggactgggatgatacaataaaccaagtttaggaacctcgaagtgtactttgcaagttcgtggacctaagtgaaacctcctgacaagtttaaggaccgatggtgcattttactttattaaaaaaatacaatctatgctacaaggaaagacaaaacaaagcaacaaagttttttttttcacaaacatgcaaagcatgtcgatatcaaatactcctctaagagtgatgtaccaattttggtctcgaggactgtaaaatttctcaatatttaaaggtacttatggtgtaacttttttgcaaatgtgcaaaagcttttaacgtcgatatcaaatatacaagtgtccttaggtgtgttctttagtactccctccgtactcgtaaataaagtcgtttaggacaatgtttaagttaaaccttgggaatataaatcatgaataactctcgagttgttgagtttaaaaatgtaaaaattatatgaatagatttgtcttgaaaaatactttcataaaaatatacatatatcacatttcaataaatatttttatagaaataagaagtcaaagttgtgttttggagaccgtgtcgctgtcttaaacgacttcctttacgagtacggagggagtactaaatatctaaggatacttttggtgtgtcaaaaaaaataaacaaaaagaaattaactagttatatcaattagtgcaatgctatatatctagctatggcccatggatgactggatctcccggccttttcttctttccaccatcaattggtcgctgtcagcaaagtgtccctttctccttcagaaagcgatccactcctcttcagttcaggagcttggccgccatggcgccaccactcgattaaatacactcgagccgtcgagaattgctttaagttttctacgaaagatgatggccttacagctcagatataaaaacgacaacggacagctaatcagatgatgtttcagtctccaatttcgtcagtgatgacaagaacgcttttgtgcgcacacatctttttcctacgaacacgacatgatccgatcgcatcagtgcgatcaacggttacgattttccctgtctcttacctctggaaaggtaagatcgatggtgcactgccaaaaagcttgacgaacataaatgcgaaagtttggcactaacaaaaacgatgcttttatgagtttttggtagagtttttgccctctgaaagtctgaaaatctgaaatgcacgtgaacccattatgcaccaaagtgctcacaatttggtctccaattcagcaactttacgcgtgtacctcactactttgtgagtgatcgatatcactgatatttttgcactctataaatattgctctgttgctacgatgctagcaatgcaagaacataaaattcggttcatcaaatcagaaggaatttgtttgttgaagctgtagaattgtagtgaagagatcgatagatcgatcggcgatggatttggcggcgtggtttgggccggtgaattcggggctggtgctgctgatactgacaatgctgctgcgaaacctgcagaatttccagctgatgcagacgttcgtggcgcggcagctgaaccggcgggcgcggcggctggcggcgctcatcgacccctacctgtcgatcaccatccacgagtacgacgccggccggatgacgcgcagcgacgtgttcgccgagaccaaggcgtacctcgacggcgccgtcggcacgcgcgacgacgtgcgccacctcaacgccgaggacgcgcgcggcggcggcggcggcggcggcgcaggcgaagggggtggtggtggcgctggcagcagtagcagcaaggggctggtgctcagcatggcggacggcgaggaggtggaggaccacttccgcggcgcgacgctgtggtggtcggcgcactgcgagcaggacgacgacaaggggcggcgcggcggcggcgggcgcgcgtcgcagcgccgctcctaccgcctcgtcttccacgagtgccaccgcgacctcgtccgctccgcctacctcccccatgtccgcgaccagggccgcgccttcatggccatgagccgccagcgcaagctctacaccaacatccccagctctcgttggggcgacgacgggtaaaccaattagcttaatcgctcacactaattaacacacgcaccaactaagatatttctaactctacaaatccataaaacgttgataacattcgactgaatcattatttatttattttggatgaaatataaaacttttgtaccatcataatttagcatacaaacttcaaattcagtgaatgaagacctaattcttgattaattaccgcacttagtcacgccaagacggaggtgacatgtgttcgttctcattttaggagttacatgtgttcgttgtggacggaggtggtgttcaagcaccccaagacgttcgagacgctggcgatggatccggagaagaagagggagataatcgacgacctcgacatgttcaagaacggcaaggagcagcaccggcgagtcgggaaggcgtggaagcggggttacctgctgcacgggccgccggggacggggaagtcgacgatggtggccgccatggccaactacctcggctacgacgtctacgacatggagctcacgtcggtgcacaccaacaccgacctccgcaagctgctcatccagaccaccagcaagtccatcatcgtcatcgaggacgtcgactgctccagcaacctcaccggccggcgcaaggccaccggcgacggggaagacgacgacgacgacgccaagacgaccaccaagaaagtgatcgatcgcggcggcggcggcggcggcgtcggcggcgacagcaaggtgacgctgtccgggctgctaaacttcatcgacgggctgtggtcggcgttcggggaggagcggctgatcgtgctgacgacgaaccacgtcgaggacctggacccggcgctgatcaggacggggaggatggacaagaagatcgagatgtcctactgcgacttcgagacgttcaagtccatggccaagatccacctcgacgtcgacgaccacgagatgttcgccgccgtcgagaggctgctgccggaggtggacctggtgccggccgacgtcggcgagcacctcacggccaagaacccccgggacgacgccggcgcctgcctcgcgaggctggtgaacgcgttgcaggaggccaaggccaagaaggatgcagctgaacgacaagatgaagacaatggagtggtagtctgacataaatagcccacccgtctttatacattttgtagaacgctgtcaattgcaaacatcaggattcaggataccagcaatgaatttggcacacgatttcattctcatttctcaacaatctcgagtgctagactaagtggatacattggacagaataattgtgttatagcatgatgcgataatataagttatctatcaaaatttcatagggccaagggtcttttgagactccatgtattgaacatctctagaatcttgcaaactgccttttgtcatcaccgccttttcttccgtagggatttgcagcgctgatgccatgcctccttccaccgtccactttcctcatcttcctccgatgtttggatgcagagctctccaaatcgatgtttacctttggtgggttcttaaaacagaaagacgctgccacatcctgccagatagaaaggatttagacccatctgtctgaatcaagatttattaatggtgggtttgtaaaacagaaagataaaaatacaacaaagattcactaccataagcacataaaacaaattatatactagaaaaataaactttaatctagctcagtaaaaaagtgcagaagaaattcagttagtttatataaaagttaaagatgataaattaccatcacttacctagcacatactttatataaaagttaaagatgataaattatcatcacttacctagcacataccattttctctcaagagagctaaatactactaaaattgaagaaaaaacaacagacactccacttgacacttaaaagatttggaacatgccaaaatgaagagcatttgttgtgaattgaatgtccaatacaacaaagcatataatgggtaacaattggtcatgcacaggggaaccaaaaatccttcagaaagaaattcaataagcagtgtaccttcagattgagattatgaacatcaaaaatgtctttcatggagtgtgagtcgtatgccaagatgtaggatctgtatgcctctttagctgactgattcaggaaataattctcgccaacgatattctcctgtccaacaacttgagttattactactagacacatttgacaaacagtgttaaaacaactcactaactgtgaaaaaacacttacaaggtgcgattgcaaatttggcactttgttttcattgaacactaattctgtcagcgaaatcttagcagcctgcaggcaccaatataatatgttataatttctcttaacttcagaaaatagaaaacatattactttgtaaagtactaccttcaggtagataagaaacttcagttcttgtggcagtaaaaacaacagtgcttctcctttgcctttttcaccacgtgcagtacgtccaactctgtgaatataatcctgaaagtaaacagattactcagtacattgaaatgagcaaataagtgaaaataacagaaaactaacttggcacattcagaataacccacctttggttcatctggaggatcatattgcacaatgaaatcctaaaacattgccaaacatccttatatcagaaaagggggactccatataagagatttttaaaaaatcaccattaaaaactcaccacatcaggaatatcaagtccacgtgctgccacattagtgcatagtaagatacccttttctgctttgcagaagttaaagaatgttgtggtacgcttctgctgcttttgttttccatggatatcagaacattctatctggagaaaattcagaagttctgcatggaacttgactgaattacatgatgagaagaacaccatgacctttttattctgtttcttttttaggaaagcataaagaaccaaaaaccttcttgcgctatcaatgacacaatatccctgctgtaagccctcaacagtagcctgtaggagcattatggttattatcctacaaacattatgaaaagagaaaaaacaacttggctgacaatttccttacattagtttcagcatcatcaacaccaacataaacaggttttgaggtactttcttcgtttttctcaaatgacaacttggcaaattctttaacctgtgtggaattcatcaatgaatcagtacatcacccagagaaaaaatgaatgaaaagtttcaacaaactgaataataaattcactaacctgctctgtctgtgtagcagaaaaaagaactgtctgtctattctgcatagcataagtagcgatttaccaaaaaaagaaatgagacattatgtaagcaaagagttacaagttatggtctgcatatgtaaaatgataaatgtcagacggccagatgaaatataccagaggaaggcgtttaaatatctgtttcatatcttcttcaaagttctgctccaatagacgatcagcttcatcgattataaggcactacaaaaaaaaagtgattcttttagtcctgaaagaaaaaggttgacccaaaagcacagaatgagcagtatagtgtagacatgagaacaaagactggttatgtgatcaggtttatagtgcagtagaactatgaattttgtgctttctcttcagttagttcatggatggtctaaatacctacactgtttccagagaaatcatatgcaccctttcaactgatagaattaaatatgggtttcttttacctttagccgtctatatatgaatcccttggtattctgcagatggtccaaaagcctgcctggtgtagcaactaataaattgactccctttgcaagctgatctgcttcacctctccggccattaccgccaataatatatccaagagtttgtgagtgatacttcatcaattccttggcaacattgtgtgtctgaaaaaaatatatcaatggcaatacatgaataagaacctcaaaaaaaaatccataaatgcaataagcaaggcatatattttgctcacaagcctagaacggactacagaaactatatttcccatgtttaacaaattcaagtacttagtattgcaaaaatcaacttccagcatgactgattacatagtttcctcaaacaggctgtagcatgattgattctattagttgtaccatgatttcgtttggtaaaccaaaaatgcaaaaccatacctggatggcaagctctcttgttgggcaaaccacaacaactccagtcccattcctcggcatgaaatgtgcgtggtggagcatctcgattgctggtatgaggaaggcaagagtcttccctgaaccagtcttggccgcgcccatcacatcctttccattcaacaggtgtggtatggacctagcttgaatctgcaagcacaagaaacaagaacaatttcatgtgagcatatctctaccaaacccaactcactataggcatccaattaagcacgcgcttcaaactacattatagatttccaattgagcaccgcatcaaactacattatatctatccaattgagaacactaggcatagtataaacagctatcaattttcaacgcaactaaggaatcgtgcagcgaatgaggtagttagcaatttataggttcaaacggaggcaaggcgaacctgggtgaggtaggtgtagttcatctccctgatggctctggcagtaggctcggagacgccgagctcggagaacagcatgttggtcagaatcgccgatcccccctca

SEQ ID NO: 59274 - DNA, 27873 bp, Oryza sativa
gaccattcatcttattcaaaaaatttacgtaattataatttattttgttatgaggtgttttatcactcatagtactttaagtgtgatttatatcttatatatttgcataaattttttgaataagacgaatagtcaaacatgtgagaaaaagtcaacggcatcatctattaaaataatggaggtagtatatataaattgcaagcatcactagttctcctctattttggtaatattgacggtcgaaactgatcgataacgaccgtcaacaacagcaggcagcccagtgctgacggcagcggcgaccgggcggacggtcggtcatcgcgcgcgcgcgtgaaaatcgaacgacgcggccggattttgggtggcgtcggcaggaagcggcgagagagagagagagagtggtcacgcgcgacgcacgtgggagaggagatgcaggccaggccatggccggattcggcccaagcgaatatgagggaggtaaagtagacttttaccaggaaatcgctttaagggatttgggggcaattggtgcgggatttgaattcaaatcgaatatttgaactcggcaaaacatggggaagccaaagaggggattcgaagcgagaattcgatattcttggaacatatatataatcatggggaggcgacgctggcgaacttgttaatggtatttcttagatttagccgcttgtcaatgatatttgttggattatctcttattttattgttcgaaatggaagtgatcttcctattttgctgatgtagatgccacttattgatgtctacaacaatgaaagttagtaggggaccaccatgaatcatacgccaatgtcggaggagactagcagagaaggcctccgggacggtcgcggcgcgagaacgacgtagagggagaattgccggagtagcacgtagttgccggagaagagcgaagtgtagtcgaggaagatacggtgacactggcgatgaatcatgctggacgaagacgaaggcgaagtagtgggaccaacggcctggatggcgacgtcagtaaccatgtagaggtagctggaccaccggcctagagcggcgacggtggcagcttggagatgcggcgacgatgctcgaagtagacgaagaagaccctgagcggctgacgatgaccagtgcggatgacgagggtgtcgaagcgcgaacggcgatgaagacgacgaggggcaacatcgtgacccataggggcgacacaggtgcagcttgatgtcgatgcagcggcgagaactccactagtagggaggccatgctgaggagggcgcctctcagcgttccaacaacaagtggaggtggaccacgggcggtggcactgcggcccaagggggcgacgcagcggcaacccgaagcttaatggcgtagacgcatgctcgatgacgatcggttgcagaagtcgttgtagccgggagcctgaacgggtgatcaagccgaagatgcgtggggctgaacgatgaagtcaaagcagagtcgatgccgatgtcggagatgtgtagaagtcgacgaggcggtgggcgacgcaaacccgatctatgatcaggaaaaaaaaacagacacacacatgtacagcagcagcaacacggtaacaccacatctcttcctcaatggtgtcggtccatagaccaagtccagcaatctctctgcctcaacggtaccagcaccaatgacgcatgcacatctgtcctctccagacctccacagccagagccagccatccatgaaactccatgtctacacttctctctctcctcccttgcagtcaagcaagttcacagaagagaaaaaaaacaggacagggtgtcacgtgtcaggcccggcggtgctgacagccgacgtcaggagagggcgcaggtggtggagacgaaaggcggcggagtcggagggcgtggcggtgcagggatgcggccgggatgagtccggccggctgcagggccctggcgcgccgatggcgtccgtgtgtcgacggtgaagacggcacggcagagggagcccggcgacgccggctgtggacctcggcgcggtgaagagacggaggatgagccggcgaaccggctgagtggatctggaggtggtggaggctggcgacggctcgggatccggcggtcggcatggaccgagcggctcgggatccggccgtcggggccgcgccggcggaactcgggcgacggggctggagcagagacggacgccgtggcttccaagatcaccagatcgacgtagctgctgttgactcgacgaaaaacgagccccgccgaggagatcgatctactcggcggcgcgacttgacgaagacgacgtaatgacgaagacatgccgtccaagaagatcgagatcgatcatctcatgacgacgacgcagatgcgaatgacgaacggaaaaaaaaacgggtggccgccctcgttagaaacaatttttaaatcaacttttaaattttctaatatttaattactctcaaataactgttacgaactcagtttgtgctatcatccatcaaagggatcgggctgagttctttctccaattttcctaactcatctccctcatttttcacgcgcacgttttttaaattgctaaacggtatgttttttataaaaattttctatatgaaagttgctttaaaaaaatcatattaatcgatttttcaaaaaaatgctaatatttaattaatcatgtactagactgctccattttacgtgcgtggaacgaacacagcctagtccatagattttgggcaaatgagttactgacaagctggtacgtgcgtactttcacctctcctgaaggaatcgtaatctagcgtgcagtagtgctggtaaactatcacacatcatgcatcttaatgacgcccctaaaaccaattaattttctaacagaatctagctttgtggtaccatactagtttcttaatacagtagtatgcgtaatcgtgcacgaatttcacaggaacggtgagaattttcccgtgtttcatcaaaccaaacgtttgcattgtatatttccatgcatagcgttcatgctgaagaaagagatgcgtccttgaatctacgctcgattgcttacatgttttgttttcttaccgtgttaccgtttcactaaatgagtatctcgcgtaacgcttgtcatgtagtactaatgtgcaagatagtaactccactacttgaaatcaacaaactcactcgtacgttcggcaatggcttgcacaccaatttcaactttttcacggcacaactcttcacataggacaataaacttttcgcattgcaagctaatacaaaaaacacaagaactaaacagaagcagagtatgctagaagaaaagcaggggaacaaaatcagtgagagagttctgtacctgctaggatggaggcaaaaactgcaagtagcaacgccatgtcgagcatggaagcagctgaagacgccattctcaagctcgactcaacctgtgacatctgacctgttgttgcttcttgcagagcctaacggccacgagcagaagcgctactactcccggcttatataggaaggtgagaacaacgccaaaatgtgtttggctcatactggccaataggattgaattcttagtctgaattaactttgccatgttcaaccaattcatggatggatggacaacgatgacttcgacaagaaaaaataggcaggagatagtcgaaggtcacactctgttcggtacaggtaggcagtggcgaagacaggacaaaagtagagcaaagaccattagccaaaggtaacatgagattagtgagtcaaacacatctctaacactccgagagtttatatttggtacatctatatttgttcagtgtgaaaaaccatcttgcatcaaactgtttgtcatctatttccaaaactgggtctcttagacaatttaactatgtttttgtgctcatcaaaggaaagccaaggaaagcaggggcctgactcttctgaccaagttgttacatcgaccttgcaaagggtagagtgaagatctcgtcatgatctcatatcatcgtgcaaatatgtgatttcattttccatatgcatcagtgcttcattcttagagtataacggctatgtaatagttttgttctctccagattctgtaacaccactcgtacgaaattactcaccaatggctaacatataagccgtttgattcatatatattatatgtgccttcaactttattcagctttaatcttacaagaccagtagttcagcctaaaaacagcaaaataatctaattaatccatctatgtgcaggcggcgcgtcccaacctctagtctcctattaccaattgcagcagacttggactaatggaattgcttgaagtgaagaccagtgaacaaaaggctttacacaaaaagaattgttgacctctttcgggataaggcccggaagaagcagggattgaaccagggcttgttgacacagcagatatcaaaagcctatgttatctcattttcagggaccgagcaagggatgagcgccctctgatctaacgtccaaacaaacaactgcccttgttactagaaatatgaagcgtgctagcgcgcacttcctattaaccaattcaccaattttaagatttgtaaacaaagataataggagccgaagtcaatcccttaaaacactcctccccgaggggacgttatcggtcgcttcgttcccttgtttactgatctcttttcaggagataggtctaccgttgcaaactcatctgcttgtaaattcattgtgtaaaataactcgtaaattcattgtgccagaattgatcactgatcaggtgtgatcagtctcatccgtctaagagactgatccggtgcgatgagtctcatccgtgtaatattttggaattcctcttccaactcgtcccggaatgggcgttatggcaaagaacaagaagaaaaagaaagaaggaacttgtccaatagtaacaaatggtgcctccacaggttgacatctgatccaacctagtagtaagcaatccgccaaaagcaaccaaaatattccttggtgaatcggtcgaaaacttgaactacgcacatacatttctttaaaaaaaggtaaagccaagagatataaaaactggtgctattgcggctacacctggagtgagcccacaagagcttttactgtaccagttccgaatataagaaggggctcgcggattttaacaggttaggcttaatctacccaattggaaatctcttgcagtagcttttactagaaatccatttctcccacaaagctcctgtgacctaaccatctagatagaagcctcgcaaagagtatatgccgaaaatcctatgtttggagtgaccatgaacactgcttgagacccttctttcgtgagagttgtgattccgctttcatgttttggattgagctttaagtggattggaggcgggcattttcatttcaacgtagcagtagggaaagtgatttcggggggttagtacacatgggcagttgggacagttacaggtagttaagttcggtcttattcttatgggcaagtggtcctagaatctctctttccttctctaaagtatagctttatgaaactagaatatgagtaaatatagaaatagaataataagaatatcatatagccgtgtattggttttgatcccagttttatcctacatggcggctgagtcagcgtgggacccacgtggacccacatgtcagcatgccacgttatctcttctttcttcccttttcttctcttttctcttttattttcttctcttctcttgtgagggtaggcggaggcggaggcggaggcggtggcgcacgccgttcagaatgaccgcctccccgtgcgctccgtgctgcagatgctcttttccgagcacggcaagctcaaccgcctcgccgagctcagcggcggtgcctccttcggcgcgcccagcctggtattcgacctccccggcgcccgctgccctccaagcgcgaggtgctcgcccagcaccacgagctccgccgcctccgcgaggacttcgcccgcctccaggtacggtttcatcacggccatctccgccgccaccgttcatcaattcaaagctttgaggtgttcgtcattgtcttcgtcgcgacgtgcaggtccagtgcagcgcgctgcaggctcaggtggacaggctaagcatggagaggaggtggcacggtggcggtggcgggttcttcaagtggagcacgttctggttcggcggcatgagctccgacgtcgcgagggtggaggactccgagagcggcattgagcggcggacgccggcgagcgggaagaagggcaggggaggcgcacttgactagttgcagaaagaactctgcaaagctatgtatgcctcacttgagtactaactgttaggtttgtctattggattacctaggtttagatctagtcggtagaacactttggatggatgaacaacaatagatgaactaacaaagaggaagtgagagggtttagggatgtgaccggtcgatgttgaggaggaggaagtgaggccggccatcgtcgttgtcgttgtgcgcttgacgtgggcggcggcgacgatgctgcgcggcagtggcggtcgtaggcgattccggcgaggtcatggcgcgacgatggagtcttcccgtcactggctgtgcccccttgatcggttagggtttgtggggtggagtggcggtggcgacgaacctcgtgtcttgtgtcgtcccgtcctccacccctctttatatggcgcagggtgacggaggcccaccagccattgggctgggcgcccccgatcagggcgcgggtcaaggcccccttgagccgttgggctcaaggagagggagatccatctaacattctcccccttgatctcactatttcttttagctttttctattccatcacaggtttacatatagagcatgtttcatcgtcacggttaattaccgctggattcgacagccactatacacatctctattcagaaacagatactttaacttttgggccctatagtccaggattcataaggcttcccttaaacacatgcatgctacatgttccttgaacatgttgggaggtaggcctttcgtgagcggatccgcgagcatcctttctgttataatatgctcgagactgattgtttgatcccggactttgtctctcacaacatagtactttatgtcaatgtgtttggcagtaccacttgactgattgttgtgagagtacattactgcgggttcgttattgcagtataactttattggtttcacaatactgtcaaccacctttaaaccgggtatgaacttctttagccagttcacctgccccgttgcttcatagcatgctataaactcggcatacatagtagaccctgcagtgatagtctgttttgagcttttccatgaaatggctcctactaccagggtgaacacatatcccgatgttgactttgtattatcttttgcaaagtcagaatctgaataccccactatctggagcgattctgattttctgtgagacagcatgaggccttttgttccttgcaaatagcgcaagactttctttacaaattccaatgctctaggcctggattactttgaaatctgccaagtaacccggtaactaatgccacgttaggtcgtgtgcacacttgcgcattcatataaacaattttagccatttatatctggtattgatactgccatctatattcagggcatgtctcaacatattgccaattatcttgttatacacagagcttgaactgagataatgaagagatcgcaaaaatgtgtattcgtggtctattaaattctggccaatatcaaaatcttcaactgattttcctaaatataattttttaaccatcgcagttgtttcaatataattcccgggataatggatcctactccagatatgatggctaaaagacttgtaccgcaatataacatcgttactttaaagacactacaattatctgtctaaactgaagcctgaagaccatgaggttcgtctctttgaatgaactccagtatccaaataaatataggggcaaaaatagaggagcaacaaatcaataaaaaatcaaacagaggcaaatgcatgggaaggaacatactggcacattctcattccttggtaagaaataaaggaattatagaatatatagctttgcattgaccaagtggcttaggtataaaccaactggcctgttataaactaacaatattatctgaatatcatctaatacaatattcaaccatacttcagatttttaaggtaggaaaaatgtactgacctccctccttattcagggtgaacaccttattccaagtccatgtatagatcaagaatatagagaaaatacactgagaactacaatgtgaagaaggcaggaagaactgcccacctaatgatctatcatacatatatcaggaaagtgagctagtaaaaatggagatataaacaaatggtacttttggacttgccaaattggaacactggatgcaataatatgtcaagattgtcaggttcaccgagaatctttgatgtcatcagaaaatttaagctttgccgggtcatatgtaatacttccagattcaagtccatgtttagtgtcttctatttctttctgacagcgctgctcatttcccatttgcacacctgataagaagcacaaaagggaacttattaccaaggatgaaagctgaagaacttagtttaacatggcttgcatgttccatttggaaaataaaattggcttcacctttacactcactataacaacaaaaataaccggcatgtatcatggaactataataatgtacaccccagagaagactgtctagacctccaaacagaaaataacctcatgaatactttggatgggaaaaatattgttcagtaggtgccaacaaactaaaacggtgaaatgtaaaaggcttagaagttggtaatataaattacttccaataaccaaattgcacagtagataacagacctacaacatatttgtttggttcaaagcacattgtagtcaatatagcaaattttggttgtatcaaatattgagaaagcctatggaaacggaattcatggtactaataaacctgatatgcaaaatgtaagaactaaccaattcaaattacatatggatattttgtatccttagacaatgggtaattctaaagataaaatacagcattgcagttattattatagattaatgacaggcatatatgtcactcttgtgttcccaaccaaaaagtacatagagagctagaccatggcaacagttcgtattaatactgcaacactaatgtgcaaacaggtaaaactaatttgtatagacaaatgatctgttaaaactcatgctcaaagaatgaagaagggcatctaggagacaaaccgaatcataatatcaatacactcaattcatatacaacatatgcatgacagaaggagatgattaatttgatctgtacctgggtggtgatgtttaaacattagtactgaataatctagccttcactcccttttttctttccttcctaccaatcatgtgaaactcacaatgagcagcaaatcaagaatagagagcaggcgctagaacagatatgtatatatgcatataatagggagaatcaatgttttagcagtagtcatgttgaaagaatgaagaacatctaggagaaaaaccgaagcacaatgtcccaatttacttgcagccgtcgtcaccataccttgccatagtttgtgccttgctgccgtcgtcgccgtactttgccatagcccatgccttccgccgtcgtggctttggtgcccaagctgctgctcttgctctccccatcctggcaccgaggggaggtgagcggcatggagaacgggtgaggaagacagtggagagtagcgttgtactgccgaagagggccacgaccggatccacctggaaagtcgagggaatcggacttgggatcgcatcaggcatagaggatagggtgagggagagagaggctaacgtggagatgagatgaaagaggagaagaggagtgcagtggctcgcatccctctcgtccgggcaaccgacaatccaccagcgaggaggccgctgttgccggatctggaagccccgcctcctcactggtggacatgacggactcgcttgccggcgcgggagcgcgggcacagtaacaatggctggatgagggcacgagggaggcgaaggacgacgaagctacgacagcgacggcgcgcgcgaggaatgaagagaagagggcatggcggcgcgcgtgcgagaggaagcggcgacggcggtacggcgagatagctggagtaggttgaggccttgagggagtggaagaggagggagttgcggcagtgacgacgcacgggagtgaaggaggagggcgaggctgcggcgcgattggaggaggagggcgaggcggctagggtttgttcaggcttgcgaaatccacaccgtccgttagagatccgacgatcccacgggtgcggaagggccagcacagtgaggaacgtggacggccagatcgaccctacctcgagatcggacggcggatattagcggggaccggtgcgtaattaaccaaaagtgtagggttttttttgcaaaaattgctgatgtgctggtagtcttccaccgatcgcacggcttttaagtaaacctatattccatccttccataacgttcaatttaaaactcaatctctcaatctacaaattaagaatgtattctttcttataccttatagtttgaatttaaacatccgtgtttatatttattttgtagtttgcatttaaatttacatgtttatattttaatccatagttgtatcgagaagtatggacttactggttattagtagaactagatggtgatggtgctgcatgcaaagcgcaaagctttcggtacgtagctgacgactacacgagaacgaattatttggaggcgtcgaacagataaatattagtactatactagaaaatctcgcgccaaatggcgcgccccatttagcatgttcttatgcatgaacgtagaaatttcaaaagatttggtaggattaggccaacttcattaaattgttcatttaacatgtagatttattcaattaaagatcatcatattttaatctatttatggcatagctattaaaaagtgtttttttagtaagtctacattatttaaaatgtacttattttaaaaatattaattatcaagctttatcttcagctaaataagccatggtctttaaaaataagctttataaaatggactgtttttttatgtaagtctacattatttaaaatgtacttattttaaaaatattaattatcgagctttatattcagctaaataagccatggtctttaaaaataagctttacaaaatggacatttttaaataacgaccgtactcgttttttatatatataaaaaagaccaaatcgaatttatgataaaagaacatcttttcctcgttcaaaatataagcattcaaagtttatatcagaatatagcaattgagtatccagtcccttgtctcaaccaatcataatatttcttatttaatttttccacttacccacctagtttatatttggttaatatttcttatttaatttttccacttactcacctagtttatatttggttttcaactaagaactatgtaataatggctatagcttctattgaagtaaacactggattttatccattatctaaaaactcacctagtttattaatacctatacccaatttcaaataatgttttagaccttacaatgacggggcatttctcacgaaagtagaactaacaaaaaaaaaattctactccaaccctgaaaactttatttctagcaattctcatgcaaatttgtagtggcaagaaatatcctttgcgtccttatcaatttttaaattttaattaaatatgtatatataccttgatttgattggctaacagatgttcttataagggagtacgtaacatatcttttagtatttgattgttttttttacttgacacagcctattaaattttaatcgctctttattttgcaaaagttctataaatattgtataatactagcaaaatacccgtgcgttgcaccgggtaatgatatggtgactgaaatttgatttgaactatttatatgaagaaaatgaattgtaatttaatgaaatataaaattttctgcaatattaattacactcttttaaattatagcaaaagtgatattgcgttgcaacgaatagaaaaaacagataaagttgaattaaaacatattaaattctaattaaatgaaatataaattttctgaaatatttaggtattttttaagtaggtaggtatacaattaaattaatttataagtaaagtaagtgtaagaaataaaatgttgtggttggatttaacttttattaaattttctatattaattacactcattgaaattttattggaatttacctagcttaattgctaattttgataatacaaatatcatttcagcatttattgaaataaaaatctaaataaaaatccttttttctctatgggcctttttcaacccattttcttcttcagcccgcaagagaccaaagtctacttaatacccccatactcctttcatttagtggaccgcgggcccacgtgcggcccaaaccctcaatcgatctcagccgttagttttgatggacggctcagatcagattaaaattgatgaaaccctaaccctaaccctccccccagccgagccgagccggccgcctcttcctcccccgccccgacgccgcctctccccctccctctccccaccggcgtctctccccctccccccagccggccgactcccccgccaccggcgccgtccctcccttctcgccggcacggcgcggcgatggtggggtgcggcggtgtgtggcggcgccgccgccttcccccaaggcgagcggcggcggcggcgccctcctccccgcgagcggcggcggcggccactctctccacttcttcccctttctctttgtgtggcggcgggagggccggcgacgccctcccctccgctagatcggggggaggggatgtgcggcggagcgggagaggcggcggcctggacgacgtggagacaggcgtcggcgccggccgcctttttttttttttgcaattttattccatggctattgctaaccgaatcggattgtgtatggacgaaaattagatgtgacgaccggaaaaacacgaatatttatattagttatagattttacatgttaaatataactatatcttttgcatccatcaaaacatcacaaaaaagctgattccggctatcggttggcaaaagtgaagcacttattaactctctttattattttattggtcgatacttatcaactgcattagtgcaaagagataggtaaagtaatgggttttctagagattctgatgtgcaagggacatcacaagagcttatatctgattgacacgtggcaaaaattttggtgatgtttagctaatttttcaggctgccacgtggcccaataacattctagaatcatgaccctgatataggtagaagagattgctgataaagaaaaatggcattttgcaacacatttaacttgttcagtgttcaagctaacgttgaacctggtacaagtacaacatgctggcacgcatgtccacatctcgcgggtcgagggttcaagccgaatacaacacacggcatgttgcatttcatcataatttaaagtacttagcatcactttgaacaaggttttggtggtcacatgtatattcgcaaccttcttaaggtgtccgcaaaagacgtgcgcagcataatactttgcagacctatggttatcaacagcaacatgccactaggcacctgcacgaagaaaaacaagaaaatattactgtaaatttaaacaagtgaaattctattgaggtaccctaacaacttgacattacgatatattgctcaattaataatataggcgtcacagcaatgatttccacatgttcagtaactgtagactgaaacaaaactcacgacatacctttttgctcatgtctttagcaccttcgtgagcattctgaatgcagcagtactgtaccttctcgattcatgagtaccactcagttgctgaattcttcccaagaaactaatattatggttcagactcgaagactcgttactcactactgaattacggaactgtggacgatgaagcattgacttctcatctgctgctccattggatacagacagctgggcccctaatactgatctccagtaggggaaaaaatttctctttatgaatgttggatcccatcctttaagtgccttttttctcgcagcctgtcccataattaaatgaagattaagctttgtgaaacccaaaaaaaaattgttaaattccagcttgatcaaccaaagagcacttgattcacaatattttcatatatcctgggagaggtgttttacttgagcaacagaataaattgttttctggttatattcaagtgatgtcaacaaactgaattgcttaagcaaaagcagctgaaccagtaagcagctgcacggcagaaacataacaaccagaagcataacagacatctatcagcttgatttattaccatccaactacaaaaggactaatcatactgagttcgttcattctaacatcttaactaggtcatgatcaaatatcaaaacaaaccattgcacaccaaaaatctatcgcaagaccacacacacacagaaagggaggcagatcaaatctaaacacaatacttaaagcaaaacattctatctcattggagaaaatcaattattttcagattgttgacagtactataatctagaatgacgcactgctgtaaaaactgccgagcaaccttttaccaggatagagaagagaccagacatagagtttctacttttctagaatcccaactacaagataatgatctggcaggcactctggcttatatgcaccagccagtaagatggcaactaatagcaaacctaacttggaacctaagtaactgatcattagctgctgctgctccctgcatgctttggtacatcatactccccacgcattgttgcacaataattaacaaggtgaatataagaaatcatcattggtaacatcggaatacaattacctttttttctgcagcaggcagagaagtagacatttgtgcaacagccttggttacatctatatgaccataaaaaatttaataaaggctctttctgagaaattcagaaacagttacttaaataataaacacacacctttgtgaactatgtcgctgtaagaaatcttgttatatggacagcttcaataacaagtttaagaaataattaataaacaacaaacatttgcatagaaaaaaaatattatattgaatacaaaaagagcagtacaggatcatggtgtcaatgtattcttcgttagggcaaaacccgaattccttaagaatatatgaaacacgcgcaaggacctccacattgggcacctgaatgacattagaaccattatatcagatagtgaaaaatgtcagaaaatgaaacataaaaatagcatatattgataatatggtcatgtagtacaatgatatcattggtggcaaagaaatgacaaaaaagaatggtttagataaaatttaattataacagatgaactgaaagaaggtagaacagtttgcaatcacatcgaatacaagcttacttggtaaaataaagtgcatatattgataatatgatcatgtagtacaatgatatcattggtggcaaagaaatgacaaaaaagaatggtttagagaaaaattaattataacagatgaactgaaagaaggtagaacagtttgcaatcacatcgaatacaagtttacttggtaaaataaagtacatatacaaacatattcaaaattacgtaactatttctcttcgtttgccttaactatattcaggattaggaaccaaataatacgactagatggttcaaaaggtacaaggcatgaacattagtcattcaaatttcaacttggtaactgtaattgactataaattataaaaaggtaaaagtctattttttggcatttgaaatttccttctagtccatttttcaccctgaactttgaactgggcattatacatggtgcattaggcagatgaactaccttgggtggtgttctgttgctgttttagtgtaatttttttcaatattttttaatgtaatgtgtttgggcctaggctcatagtgctttcttgaagcatatgccctgaactaagaaactagttgttttttaccccaaatttataaactggacaaataacacactaaatcatatttcatggtggacaacatgatagtggttctcgctaacatgaacttcatcaggtcagtttcattgttgtggacctaatcatgcgacatatatactaccaaaatatgcaaaatatgagcctgcactagggaaaatcaccactaataccaatatatttttttaacttttccaacttgtttgtgtcaacaatatcaaaatatcctcagggaaatgtagtcagcttaagacaataacaaaacctattggttgccacttgccgccatgaaccaataattaatacgcaaagtatttcgttttttgccgttatgtgctgtgcatcaagaaaattcacaaggagataatagcacacaagtattcatgaaacatgcaaaagttgcaatggccaacatcactaaaatatatcaaaaagtgtacacagttactctgtatatgcctgcgctgtggttacaactacgattaaagaggcttgttgcatctctaataaaattgatataaattgacatttttatacaaagatttcgtatacatttctgtaaataatgttaaatcagttttggttacttgaagcaaaagcaaaaaacaactcacataatatccaatacaaagttgaattgaaatgcaataatatttccacgctataaatcactaacacaaaaggttgatacaaatgcatgaaaattttattactatttgagatttgtttcctaaatcatctccacaactcagatattagaatgcatatcagcatctgacaggaataccctaaagttgttcttttggaagggtgagccttcagaacctggctcccctaagaagctagtagttgttatgaactggtgagtaatgctataacaggacaaattgtaggggatatggtactagagttgggcgagggaggaaatttcacagggattacttgacaaatggcatgccccaaataatagtaccaatcaccagctagagtctgctacaggctctattcagatactatctcttacaatagataagacgacaaaaggttctgacattaatgcaccaaaacagtttttttgttatctttcttttcttttcttttatctatcctcatgcaacaaagtttccttttataaacgctaagagtcgatgttaagccgttgttaagcttaacaacgatgtttcaccctcctttcccctctcatccatgtcagcaaactttaccttgttaccaatgctaagagcctgctattagttgctgttgtatacatgccctaattcaaacctatctcaaatcaaccagaggatagtaatctaatttaatatgtttcaaggatagccatgactactcaaaataacccaaggtacagaagctcctgcaacatgctaaggtcacatccctaacaatagagggctccagcttctcaaagcagcggaggctcttacgtcataactcataagcttcattagacagcttactcttgtgatggttttaacacaatgttgaagatagataaaactggactgaccgttcactttatgctggatatgctaccctatagtacaagtaacggaaagtggccacggaaatcaacaaatcactagcattcttgttaggatcagggcatggagccatggaattacctattaaaatattaataccaatatgaaaaaatatacagtgagtaagagatcatatggtgctgtgattttacaccattaaaaaaacaatagtacctctgaatgtgcttgaatgtagttatccaaaacctcaccagcttgcgaaattatagtgacaatcagacatttacatttcaaaagtgctcttctttcctccagcagcttctgcccctctgcagtatcacctttatcacacactagggaatcatagtcctcatatatacgttgcgcgataatgtcgaacccatcaggtttgccctcacggatatgttttcgggctgccaggagtaaaactgcggattctacaagcttgtcattcttcatgtaattccagagctcatcagctagattatctgttttttcagcaagcagtctaactgtatccaaaaaaaccttctgcacaataaaaagaaggcaaaggaatgaaatctaaatgactttgagcatttgtatgcaagcaagcagtgaaaaattacttcctattacatctcgtttccactaattgtagcaaggatgaactaggatcaagcggaataaaacctactactccctccgtcccataatataacaacctaggaccggacgagacatttcatagtacaacgaatctggacatgcacatccggtcctagattgctatattataggacggagggagcatttagctatttcctctgttacaaattactagctttatccaaagtcaaatatttatatccttgaccatcaatttctataaattcgtgtgttttaacaacatgcaaattatatattatgaaagtatttctcatggtgaatataaaaacataaatcttaatgtgttaaactatatgaccagaaatagacggtcagatacagatagctcacttaggacaaaactacaatgactagaaaaggagggagtaatggaattttgaactgctgacttcttgcctctaaatttgaaataagaaaatgcctcagcacatgtgaaaatttttaaaagatgacaaacaggaacacattttgttgtcatgctgaaaagatgatactttggaaagagcgttaagtgaaacaaaccatctcaggtagacacagcagatgaatgagcttgtagatataatcctcatgatactgcacaggagatagattgtcctccagatatttatgcaagcaagtatttccaactgcaacatggagcgggagtagtccgggaatgccagcatcattgactgtgtgtaaattggctgaagcaccatggcagaacagcaacttgatcatgtcaacagagaaccgttcagcagctccatggagtggaaaaattccatatgggttaatgcagtttggattggcatgcatacaactgagctgaggtgccttgccctccaatacagttttcgcacatcgcaaggcattatgcctgacaatgcaggataaggtttctgaggtgatgttacacttaaatgccatggccgcagtacattccgcgaacaaacggaagaagcaccggacactgtcctttctcaagacggagtccaagcggggagatatatcaaagaaggcatcccgcaccacctaaattggtccgttcacaatcagaagagatgaaaagaaatcagctttcaatgtaataaagcaaaacataaagtctcattgacgtgcaccttcatgacaaaacatttcatttcagcaaagggcaccctttttttttgagaaaatggaagagacaacttacgtaaactaaaatgctgcaggattaaaaaaggacaaacgtaacaggatgatctagcaactgaattctgtacatgaagactagagagcaacctgaggggtagggtctgggatgattatatcatttgttaaggacttggccatccaagcatattttattttaacccactggaagagagaatgtcagcagccaggtaccaatggaagacagaaacctagaggaagagtgcagatgggctaccatacctcaccagccttatccaaatcagacttcttgataactagaaaagggcgggacgggtccatgttatctacggttgctccatcttctttacctttaccaacactttctcctatgaaagcatctggcagaaaatgatcgggaattttcaccactatatgtttgtctgtaacaaggaggattaatctctagttacattcaaaagaatatcataactttgtactgctagtaatataatataatatacaattggtaaacaatgatccttaagactgtgaagacaaaataaatgatatttaggacatggacacgatctacaaagtggcacttaggctagcaatatctatggaaacatgatatttcaagtaaagatgattaaatattatgagtattttccgtgatgaatatactgtcaatatgtgcagtactttatatactgatggtcaaagttaaaatagtttgactggtaggaaccataccctgcaacaacatatattttgaatcaaacggcacatgcatcactgaaattgatgaattcattgaatttccacccccacagctggatataataatattgggtgtaatagtatagaaacctatacttcattcttaaagaaggcagtggtggtggcagtgaatctgccaccacaccaactctgttgtatagattatttcttttaccaactactccttcgtgttttaatattacaaaatagtccttctacataatctacaagcacgaaactgtccccaaaacctcgcaattaatttgttccaagcaatattagcacgcgtttaatttattttaatccatcgcaaatcacagatatttatctagtatatgtgaaatgaacggtaaaaagaagtttttcacatactagttgaacgagtgatgtgtaaaacttatggaaatcgaacaaatcaaaaaataagattgatgtttctgttcaacaaaacaatacctcctgctgtactagatacgccgaaaagaaatcaaatcggtaattaggctctgaatgtttcagaagagatcagaattatagatttgacatttcgacatgaggaacagctccagatctgagggcgattcgcaaataattttggagatggaagagatatacaccgtagaagactccgagttgaagaagaagaagaagaatgggaaagaagtactgaaataacaaaaattggttgatgtaactattaccgagggccgattccgacatgacctccttgctatgataaagattggggctttcctggatgagtagaaccagatctccagatgagatgaagggctggcttataaaatagtggtgggatgtaggaaagggggcggtggagagttcgccggaggcgatggcggtggaatgagcacctagggtttctttatgggaagatatttgtgatggggaactggggatggtggacaaggaagaaaaggatatgatcaagggctcgaggcccggcctgagtgcctgacatgttgcgggctgtaattaagcgcctggccaggccgagaaggcccaaatgaacttctttcttttctttttcatttttttttaaaaagtccactttaggctatgaactatgtagttttatttgagtcccttaaccataaaatctgatataaaactcccttaattattaaaactagttggatgacccgcacaactacacggctatcatcaatttaaaattatctatttttacacataattttatttaaaattattattcatgctattctaataattttatagtttttaaaagcaacgccagtcgctaccctttactcctttgtcacatttttatttgcttacttgatctatcactacttctattcatcctcttgagaactttaaaagttaggccttatagtttttagagtaccttatcttattgggtttcgtttacataatttttagaagtatcgtcaaacatcgccaatttactactctacggccatctgttgccacctcaatttattgtcatcgggattttaaaaatcaaatataattattatttgtgttcctttttactttctataagtctcgccaatcgttagtggcttcaccaatatactcctctacagcaaacccgctgcttccccttcttattgccattgacattttaaacataaaatatgattatcattgtggtttttttaattatccataagtcccgccaaccgtcgtgaccatgctgcttaacggcatacctatcgtcactcctcttaatcatcattgtgattctatttggggttttgtttatagtttttgttgatatcccatcaaccaccaacactctactgctttacatgcctattgcttctcccctttttaatgctatttgtcatcgttgttttctagatggactttttttaaaaaaaattgcatatttttcattccgataatttttattcataaattatattcaaacttcaattcttataatttttttcctatttttgaaaattattttatttgttatttcgaactttagttaatctcatcatgtgttctagattgcctcttaattcaattgtctttatttttttcttacaaatttaagttatttataaattttattcaagttgagctcttatttttttctttttctatcttttgaatttattttattttttattttgaattttaattaatctcgtattgtgttctatatagactattctcttaatatttttttcttttttatttctaatttcaatggtttagttaagataaaatacactgtgggatttcgcttggatatatatatttttttagaaaatcatgagctgtagttaggagtccgatcgtctcaagttagcatgcgagttttttaaacatatttcttgcatgattctttcggtattaccaaaagcgaacgatcttaaaaaccgactcaaatacggatatgtatttccaaaagcaaacaaacttaaaaaccgactcatacacggatgacttaccaaaataccgataaaaacatggtcgttaacaaatttttataatagtagagaagagatatagattaatacaaaaaaaaaaccgactcaaacacggatgacgaaccgtggaaacatcttcaattttttataaccgactcaaacacagatgaccgactgtggaaacatcttcaatttttataatagtagatatttggattgtttcaatattctattcctacttgaaatctctttttattttttttctaattctggattttatttgttttttattttgaattttaattaatatcgtactggtttcttgtatggactcttctttcaatattgcttattttaaatttcaaactttagttatttttaaattgtatttctatacgaaatattcttttattttaattctaatttaggattttattttatttttattctgaattttaattaatctcgtattgggttcttatatggactcttctttcaatattccttatttttaattctgaatttcagttatttttaaattgtatttctacttgggctctttttttttctagtttctaattttattttatttttatttaaaattttattaatctcgtattgtgttcttatatggactcttctttcaatattgcttatttttaatttcgaatttcagctattttaaattgtatttctacttggactcttttttctttttctccgattaatgtgggaatttcttgcccccacagcgatacaattgtattcctaattgaaatcttatttttctttttctaattttggaattttttttttcaaattttaattaatatcgtattgtgttcttttaatatttttattttttattttcaatttcagttgtttcaaatttgtattcctacttgaactctcttttattttttctatttttggatattattttattttttattctgaattttaattattctcgtattgagttcttatgtggattcttctttcaatattgcttatttttaatttcgaattttagctaattttaaattgtattcctacttgaactcttttttttttgctaatttcggattttatttttatttttattcttaattttaatttatctcgtattgggttcttatatgtaaacttctttctatattgcttatttttaattccgaatttcatctatttttaaattgtatttctacttggactctgctttttttttctaattttggattttattttatttttattttgaattttgattaatctcgtactgggttcttatatgaaaacttatttcaatattacttatttttaattccgaattccagctatttttagattgtatttctacttggactctccttttatttttttttctttttctccgattaatgtgggaatttctagcccccacagcgaacgtggtgcctcctttcaaaactgttttaataatataatcgatagatagatatatagatatactagtgcaaatcgagtctcccagcggtttagttaggtggttttgtcccacgtgacaatggtaaatcgtaccatgaaaattgaaagaatttcgttgaatctacctcccatcctttctccttttcttcttcctcattcctctatctccccatctctctccaccgtgcacatgtgggtcagcgggcaatggagacaccgatctggtcggagagcaccctcagccatcgccgtcgcaagtggcaagaagagacggcgtcaccattttcctcgcttctcgttgtcatgttgattacgctatccttcacttagatccagaatacgccgatggctgaggactctggagcactgtctgtaattacattggtgatgttcttttcttctgaaaataaagatgaagatgaagaatacgttttttacataaaacaaggtggtattaacgtatgattgattgagttttaattattacaaacttgaaaaatagattaatatgatattttagagcaactttcatatataaatttttcgcatgaaacgtaccgttagcaatttgaaaagcgtgccacgaaaatcttaatcttcatccaacttttattggagaaaagaacgggaccattgcccccattcttgtgaacctcatcatgctccagaacttcttctccggcgcgctaccaaccgatagtgacgggtgattggctggtttggtggtcgtcggagatgtctcccttgattgttcgttcttggatgggtggtagtagtcgggttaagcaaaaaaaaaaattcaaagattgaattaaggtagttgttatcacaacttctttttgcttggatggatgctattgtcggtgtctccatttgttgcttggatggtgttgatggtccttaagtaccaaattcgatttatcaattcatgcataataacaattgaaagaatataaaatagaataccaaacttagaggtagtagtcttggtgaatatttatatataggtaaatatatggacaaaaatcatccgccatgtgaccaaatacacctccggacaatcggacacgattacacggtttggaggccccacgtgtcaatcaaaaccacctaaaattgagtccagccaaagtacaacatgttgggggcccaccaggcagcctcccaaccgaatgagtggccggtaggtgagccagaagttcggtcgaactgcctttgcatcccctcgccatctgccaacacgtggagcaagatactggagtcctaattgcggttatgtgtggtttctgagcttaaccaacccacaaaccatcattacaactaggggtggcaacggggagggtcggggctgggttggacgggaacgtgtcacaccctgatccggcaccgccgtacaacggcacctgacaggagcgtgtcgtaggaaaaacggcgcgaaccgcttcctacgaaaccgcgatcacagtaccagtcctaggacatagcgctggtacccacggtgacaaatatgaatcattgcaatccttaaaataaatagaggatttatttaccttgacttaggttgcagctcgggacaacccgagaatacaaccgacgacacggacgaggcaaacaccaacaacagcagcagcagtggaaccaacggtctaacacccaacaccacaggcaatactagggaactaggacgaaaccttaatcttcacttcacttcaacttcaccttcagagctggcagaactatatatatatagagcaagggtgagtacttatgtactcagcaagccagggggacttaggtggttaattcaagcttcaaggaaaggctgttattttagcaatcaaatttgttttcaagttttcaacaatctaagtgtgtgctttccacaaacagagcgagacaagtctcagcttggttgggggcgagacgtaaccaaatttgatttgcaagatttacacaactcccagagttggcctcaaagttggtttcccaaaccaaaccaattttccaatctttcagagttttggttgtctccaaacaaccagtcattctcagggactccctgtcccgctgtctccctgacatccgcttgctttatccaaacatcaggtttcccaaacctcaacatcttttcacaaagctgggtaaaacaaaaactacgctaaggaatcacctcacatccgcccatgaccgtgggcatggctgttcgaacagtttgttaacctctgcagagggggtacactttacctacatgacgttactagccttggtcacctagcccgtgcggatcaaacacgtctggtgacttggggctttcacgacaaggcatttccaaagccaacacagggttgccatatgccaacgagaggggtcccggaccaacaacaggttaggtcccagaccatactgtgccatgaagcccaggggtcctccccgacaccaccccggcgaatccacttgtctcttggcatcaaggcttccctggcctagcttgttactcagccaggggtgtcccattccacccatgtggtcgcacttgttatatgctcggatgtaattccaaaggaatcggtccttaaatgtgaccgcacaagcattccgcccaggaatggccttgtgtcgcgagttttatttttaaaactcattttctttcacaaggcaccgacccaggcgtcgggttttccaatcctttcgtaaaccaagttttacccaagatgtttctcagattttaagttttaaaggcgaccgtcgatactcgcacagagtgtatgaataccgaggcgcaaccaggtggttacaagggagcatgatatagcaattaacaatggaaggatcaaatgcaacaagttaggtaggcccaccaatctgcctcgcaggcggggcaaacatattaagtgcaatcctatcaatgaataatattttacaatcaatataattaagttcaaatataggctcaagatgttcaaaggtggcttgccttgctcagggtcttcacgaatcttcgagaaatccgcttgacgaaaaatatccggtaaccgcaactaggcgcatacaatcaaaaatctaaacaaggaccaaatagaaaaggatcctatttagactaaaataatagtgccattagatagatcacaattttacggaattactggaagtggaacgaggtcaatcggagtcacggatcgggagatatgaatttttggaggctttaaatgaatgtctggacaaggaaatgatttatttgattctttggagcggggaaaacaatttgtggaaattttgtggacaagggaggatatgtacttatccgatgggaataagagaaattatttacgaaggttgtttgaattttctgggaggaaggaaaatatttgtggaacaacggaaaaaggatttattgaattttctggattaaagaaatgatttattgaatttgtggaaaagaatattctttttagtca

SEQ ID NO: 59275 - DNA, 27747 bp, Oryza sativa
aaattgaggtaactctttagtctcactaaattaaatttatattggaagcttatttgcttatgtaatatttatgatcggcatcaggatttaaaccttagtgatggagtcattccctcattatgatccggtactaaatatggcatgttttactattttcagattaaagtattttataatggtctttgctggtaaaaaaataaatctaaaccaatcatcctctcttacttactgaattatattttttttgagaattgtacaattgaggctcttgtaaccctgttaaatcctgaaaaataaatcctaaaaaaatcgcttccattaggagttggacctaggacctcaggtgctactgagactcttgtaaccactaggttacaggccctttcacttttatttactgaattatgtcttataccaccacttaactaccggttgtagattttttttattaatgacagaagttaaaaataaatagttgtggtcaataaaatagggagcatataatgtacacacaattttttttgtacacaccgtgcacacgaactaacaaattttactaaaaattttagaaaaaaattgtatacgtacttccaataatactagccacgtagtcacgctttgtgcgacttttgattttgtttaagaacttttctatatggtctattagtttaggtaaacttataagaaggttttaacataataagttattattttacaaagtatggacttccctagccaactattgatttagctaagttgtactatatgtttataagagaaatcactagaaacctcatgtttcttctctctttatcccctctcttttttatcatgtgtctaggggaggtaccagaaacctccggaaatttccatttatttagctcatctgtggtttgtttatacatgtacccttttcatccaatgaccattgtttatccaaatccttcatccgatggctaatatatttataatgatgtggcacgttctcgtgtaagaaagcctgctgctttcattatataagataagataagattacacttacgtgttaaatattaacctcgaattaattatattttggccataacaaaaatattctttttacaatttaagagtataaatctatcagaatttttttctccccatatataagtaatgaatttgaattgtgactttagacatagatataacactactaagggtagatgtacattttttagagtttttttttcatattttttagttggtgtatatggtgtgcacacaagaaaatttgtatgtataggatacgttttccaataaaaaatgctcgatttattgaccaaagttataatatgaatagtcatcggtgatatagatgtattatttatttattttttttcaattttgtatggaataagctgagcgcgatttctctaggtgtgtgatcgacagcgaaaccttgaaactgtcgatgattcctctttgttccaccgtgcaacacaccaccggaccgcagcagattgcaagttgcaactgcagcatccttaatcaactcaataaaaaaaaagcgtgcgcatgttatcctagcgtactaaagtactaaccttaaacaaggctgcgtttgaatgtaccatgacctttgaattatctctcatttttcgttagcatgttaaatggcacatttcgtgaaatgatctatataaaaattgagatcatctatttttaacattatattaattaatatttaattaattatatgactcattggaacggccccgttaacatccgtgcatgacgtgcatggagtcatgtctgctgctgtgctgcaccctaaaatgcacaggtagaagcacaagaagttacgtacaactgcgggggattggttggcattacatcccagaccgggcaaatcggcaaattgatacagcgttgtgaacgtgggagggcgaacatcaggcagggtaagctcagaactcgggaagtttcagaacgtgaaccacgcgagagggagtgagtgagggacggtcggaccaccagaaaggcagcgctgatgggaagaatctgggactttgtgcaaagttgtgtgaagctaccgcgagaccgcgggacggagctgggacaatcagtacacgatctgcctttccagcggccgggcacttcagatctagtcgctgtgctagtactgcttgtcaccagccggcaaaccaaaactttttgctcactcacagaaatgtggttgattagacccctttgctgttaaagaagatgagagtgcatgttgctttctttggcgtcgacaaaggaacgaagtctcttcttgacatgaagacacccagggcatcttttgaaacacgggattaaaaaaaaagaaagtataaaaagcacaaaatgtaaaacacacatggctccaaataggtccttttcttactggttcaaacacacctctgttagtcctccctaagttctctccccctttttttttttccttttttggaaaaaaaaatctgtagtcgatcatcttaacacctgtgaaaattggtttcgcatgcggttgtgatgctcgcaagtgaatattgtgatttttcacatacacctggagctagacagttgcttcacccaccagcaaaaaatacttttggctgtctaaaaaggtttctttgtagcagtagtagaaaaagactatcaataatagatttgagtactgctgctacagtaccttgtatagtatgtgctaatgcatggaaatgcagtagtacaagacttaaacgctgcggttttttgataaaaaaaggtgatataaaaggcttttaaaaagattcaagtattttttaaaaatctataatagttaacattaattaatgatgcgataattgagtgtgttctccggcaaccaaaatgacaactcacctcacaatcttcaggggcttttggctcttttaaggatagcatggcaattgaatgccaatttatcgagaaagagagatgacacaactcaataagatttttttatgtgtccctataattttgttaacacctcaccattcttaaaaatgcttgattatggggagtaattaaattgcatgtgcggtacacagaaatatcatacatgtgcaattagtacataaactaataaaaatatttattctagtgcataaacttgtctagtacatatgaatcaagtcttcaacgatatattataactaattaggatgtctcacacacatataaggccatgagacatgttgtattcgttgcatactccctttatattttacgttttttattcgtataataaacattacttatttcatgtttgatcaagcatatgtatacgtaggtaacatcatatcatgttgacataggagtctacgtaatattccaattagcgttcaacttagtgatattagttatgacttgctttttcccccctttatttgcacataccaaacaagtttatatatatataaaaaataatttacaagttattactattctaaattacacatatctcgcaagttcaccgacactgttcaatacgtggaattgcttaataaaccggtcaaagttcaaaagtatttagagtaaactttaaaattttagcaaaatttatttgaaactgatcgttttttaatcgataactgctcggttaagttatggatgaagccactaggcagcgtttttgatagaaacaaataagctagagggcatgcagagtaaccttttatccttttatggatgaaaccacatccatcagtaacatttcctcttctttcccaactcacctcttttttcacgcacatatttttcaaactactaaacgttgcatttttttacaaaagttttctatataaaatatcttaaaaattatattaatctattttttaaaaaatagctaatacttaattaatcatgtgtaatgagtcaccctattttacgtgctcgtgggatttgttccaacaccacacgccgacagcagccttaagggaggcaggatcatgccactcattccttaccacatttagttatttttccataaagattcgcgattcactcaatgcgtgtaagattccctgacatagatctgtggatctggggcaaattgaggttagcccatatcatcttgtttagaggatctcaagttctcaactgcttcatgactctggaacagagtttatacccaatgcgatcctgttcctcagaatacgaaacagagtggcctatacgcaaaacagagtttgcaccaactgatcttcacgattggcaaaatgggaggaaacgaaccaacgaaccaacccaaatttctgtacacctgcttggatggaaaaataactatcgaggaagaactcggttagttcaagtcacctttcttccgatggtttgacctgggccgtgcctgtgcagtgctggttcatcacggagaggcccttttttcattgggccatgcttgggccacgcacctgacccacgcgtgccggcaaggcacggcgagcaggccgtgccggtccgtcacggcccatctaaaaaacgaacgatatcgctaaacatctgtcgataaatttctctcaatttcaaaagtcttttcagccaactgattttccttaagatcctttttttttgcgaaatattaagatgtgagagagagagaacgcgcgcgcaattagccggaaacccagccggagaaaatacggcgatgtttatagtaaggaaacgaatcaatccacggcacagtccaaacactgaaacacacacacacacacacacaaaaaaaaaaaaaccgaaaggaagcaggcaagcagcaccgcgcgttttggccggcgccggcgtttcgcctcctgatcgactaaagagaggaggagaggtgcagcgccgccaccccctcccgatctccaaatcctcgacgacatcgccgcctccaccacccgatcctccaaaccatcgactatagatgtcacaccggagcgtcccaggcggccgccgccaccttccccgcatctacgggccaagaaacttcaaggacgaatactccagaggcgacacgaaagccgagagtgtgccggttcttgccaagatcgcgaggtgctacgaccactgtcggttgaagtgtctcgaggaggagttcatctccagcggcggcttctgcttcggcctcctctcccacctccaacatcgtcgtcaacagcgtcatcacgtcctcttcccggcgtccggaagtcggcggcggcggcggaggagagcatgccgcggacatgttccagcggtcgctggatgggctcgtcgccttcctgacctgcctcttcccctacctccccgaggtggaggcacttcgctacctcgacgccgccggggcggacgccctcgtcgccgcccgactcatcgtcaaccggcgcggaatggagcagtcgttcgtggtcgactccggcgccaccgtgatcaccgccgagatagccctccggtgcgccgccgtcgccgcccgccacccctgaaagaaaactcaatctagaggtaatgtcgtcgatgcgacggttcgtgttaattcagcactgaatcgtgcgatcatttacagatatatatgcgccatagatgggaggaaccggatctcctatacatgctctaacaaccttatcaggttaacaaactaccggcctcctcatcttgcgcatacagagattacaggagattgcattatctctaacaaccccgaccctcgactgctcgtgttagggtggaagctcgtctcgccggtgacctgaaaatgctcatcacgcccaacaaatctcgagtcaaggcgctactagacaacaccatgatgaaccacgccacagtgaaagatgatgaaattctccatctgaagcaatcctgggagctcgccgaatctcggcttgatcaccacaacacaaaaaccaaactggcaaaatcatgggagcgactcgcaaaatctctgctcctacgtgcaaagcctcaaccagttctccctcatgtccgggcggccaagaagcgaatgctcttcgcaacgatccgcggcttctacctgcaggcgatggcgaggctgccggccgacgagctgcgcgctcggtatcaccgcagcatgctcaaggccggccactgctacggcccgctggaccccgtctccaacatcatcgtcaacaccatctggtacgatcaggcggccttctcgcagagcaagccgtgtacactgcagatgatcagcaccaaatgcctgatgcgaatcgtggcccgatctttctatggcctcctgtccttcctgtgcactcgttacccggactgctcacctgaccaagcgatggggtggctgcagatggccaacgctgacttgcggattgttgatcctgcccttggttatatgtccaataagattacgagaacagacaacatcagcatgagcttctgttgtaacttgccactgcaggttgggattggatgtttgtgtttcagagctgaggcatcaagaagatcggttacccgtctgccggtgtccacgaagcttatgctgctgcggctgctgctgctttccacccagcgccgcttgcgcagcaagagcttctcgcatcacctgacaacctggctaagcttgggtttgtatatctgcatgcgttgcagcacggtgacaggctctgctctgacgatgtcaccttgatttccttgttgtttcgcaagcgtcacttcgagttgcgacatcaacagcagccagagcctaaaaggttatgcaatgatgcctacattgcgctttgtcaccggcgtttcaagttttggctacatcatgacctagtctgcaagaacgtggaagttgcattggccacattcaaccttgacaaggtttggtttcttcaagttgacccccctctatttttgttgtatatgcttagcctcaaatgtccaattaactctcttcgattgtgtctttagttgaaggtgcacaaatataggcttcattttatctgtggtgtcaatgagtgcgtatctggcctggagtacggcccggtcagaagcaatagcccatggaggatttacaaatataatcactctcatatcaactttctggcgatttgcgatgacccccaatctgccaatgatcctgcaacgctcttctttgctgaatgtagcaactatagcgttcatgaggagtcttggtgcatccctgtggtttcgccgcatcgagatactggtatgctctggtcttgaccttacgatcgaaaaacctttcaatatccatctcaatatttcccttccaagtagatttgtctatgctatcgtaatcaatttcatatcagtatatatctctagttgaaaactcaccgacatagcagaggaccaaaggttaagcaaaaatagtgatgtgatgcccagaaaagaaaaaagaatgctgctaaaatctgtccaatagaaagattatattagatctgtctatggtaaatagatgctaacgtgtgatagattacttatgcaggatgcttcatagatgacataggtgatactctctctgtcctgtttcaaaagggcacagtttcttgatctgtccagttttaaagggagtacggatactattcactgtctgattttattatttttgtttctttaattgtagatcaaatttagtcatacatgtttgtgtatagacttatggacaaggattttctacacctagatgtcatggcacccatcatttgcatgtgattcaaatagttacaggaaaaaatgaaaaaaattagtagcatcgattgtgatgatataagtctatacataaacatgcatgactaaatttgatctacaactagagaaacaaaaacaataaaatcagacagtgaatagtacacgtaccacgcagataaaatttgttatttttgtttcttcatatgttgatcaaatttagaccttcatgtttgtatagtgtcttatattatcataatctatcttatcaaattttataaaatttttatataaccttttaaattacatgcatacatgtagaaaatactttccatagacttatatcatcacaatcgatgctactaaactttttcaattttttctataactatttgaatcgtatgcaaatgatgggtgccatggcatctaggcgtacaaaatccttggcatttaggtgttattttcactttaatttgttatttttgttgcaacttatagaagttgaatttggtcttgcatgtttgtggagtgatatatttcgtattaatctatgttgtcaatttttttaattttttaataactatttagatgacatgcaaataacgagggaatgtcccctcaagggatgaaaatccacgtccgatttctgttctcaatatggagtgtgcaaatgtgacagaaggaattctactcgcgttaataatcaattgtcactaccatactattattagtttataacgtgttgtcatttttgtatgtatggcagaattagtccgttgcatttactgtgagagcaaggggactaggattgtgcatcctggtgagaagagcttccatggacgtgacacggaatttgagaaggtgatgcgtggagaacgactctttcctggattacagagaggatcctacagcaacattcggctcgctgaaagaaccgatgcagattgggtggataatctggaggaagattgcatctacatcactgcctgcgcagcggataatgatagaagagtgaacccgctcaattacccgcctatgtatcgagagcgtgtgctaccgtgctgcgaagcagcaagtgatcgttcctagttatcagttttttttttcatatatttttcttcacaacattataaggtggcacactgattcggtatccacacaacgctaatctctctacatgctcccgtgctgaaggatcaattattcgtaatcgtaggtacatattcagattaagatcgggagctcagatttcagatcgagatgctgttggggatgcccttggcggtgatgccggcggcggcgccggtgacgtcggaggtgttggggtaaagcagcatgtatgggaactcggctgggccattgcggttcttgagccccgcgtcgccgttcatgcccaccaccttcccttcgatctccaccagccggtcgctgaaccgccggaacgcctccagcgccctggcgtccgacgtccacgccggcgtgtcgcgctgcccgaggtacacctcgtcggaggagtgcttggacaggacctcgatcagcgagatgccgatgatggtctggagctggctggtgatggtgcggatgaaggcccgctccgggtcgcgccccagctcgccgtacgcctccgtcccgggctccggcatccgccgccggctcaccgtcggccggttcgggaggtaaccggcgtacgggtactggccgaagttgaccgccgcgtgcagcgccgacgcgatccagatgatggtggtgcacgcgtcgcggagctccgacacggcgtccatcctgggccaccacgccgcgcccttgaggtcgccgtgcccgacctcccgcacctccgcccaccacgcctgcagctccgcgtcgcctcggagcacgccgtcgtcggtgtagtagatcgccaggtactcgcccacccactgctcgatcgcgtgccagatctccagcccgtccgccgcgtacgggtagtccttgatcagcagccgcaccttgtacgggctcgtcgcgtcctccaccgccactcccctgcaaaaaaaattcacacgattttgcactaaattgtacattcttcccactgatgccttacaaaaatcaatggagatgtgtaatactactaccttttgatgagatcggcggggaggccctgctcggtgaagttccagttcttgtacaccatggacgacatccagagcgcgtacttgccggggaagacggtcatctcgaagatgccgccggcgttgatgagcgtctgccgcgccagggcgttgatggtcatcgtgtcgcggtagtgcgggctcagcagcttgtgcaccgggtgcgtcacgctgagctgccggttcgtcgcgatcacgaacggctccatcacagcgtgcgtgttcagcctgatcaaccaacaacaacaaccgatgagtacaaatctccgtcgatgaagcgatcgattgctctggttttgaacgtaccagtggctgatcagttggtgccagccggagtcgttgacggcgacgtaggccttggcgagctgccacacccaggcctcgacgccggtggacgccggcgtgtacacggtgctcttggcggcggtgacgtcgccctggatcataggctcgctcagctcgatggcgagcggcgccagcgtgccgtcccctcgcaggaagaagagcgtcctggtcgcgtagatgaagttgccctccaggccgttgacgtcgatcaggaacggcatgaaccggtcgtggtggtccagaatgtacagccggttgctgtccagcgcctgcaaatcgcgacacagtaaatttccacacactattgccatttgccagcaacaattcaggtttgcaagtcacgattgatagcaaaatctgcacgtacgaaaccaacctgctgcacggtgaggccctcgaggttgctcccgatgtgcgccgccgtgatcatgctggtgtggtcgccgaacttgctaggatcgagactacttttcggagggaattcctgcgggatcaacatcgagttaaatttgccacatttcacgttgcagcagccgtgttcactatcaatttggcatgaacgcatcactgatcactcaccgtgagacgcgtgatcatcatcgggttcacgccggcgagcacctcccgcgcgaactcctcgtctgtcctccacgcctccttgtcctctgcatacatagccaaacattacatcgatcgtcagttttcacctaaagattctgatgaaaagtctctacgatgacaggttgcgctcacgtttgataatctgaggcatggggagcttgaggatatagtcgccggcggcagggaggaggtccttgacgagctggagcgggaatcgcttgcggagctcctccagcgcggggacatcggggagcttgaggccaccctcgtacaggtcgaggatgtcctggaacgagtcgaactcgccgggggtggtgtccacgtacgtgcggatcgccggcacgatcccctccgcgatcgccttgatcgagtagcccaggaagtccgccatcttcaggtgcccgaaccgctcgtcccgcggcacgtagatctgctccaccagcgacagcctactctccgagtccggatctgcacgcacgcatacgtgtacaaaaaacatcagtcaaagtcaaagtcaacggtcaaccacacaaaccgggcccaccgtcagtgagacattgcagctgaacatggaccagttctggtgtttcactatgacaggtgggcctaactgggaggtatgtgagtgaaggtgccacattctagtgtaaaaatgtataaaaaactttttagaccttaaaatgtttttttaagaatcgtaaaatttttggttgggggatgcgtaccggtggtggtgggtttgcggccggtgcggccgcggcgagggtagggggtgtcgggggagccgccgaggatggggcgagggttgccggagtcgggggagccgaggtcgttgtagacatcgtagcggtagacgcggtcgtgctcctcgtaggggccctgctggtcgtcgccgcgcaggttgcggagctcgtcgtcgcggtacggcttcagcgccgccggcatctggctcggcaggtaggcctgcgcgtcgccgcagaaaatatatcacaaagttaattatagcacgtactcgtattaatacgcatcgctaattactcctacttaattggttagttgattgcccaaatcagtcccttgatacggcaccggccttggacacctggctgcacgctgaacaagaggcaggcaactatctgttcactttaaaacttttaccgtgtcatgtgttcgcaaagtaaaatcgagtgctgtgtcgttgatcttgttgaaaaagcttctcggggccatgaaacaatgccgtctaaatgggtgtgaactgtgaactgtggcaactatgatgagttgatgactcacgtgaactcacatgccttcctgagtccaaggactattccagatttctagtactatagccacttttatgttgttatcatcaggaagcatatccattgtagagctgcttcttttttttgaacagtgctactaaatccacttcacctaccacataaacaacttacataaagtccattcacttctcacctaaccaaatatcttccctatggacgcctaccaaacgacgtgaatcaagcaacttactacataaagcatctacgaactggccaaacaaagaagaacggcaaatggttactgtaatagtgtaatttacatgcagggtagcataatacagtatgcagcagagaagaactcacatcgttggcgaagaagacgcggtcgtaacggtacttgtcggcggggtagacccaggagttggcgaggaagacgacggcgccggcgcggccggggacgtcgtcgagggtgatggtcttgaggaagaactcgttgctgtggtggttcttgacgatgatggcccccggcacgccgagcttgtcgacgtcccagtcgaacgtcacgccgaaccgcgactcccccgtcgtcagcgacggcaggctgctcgtcagccactgctccaggctcgcctccgcccccaccttcccccggttgccgttgtctgcacgccgatgagaggatcatgcccaatccgttcccgttaattagtccaaaccaacgactaatcatgccccagctgttaattatactacgtgtcaccacctcgcgacaccagctatagtttcaggcatctagttcaaagtgaggtactacttcttctttttttttttactttttagcttttgtactttgggttagcatctggtactcctgccctggttgtctttttcctcgacgttggtctcttctttccatgtcccatcaaaagaggaccgagctagctaggcaatggccgcccatacagtgtttaagtttgtatggacaaaaatgaacaagagaggtaaatcgaccaagagaagagatgcaagggggtgagagggggggggggggtgtgctcacttgggtcgacggcggtggagctgatgagctggcaggtgacgcccttgccgaggaactcgccgaggccgtcgatgacggtggcgccgaagtcgttgaggtcgaggacgttcttgcgcatgagcaccaccgtgcccttgagccgcgactgcttcgacgaccccgtgatggtgtcgatgatccctcccagcatcttcgcctcttctggatgtctcgagctctcgacctgggtttgccgtggactgatgaactgatcactttaatcagtacgtttcgctctgaatcgagttgcagtgagcgtgagctcgctgggtatttatagccacaagagggtgtaactgggaacagtacaatagggccgtgactgaagattgactggtgagtgctagtgggggatactctgcttaaaatttattatctcaaatcatttggcacaatttaatattcttgagagcgagagttcggtttatcatcttactgaaattctttagattaaactttttgataggtaagtgaattaagcactcgtttcaaaattattatgggtgcgtttagttcacgctaaaattagaagtttggttgaaattgaaaccatgtgacgaaaaagttaaaagtttgtgtgtgtaggaaagttttgatgtgatcgaaaagttgaaagtttgaagaaaaaatttaaaactaaactcggcctatgtcgaaattattgacatagttttggtaataccaaacattatcgtcacatctctacgactctatcagcccaaaatttaaacaacatcagagatttcggtacccaaatcttagtaattatactttattttttaaatataacattattaacttttaaacatgatatttcatcatttgctttgttttataaaaaaaagttatataagcattatttatgttgtttctactttttataaatacatatatgtatttttattttgtttttacatactttatcattaaagatatttcaagtatgacttatatgttcatatatttatatcaaatttttaaacaagatggaaaaataaatgtcttgtctagaaatgaatgacataatttctgctactatagaaatgaattggagttgtcatacttccctcttgtcctcctagcgagtctgtgccctccatccaagtgagtaatactccatccgtcctataatataagggattttgggtgaatgtgacatatgctagtatgctgaatctggatattgtgggacagagagagtacgttattgtattcttaatcacctcctagtctatcgtttgttgtatcgttttgactttttttctaattaaacttcttttagtttgatcaagtttataaaaaaaattacaatattttgacacaaaacaaatatattatcaaaatatattaatttctatatgttattaaatatttctatattaaatttaaagaattttaattataaaaaaggtaaaaataatttataatataaaacggaagaaggctaattacgaccggtcacgtacgggtgcattaaaaaggaaaacagaaggaatacgttatcaaaccaaaccaccccccacactggtgctactggccttaattaggactagggccatggcatcggccacgtttgcgatagcttaaaatcgatttgaatatttgggaagacgcgagcggcgtgggaaacgtccgcgtgcaccgtgcagctcgtctcattcgtctcggtttcccctgctcctccaaatcgcgacgtcgacgtgcaccgatgcacggtgtgccggggcggctcgtgttgtgcgtgattttatttcataataatgctgactccaaactcctaactgctcaagtccagctatatctgatttgcattgttgacataacaacttttcgttagaggggaatacatttatgtgcatataagtttttcctgtttacatcgcgtacaccaagaaataaattatactaaaaatgttagaaaaacccatacatataattttaaggaatttgctatattcttttagtacttagtacttgccagactcattatattttagttgtaataaaaaaaataaaagtttcgacagatttgaaagtaaaaaatatgttagaatttcatcgctccctatttataataaatttgtaggtatgactttatacatatttgtaaaactactgaaagattatatacattgttttagaattttttaatcatattttttaattgatgtatatgatacttataaaaaataattatgtgtataggatatatctctgattagagatactagcaaacaaattagcggaggtgaaatttcagtatcaattttagaccgatataggtatcgtcttcatcatcgatctttgtcatcgtgaattatccgaagccatcgtttctcttattcgcgatataacagagagcctcgtaattaattcttcctcaccaccaggatctgtttgatgttagaaaagggtaacgatcgagctcttgattctgaattgaaccacgtgtactcccaaaagctaggggagaataaaaaggaaaaacagaacaatatctgcagtacgactctgaatttcgtgtcagcaaacaagagagagagggggaactgtggccatgcgattcacacgtccatttgtgatttgtgtgcctcgacttccgatctctcacgtcagtccgtgatttgtaagagcaggtacaatagcagataatagtaaactattagccaactataaacatattttaataagataaaagatgagagagaagaacatcggactatagatctatagtcagctgcagcacggactctaagacgtaatgtgtgtataagagcaaggtcaacaagagagccaactgctggctccaattagtgtccatgtcatctatagtactccctccgtcccagaaaggaggacgttctaggttagttaggaaaaattagtgttgtgtgaaaatgaccattttgccctcaatttatagaattggggctaatcatttgaatgcttagtaggagtacgacaagtacactgccacatctgtacaaaaggaatatttgaagcatccaattaatgctgggtgctactactagtatcaacactacagattggtgttatacacctaattcgagtgatatggcgccaaaacataagggcttaaaagaatccaaccggtctaatcaaattcaaaaactccatggatggtgctttgccacccaagggtaccctccataatcctcaagcagcgaggcagttacaagccttttatcacttcatccatcatcctacaaaccaactccacacccacccatcacaatggctatagatctaaacatattagcagaagaagaggaagatggaggggctttacctgacctcaatgaagcacaagccaatctagaagaagaagttcctggaaggtatgttatccaggtagatgaccttgctcgagttgcttgccatggaaatgatcaagttgtacattcttttgatctcaacttgggagcttttgatctcaacttggaagcaacagaagaacaagaacaactgcatccaggttttttacttcatctaatctttctcaatgcataaaatgggttctttctcagtgcatgttgattgcattagtaaatctggctctaaaaaactatggtgttgtatgacatgcaacagcagattataccccctcatcagcacacatgctctctctctctctctctctctctctctctctctcacacacacacacacacacacacgatctgaaaagaacaaaaggttgctactgtgacagttttgcagagtttagttcttctagttccattatcatgtatcagaagacactttagaaactagataacaggtgtagtaatcatagagagtaaaactcaagacatgtcactatggtttcaaacagattaaagcattggcaaacaaatagattagatttcagagcctagtatgaaattttagttcacatctgaccatttcttttcagaatcctagagcatctggactttacagaagatagagaaaacaaatgaactgtaaatagcacattgttacctaacatcgaattagggaggaagtaactttggtcatggccagagcatgttggaagaattaacaggcacaacctattggtgagcagaacgatgtcaagatttactaactaattttgttaattgctagtacaaagaaccaatttattgccaagaacccacacgtcttgccaaatttaagtatttaatattcatcaacaaatcacgtgtttatgatgcgaaatattgaatcatgcttagatggtcacatacttgtgaaatttgaattgtgaaacatccttaactccagctcccagtcccagacacaatattcctgttgacctgctactgaaaataagcaagaactgaattaagtacctgaaaaaaattacttgtacaacactagaacttaaatagagctagaggtagaattaaatacataactgaattagcatgacaacaaatcaatgctaccttacgaacagatgtatgaataagtcatggatcttgatatggaaatatggaagagttagtactattgtaaactacagttatgagtcatgacattgcaaatcctaaacatattcaatattctttgtgcggcactgaccagcaagtagttttttttagacaattatcagcaagacatggagcatgacctggatatgcatgcaaatggaaatgaggaacaagaaattcaactgggtaaaagttcattactctttgatcagttacaaacatgtttacattcttgattttaggactgaataaatctacacaatctgattaacacacattaacttaccatgtaaatttttttgtagacaatgacaatgaattgcaacatgagctggaagccttggaggatgatcttcgggactatggcgtgtatacagatactgtcaatgttgtctttgatagagaggagttgtcagactcagaagaagaagaagatgcaaatgcaaatccaaatccagatgcaaatggaaatgaggaaaacagttctagagaattgacaaacacacaaaggcaaagaatttatgaattgttgcttgcaaaaagtaaggatggaaaactagaaaaagacaccacacgtgcagttgctcaagtgttcaatgtcagcatccgtacagtccagcgtatttggaagagagcaaagctttgcatcgcacatggagtacaagttaatgttgactcgaggaagtgttacaattgtggccgcaaaaaggttgtaatagacttgtcggttgtatcagctattccattgcgccaaagaagcactatacggtcacttgctgaagccctaggtgtgtcaaaaagcacattgcataggttgttcaaagaagggcatctacgacgtcactctaactcactaaagccttatttgaaggaggcaaacaaaaaagaaaggctgcagtggtgtgttggtatgctagatcatcgtacgttaccaaacgaccccaagtttattgaaatggaaaacattgtccacatagatgaaaaatggttcaatgccaccaaaaaggacagaactttctacctgcatccccttgaggaggaaccctatagacctgtccaaaataagaatgcaattgagaaagtaatgtttctatcaacagttgcgaggcctaggtatgatgctgaaggcaattgtacttttgatggtaagataggcatttggccttttgttagaaaggtaacacaaccttcttatacaagtgttatttacttctgttttttatgtttaaacctagcctatttgatgtactaacaggaacccgcacaaaggagaagccgtaatagagagagggggacacttgtaacaaagacaattaaggttgatagagacactatgagatcatttataatctctaaagttctcccagctattagagcatgttggcctctagaagatgcaagaagaacaatatttattcaacaagacaatgctagaactcatgtaccaattgacgatgagcagttcagtgttgcagtagctcaaatggggcttgatattcgcctcgtgaatcaacctcccaattcccccgatatgaattgtctagatcttggcttctttgcatcacttcagtccttaactgctaatagggtgtctaaaaacatggaggagctaatagagaatgttcagaaggaatataatgactacgatccaaagactctgaatagagtgttcgtgacactacaaagctgttgcattgaagtaatggaagctaatggagggaataagtacaagatccctcacatgaacaaagcgaggctagaggcacttggcattcttcctaaagcccttcgctgtgatcgtcagttgtatgagaaagtcatacaacttctaggcaactaattgtgcacttgtgtcataatatgtacttttgtcatctatgtacatgtgtcgtctatgtaattgtggaaactaaatatataatatgtttgcttgtttgaatgttttatcctaggttctattaacaagttgattgtccatatgcacaataaaaaaacaagcactagtatttcatagagatgcatgacatttcaataagatgttgaataaccatatattccaaaagatgtcaccaaacagaaccacataatatataacatgataggatgccactatgcagctgactaattatgagttcgtattttggactaacaacaagaagtacgtagacggcacatgtcacgcccagaaattctcgaaccagaatttctaagctgaatgtgcattgaatccctgtccaggaccagccagggtacacaaacgacaattgttgacatacggatccacgtcttacaaaaatagaaaagattacaaatgcagcggaaaagataaaagcgagctaaaccgggaagcttgacttcagcagcgggcgactccactccacaggcaatccttgacggcagcgacgaaaccaaatttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacaacccaccattcaatgtattttaattaactaacaccattgcggtggcaccaatccaaagctatgctcatagtcaaagtctatgtaataaggtgatccccatttgtgtgctagttgaactaagcatggctaagcatttcctaaaccaacatctagtcattttgatacccaggttatcaatgtcatatggtaaacaataaatggctgagtaataggacccattccacatgatattgtaaaagaatgcaacatttaatagaaatgcgggatatttgtaaattgggtacaatatgatcaaacgtattgcatgacttgccttgctctcgcactgacgagacctcagcaacgtcttcgagaaaccgtggatcgacgaaacggccgaaacctacgcgacaaacaaagcacacaagcaaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcacggaggggtgcggcgccgacaggcggggcccactggtcagcggcacgggggaaaggaggggcggcggcgccacgtggcggccgaaccgacggccccgatctacccaagggtagatcggacggcggcgggacctcgcggccggggcgcgcgggcgcggcgcgagacggcggcgaccatggcgccggcggcgcggcgcccacacggcggcggcgcgcatgcggcagcggcgcaaggcggcgaccgaaggcgaccgaccggcggcggggagcggcggctagaggaggagcggcggctacgcggctaagcggcgcgcacgcggctacacggtacggggaaaaggagaaaggggagggggaagcctcaccgacaacggtcgacgacggcggccgacggaggacgacgacgacggcgggacgagctccggaacctcctaacgaacaaaaggagagggattagagagagaggaaagagcgtgggagggcgagagcgccggccgaaggcggcggccatggcgccacttgccggcacacgacggggatgggtctccggcggcgaacctcgacggggaaggggcggccgaggtagatctcgaccccgcgaagctaacggcggcgacggcgcgagacggcgacgagcctagcggcggctagcggcggtcggagtagcaaaagcggcggcggcgggtggttgcacggcgcggaggcgatggggagctcgggagagatcggcgaaatgggaaaaaagcgagagaggaggacggcgatgcttaaaaagggggagagggagccggacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggcggcggtttcggcgcggcggcgcgccgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagaaaaaaggagggaaaaagggagggaaaagaaaaagaaaaaggaaaaggattttccctggaattaaaaattgcactttggtgatttttaattggttaaaattatttccaaggctctgaaaattccactaaaaatcctgttaataatgtagaatccaagaaaaattccacatgccgattccgattattatttgcatttattaattagggaattagctctaggttaattaagataatttcttcggacgatttatttagccaaatttttaaagcaagcaaaaagggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaacccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgatcccagaagagcggagtacgacacctccgtccatacagtgcttcaaatggtgccatctgcagactagcttggtaactgttgttgtacgagaactcagcatacggcaagcttttgtcccatgccccaccaaaatcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttccccgatcagacacgatcttcttaggtacaccatgtaaacacataattcttgccagatagagttctgctaatttcttccctgagtaggtggtgtgcaccggaatgaagtgggccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccgaccctcatgttctttttgagctctgctatttcaggatcacttgcttgagctatgcgaacctgctccaccagtgtgggttgtgcctctagggcagccacgaatccgtgctcaactataccaaggttcaaatgttccaaatcatgttgaacctcacagcatagttcctctacccatgcgacgttgcagtaactcttcctgctcaaggcatctgctaccacattggccttgccgggatgatagtgtattcccatatcataatctttgattagctccaaccatcttcgttgtcggagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccacttggtaactgactccacatttgctggatccacagctactccttgagcattcacgatgtgaccgagaaactgaacttccttaagccagaagtcgcacttgctgaacttggcatatagctggtgctcttttaacttttcaagtaccagtcgaagatgctgctcatgttcttcctcggacttggagtagattagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaagggctgcacccctagggctgctgctgttgtagcccttagggcctccaacatcgcggcccctacagtttccgcctccatcatcacctccacaacccgatctctcgccaaagccagcgccgtagccatccctacggcctccaccgccatagcccctaggttcgccgccactgcaacccctagggtttccgccattgctgctgatggcgctctcagtgttgccgcggccgttgagcatgttgtcgcacaccggatatggcttgctcgtctgggggtgggggaggggggatggatggggattggtgcggtgtgctgatgggagggagaagcggggtgctggtgtggaagacgcggcgtggaaggagaagaaaacgagagacgagcgatggggaagaagagaatacgagaggagaggataaggtagcgcttcagagcaaaaatcgtttggagaagaaagagttcgctagtactgttttagatggccccacttcttttttttatttacccttttttttatgtgtgcttgtctaggagtttgctagtgcctgccaggctgccaggctgccagcgtcaagaattatgggacaaatggttaggagcagaacgtcctcctttctgggacggagggagtagacattatagtccatatgtaccatgaagaaattttatgtttactcaacataaatattttattattttcgtgggtcccacagtcttatcctgtctcttctctttctttctctcagcttctcttcctttctttacttctcttcgtttcttttgcctgcatatgcaaagtatgcagcgatgaaggttacagccaagcctgccagggatacaggcgacgagtgcgacgatggacgaggctggtcgccgcggcggacgtagaagacggcgggcgcaggagacggccgtggtggacaaggcggacgcaactgacgacaggggacactggtggagaagtgctttttagtcccggttcgtaaccccctgtagtcccggttttctaaccgggactacgaatccgggactaaagatcgctatctttagttccggttcaaataaccaggactaaaaatcgatctttagtcccggttggtgagatgg

SEQ ID NO: 59276 - DNA, 23733 bp, Oryza sativa
atctctcactgttgtttccgaagaactgaagcctttgtagttttcatcaaatccagcaaggcaagcagtgtattgtaattgtagatgtataagtggttactaactgaggtgataagatcgatgtggtaatttatcagaaacttgagattccttcatctgcctgtcctgctagttcgattatcttcaagaaaatctgagctccttgtttctgtgaaatcagctggttttgatttaccaatccattagcgaactaataccgtataagcaaagcttaagactcagactgaagggtattttggttagttaccccaccccactttaccatgcatgctttaatcatgccatggttttctaagagcaagtttaataatatagcttattactaaatccaaaatttaaatcatcatctataatcgatctaatagcttactcgtacaatagttagctatagaactacatcattaatgaataatccacccatctccctcacatagtttattggagctcgtgctatagctggctataaatttgtagcctgcatttgttctatcttctcttatctctcctccacacaaacacaaatctgatgtggcaacttatatagcccgtttatatcatcttattgtacttgctctaaaacacttgtttgctttgatgtcgtgattaacttataccatagagtctcatcgatcgatcatatttcctaataagttaaagtggcgaaataaaaattagcttattggtagaactttatatatttatatatttgttcgtagcgatttaaaagccagggctaaaaagaaattacgttgaaaatattttaaaatcaactttaaaatcaagtttgaaagtttaattttaacttttgctttgataatttttcaacttttgctttgacttattagaacaaccaatggctcgtacttttttagccttgaaaccccgacatcaaaatcttaaatctgaagccaactgtgtcacagttgtggctaattatttcttagggccgttcactttaatgctattttcaatcttaccaagttttagtaaagttgccaaaaaagtggctatatttaattcgttgccaaattttggtaactatataagaaattctgtcaaaattttggcaagttaccaaaattttagcaactataccaaaattttggtaaggttttttttggcatcaaagtgaacaggcccttagccacggttttggctagttatttctttgccacggttttagctttcaactcaattttttttgtttgaaggaagctttcaactcattcgctcatatcacaacttgcctaaggctctgtttttttcagtttgggattattataatccagattattgggagtaagctgaaagaaacagacaacttattaaagtagtttattataatctggagcccagcttattataatctaataagctcatttaggtaagctttttctagattattgggtgaaaaattacccaccatgccaccctactccctttttagacttgcaaacccaataatctagactctaataatctagaaaagaaacaactaatcgcttattctactacaaattataacaatctagtttataataatctaacacaataatctagattataacaatcttaagctgaaagaaaaacagagcctaagctagttgtgggaagcttaggcatcaacaaacagcccgtctctgcagcatttaaaggcaaggtacacaaccaggtctggtctggcgccgccaacgcgattcggctccctttttttctcttggaagttggaaatgagcaggacttcctccggttctagaccgtctccctctgtcgctagacaatgacgcaccgaaagaaggttaccgtggcttgtcgagtcgagccacccatttttctccagaatgcacgtgtcggtgtcgccctttctagaagaagagttttatgcagctcgtaggggctctcttttctttggcctctgattcgttgttaatttaatccgccgcaacgcaagcgtaagaaagcacaacgcatcagagacttcttgcccgaatcatatgcttttaaccacttgacctcagccgtagaaaaactagtccggatgcctagtgatttcttgttcttgtgcactcaattatatgattaattaatacagatgagaaacaaatgctttaatagttgctaatatttcaatcgatccaaatgaacatgatgctaaacacaagggcaaacaaacgcgaacaagctgcatacacaaaggataagtaattaaaggaggacacagtcgtttattaatcacactgataggacacagtacatatatatataggaagcagcagcagctgtaagcaataagctggcataaaacaattcgagaagcagattaatactgcatccttgatgaggacttgaggatcaagccgtgctgccgtgtctgtacaatagatgcgacctgaggccaagccaggtcgatcgatggatgcatccttagctgacgaatataatcgacgggtcgcagcagcactcgtcgatcaagcagcagcaacaaagcgcagccaaactgcagcaaaatcaaattaaccagacagttcgaaacgatggcacaagttgaggtgaatttgattggcatatagtagtaattcgaaaggaagaaggaacagtgaatgcttaccagccttcgaggaaactaggctgccgcctgggcggcggcgcggcgtactgcggcggcgccatcaccggaggcccctggtacgggccctggtagtagccctgcgccgggtaagggtacgcgtacttgggatcgctcatcttcagcttcctcctcttactacgaacaccaactcaaaagaaagcagatgcgagttgcgaactagaggaggtgacgcgatgaggaagaagaagagaaagaaagcagcgtgtggtaatggagcaggtggtattcggagagcgaaaagcttaacaagaagagaggcgtcacggcgcggctcgttattataggcgggatgtaggagagccgtgtcgcgcggcgatgggtgggcgagccgacgcggcgcggtgcggatggagggaggcatctggaaagcgcgcgagagagggagatgagatgggggtttgcttccgcgggaggcatcggatcgcaccggttttcctttccttgcggttggactggccacattcgtttcgtcgtcgcgttttctctgactttttttgggtcggtttccgtggcggctgcgatggcggcagtttggcctggagtacgtacgtgcgcgtagtgtgaggcgacattgaacgtgagcagccgccatcgtccgtcgtcgcacgtacggcggcgcgtcggcaacgaatgctttggaagaacagtgaacacgataggacgtcgaccctcctggaccttggtacacgaaattcaaagagagaaaagctgctggaccttttgcgttttttcccaagaaaatgttcgccaaaatcttgctgtattgccgtgttggcccgtgttcaactatttccagattcgaccaataaaccctatctgagttgtaatttttgcttgttccgactgcctcacaacataccctcaaagaaaatccacccaccggagtggcagttggtatttgaggtaccatacaggttgatgtatacttacaaactatcaatacgaaacacctccgctcaaaaaagaaaaacgaaacacctgaattttattgttggaagagcatatgtccgcagtaaaattccctcaagatttattactccctactagtccgtagtacaatccttttagcgtccatatgatctggcattctggctcgtggttctggctgccgccgacgtgatcccttcaccggttgtgacagtcaccgttagctcggaacttgggcgaattccgtaatcggattccagtttccattgactgctgaagagaagaatgaaaaaacctgtccaaggaagcaagcttcaagatcactttcaaaatgcaaattgaatagaagaagaaggaactgctcaagctgctgccgcggatgatgaatcttccaagctgtcatgagtgtcttctgaacaaggaggagcagttgattccttctcgcaagcttaggtttcaaaaaaagaatcacaagctagcaagcggtgacggcagccactgaaagtggccaatgcattttgaacacacagcgaatttgtttcatgccatcgcaattcgtaaatgtgttacaaggtaatcttatgggacataagtaaaagcttccgtcacccgacctttggacttcagttgatcactctcaacaaaatgtaaattttgtcatgcacgaattctcctctggaagggtctcttgctgaaattctgtcatgcacgaattctactagtactgtatacagtactactgtggagcaatgggcatgcgaactgaccactgaactgcttcccaattcagagtttcagacttggaatggcttcctggtgccgtcagtttgtttgtttggtccgattctttgtttagtcccatagtacttgcccttatatgataaaatatgattaatactctatgcgtgacttatctttttaatttttttcataattttgtcaaataagacgaacggtcaaacattggacacggaaaccagggtttgtctttttttgggacggagggagtatatgtcatcagtaagctcatctgaattcaaatacgaataaacacatggtacaaacaatatagaactggaaatcagtcagactaattgaactgcatttgcccccaacaccaaaacaacaagcttgcttagatcacctaagaaaggctaacaataagcttcagtatgaccagttcactacaatcggcataaaactctacaaaaatacatcggaaggccatgctccaacgtgtgccccatgacataaagcaaaacaggctgatattgagcaaatcttcactattgcacccatcgttttcagttgatagatcgatgtgggggtacctgaattctgttagctgttgcctgttcggttgccaatgagatgataaaaatccttttttagttctcaacctcatcacgtaaactcctagtcctacaaacataacgcacacgagctataaacgaaattaagggggtgtttgagaaacaccccctaagccttacatggattgcatgagcagagaagactcaagaatgagtacagccatattcatataaactagcatggtggctcgcgcagattgcgcggctagcatcattatattttctctcatataatagcatatatgttttctcattatattattcaaatatattaaaatgacaacataattttaaattttgcaataactttacaaaactactaatatgtaatattcatattgtattttatatatacgtgttagttattaattatttttaatatcaaattttagttatttgtaaattataatatttctatatggactctagaatcgtcttttaatatttctttttttaattccgaattttctgtaaattgtatttttatatagactctatgctcttcttccaatattatttatttttattctgaatttttattatttctaattgtatttctatgtggactctaaactcatctttcaatattctttaatttttaatttcgaatttcagttacttctaaattgtattcctatattgactttaaactcttcttcccatgtttttcttaattccgaattttatttatttgtgaattgtatttttatacagactctaaaaactctaattttaattttattatgtttattctaaattttagttagttttaaattcctatatggactctatactctacttctaatattccttattttttaattccgaatttctatttttgcttaattgtatttctatatagactctatactctacttctaatattccttatttttaattccaaatttctattatttcctaattgtatttctatatggagtctatactctacttctaatattccttattttttaattccgaatttcaactatttctaaattgtatttctatatggactctagtctcctcatctaatatttcttatttttaaatttcgaatttcagttatttctaaattgtatttctatatggactctgctttttctttttctctgattaatgtgagaatttctaggccatgagagcgaacgtggaggctcctttttctattcctttaataatataatagatactagcatttggtccattacatcagcggtgttactcaaacttatcaaaaacaagaaacgtttttatcactagaaatgcactcaataatacctaggaaatataccatttacattagttccaagaaaaagtatcttttgcatttgactttaaactcaactattggggagagacatcccacaaatctttgaacttagatcgagaaagacccaaacgctggctgccaaggacgcttttcgcatataactctgaaagcagttatctcatcaaggaccttttttttggtgagacccagagactgaaccctggtcagcaaccccacaactaggtgggttaccaccgtgctgccattcacgcgttctcaaattggcattagacttgcatataagatacacacaaaaaatggtaaaagcaggaatatctataacaatatttaaaaaaaaaacagctacatatccaatatcaaattcaattttgcaagactgggtgtaatccaaaccggactgggccagttggaccaaagctgaggagacccaagttcatccctgctgttatcttccaagttgaatactccaatatcacgtctattattcttgaattctgttatccaattctggctgtcatcggtgaagtaggcatgatttgccttgagagacggaaattcttcagcgcggaggcaaagtgtctggttatgcccaacaaacaggacatggtcttgcaagcgattgatcttcacaagcttttcttccaccaagtcagacttatatacttcgatacttgcagtattcttcaaaatggcatcataatcatcttctgacggatgaatgtagtcgtcctcttctgttttccagatttgcagcacatcaccccatggcgcgtgaagtatgtatgtatttctgtcaccatcccctatatccatgacctttcccataacaaccttcaccatggcaatagggccactgaggtcaattgcatgaatttctcccaacgtagtgactgcatatagcaggccatccttgtaggtgcagtcttcatatcggccgtactctggcaggtagtcccattcatcatcccctactcttgcaaatgagagctgaccgaatggattgcgtataagcaccacaaggagctttcctgtcgatgtttcagagaatacaaaagccctcccagtgaggaacaactgctgccatctaggagaaatgatggatcccattgaccttgaggaaaacatcactccgtcgtgccagaactggctccgattctcatacttgacaatagcgcccgactcgtcgtaggtgggattaacctgctccatggtgatcactggcgggagggccatctgctccctagtgactgggttgaggaggtgcatctcacacttatcatcaatggttaccagccaaccatctgatgacccaatcaggtatctatcacggatgggtggatccgggagagtaatcttgtaggttctctgctctgcaaggctgtagatacaccctacattcttaccggcagattcagaggtgtagaagaggcaaggtgtctggtgccgtttatattgtccaaggctgtgtagtgtggtgtatgcagagtgccaagaggagcagacggagctcgcacgcagcaagtcagggatctccaagcgggaaagtatttgtaccagcaaatcctccggcagatgcggcaattcagcctccaccatcgatggcagcacgccaacatgttcttcttcgatgtgaggaagagctgagagcttatgcaaagctcccaagattgcagagcacaaagccgtagctagcctgcctatgctcattatgctggctacgatgcaggtcgccatcagatcactgcttctacttgcaagatgaaaaaaaaaaagttgagttgggcttggccctggatagtgtatacacttataggcaacaaggcaaggacggcttcgaatccgaaattgaacgggaatctgaatccaagaaggaaactgctcctgtcatgcctgcctgcggaattctggtattagtgcacgggcgagctaaagcacttaaatagattcggaatcgggagtttgggaccaaacctgaaacctgttgccgcagagagtccgaatccgacgagtgttgagttcctctctccctgtgtcgtcggaagcaacagtagtagcaaaactgggccattccactcgccaggaggagccagccgacgagggcgcagcggcggcgcagttggttgggtcgtgcggctacttggcttggttgggttggccatggccgccaccccgcccgcatttcctctctctccgtcgccgctgcgccacccaccccgatcctccctccgccgccggccgccggcctcggcttatcgtcgtcgccgacacgagttgggctccgggcccaatacatacttgggcttaggccggcctgcgcgttggcctgcttgatgtgtcggcccaaaatggtggccggcgacgctgaacggggtggggtagtctgctatttaacctttctctcgccaacctgcccaccgcgctctcgctctgccaccgccattgcgccaccgctcgccggagaagccaccaccaattatcgctttcaaggataataaggtgcatcctgttcctcccttcttcagttcttccccatcccgttacagagtctttctttgcagacacgtacgccaagaagcgttcttggtttcttggccgcgcttgcgccaccgctcgccggagaagaagacaccaccgccatttctggtttcttggccgccctctgccaccactcgccggagaagaagccaacaccagtttcttggccgctctctgccactgcgcttgcgccaccgctcgcctgagaagaaaccttcaccatttttggtttcttggccgctctctgccactgcgtttgcgccaccaccaagcaccgcgccgcgtccaaagataataaggtgcatcctttcttccataacgagctcttcttctcttctctttctctcttcttccccttcctctcttctctttctctcttcttccccatcccgttacagagctcatctttgcagacacgcagggcaagaagcgttcttggtttattgcagacaagaatcgtctctccacgactgtatccggcgcaagagacagatgggtcccgactcaggtagcgtcatctcatggtgggctgaggcgccatgttgtcgttggttggccgcgctgttcggctgtccttcgcagtcgcgaggatcttctccaaggctgcagccttcttcttcttctacgcgatcacaggtattttgatgtgtttttactgtttgctggagtgatggcgccagaaattgtggattcgcattttcgttttcttttgctctgtatacaaactgctgcatctcttttaacaaaactagctgggcggctggcgcaattacgcggctagcacctatacaaaaattatatatttttaatatgattttaattaaaatttattaaatagttatctcgttgtcttaaaactttaaaagactaaaccttatcatcattgtgtttctaattttatagtttttaaaagtcacaccaattgctactccttacttctgtcatatcattttttttatttgcttgctcaatctaccaatgtttctatccattctccttggaacctttaaaaattagatcttatagtttttaaagtttattgtcccgttgggatttgtttttataatttttagaagtcccatcaaacattaccattataatcctctatggtcgtccactgcctcttctttttattgtcatttgtattttaaaaatcgaacataactattgtttaggtttatttttttacattctagaagtttcaccaaaacgtcagcgaccttgtcactgtactcctctacgactcgcccgccgcctcccttctctgttgtcattgagattttaaaatcaaatatgagtatcatgggggtttattttttttattttttagaagcccaaacctttaaaaattggacttatagtttttagagtttattgtctcgttgggtttcattttttataatttttagaaattccgtcaaacgttgccaatgcactcctctacaacccgtccgccgcctactctttattgtcatcgaatagtaaaaatcgaacataactatttgttagaattcatttttcttttactttctagaagttccaccaaccatcggcggctctgccattgtactcctatacgacccgtccgctgcctctcatttttattgtcatttagattttaaaaatcaaatataattatcattagggtttattttttactttctagaagtcccgctaaccgtcttgaccgattgcttcacgacctacccgttgtgtttccttttaatcgtcattaggattctatttggtgttttattaatagttttaaaatgttccatcaactgccaccactccactcctttataggcttgttacttaattaatctcgtcatgtattttagttggtattttctttcaatagtctttatttttttatcaccaattttagttatttataaattgtattcctagttgaaatcttatttttctttttctaatttcagaatttattttttttttgaattttaactaatattgtattgtgttcttttaatatttttattttttatgttcattttaagttgtttcaaaattgtattcctacttgaaccctctttttaatttatctaatttcagattttattttattttttattttaaattttaattaatcttgtattgggttcttatatgtttcttatttcaatattgcttatatttaattccgaatttcagttaattttaaattgtattcctaactgaactcttattttcttttctttttactaatttcgattttttattttttttatttcgaattttaataatctcgtactgtgtttttatatggactcttatttcaatattgcttaatttaattccgaaatttagttattttaaacttgtatttctacttgaactcttattttccttttttgctaattttggattttattttaatttttatccaaatatgtattaatcttgtattgggttcttatatgaattgttatttcaataatgctttttcatttcttgcaatgttaaactaaattgtagggggttcagtctcgaaagggaaagcatcataatgctttgctttatggcaaatattctaatagcaggacctctcgttctaccgctagggctatcaaccttcctaccagtgcagagtcttcgaacaaggaagtggtacgaacgatgacttctcaaattataacctgttagttttttttttcattttttgagttaatggttaatttgattttcttttatttgtatataaaaagggaaagagaaatatctcatataagtttaaaatctatttgaattaaatatgtacaaattatatatagtggtcacaatcagacaaatatgattttaatcatagacacattgaactttcagatcatattgaatcatttaaacatgacgcaataggatggtgtgcatggtgatgctatggtgctttaatgattgccaacttaattagtatatggcatgttcttatatgatttttcttttcctgaaattcgtagaccgtgggtgagagaaaatttccaaaggaagtggtagttgcttatgttgattactgtaaacgtgcatcagtctgtgaggagaatcagcgtgtgtgccatatgtgtgtgttcatcgagcaaagatgtcagaactacatagtcaaacaatctaaggtgagtaatctaaatgcgcattgtaggtattacgtagagacatttgtattcttgtccctatttttggatttaattgtgattttctctgtttttttccttaaaaaaaatgaagcaactgtttgccctgtttttgagatgcattgcccttgttatgtatgtaatgttgtatttcagcaagtctaatttccatgtcgtatatagttgataatccactgcataaatttgcacggcgacatcggtgtggagtgtgaagcgccaggttgcagtgtaagggcaatgacacatgaagatcttgaggttcactcctacttctgtcacattcaggctcaaggtgatctaccattctgttgcaaacatggatgttaactgtggattaacattaaatattagcgcttaacttaattctcttttgtctttttaggatggtggaggcaatacgaaaatctcgagactagccagtgaccacagaatgccaaggtgtaccgagacatcttggtgtagagcgagtagtatagcagtatgaactttgaacaagagtttccgctggtggttgttttggcatgcacttgtacatatgcttcttactacttttggagctgttctttactggatttataatgcgcttacactcttgtcataagttgtaaatgaatgtttgccgaaaaagattgttacaaaactatatgggatttgcatctacttccttcacttcacagtgtaaaactttctaatattgcccacgcggtacgagcacaggctggtttgttcttcttcttcgtgtcgtgcggctacctggctgagtgtgagtgagttggttcgggtttggcttgcaccagaattgtgtttgcattcagacactttcagaatgccaacagcgacttcttttcacgttatttaccgattattttttttcaaaaaaaaaatcttctattgtagtgattacaacacatgttttaatttatttgttaagtctatttatcaaaatatttaaattattctacaattaatctgttttaaactaaaagctagatagttctggtggaaattaagcctagtccgctcaataatatgttttaaatccagcctaacatggctttttgtcgtcctctttgtttagaaattaccctggccctacattttatatcttttgttcataaattacaacttccattaactacacatagttcaggtggaaaccaaaaaattacatcaaattggtctcacactacagcaactatatatgctagtatatattcagttcactgaaagcttgagactgaaggacgcagaaaaaatgctgaaacatgtattgtttgggggtaaagaactaatcaatgaatcaatggattccctgagagtagtccatcgatcctttgttagagtacttcaatttatagtacctgtttaactatcacattagtaatctcttacttactcctttggattcatccactaagtggtagactatcaaagccaatttagtctgtacaaaaaacaaaaacctaataaactcgattgtaacatactcatttttccttcaactcataggccaaccccgggtaatgatctcaactcaatcaaaatgattcaatatacccgattcgaacttgaatttcacatacataaggatacaccctatttgtatcagaagccaggtaaactatatgcaacaaattactttggttcttccattatcacattggcatttgacattgtacacctcttaccaattcttgatgaggcgacaggttagcactggaaccaccacacagccatagccatggaggatcagaattgagaagcttcagaagcttccaattcaagatcccttgaggccggacacctcgggaagcatgccctggatcctcctcagctcggccagcgcctcccgggcgtcgggccggtcgtccttgtccggcgccacgcaccggaacgccagctccgccaccgcctccacgctggccatcacgccggcgccctcgccgagcaccggctggtccaccacctcccgcagctcgcccacctgaatcttggccaccacccagtccgccagcgtcacgtccctccgctccctgcccacgtccaccggccgcagcccggtgacgagctccagcaccaccacgccgaagctgtacacgtcgctcttctccgtcagctggaacgaccggtggtagtccgggtcgaggtaccccggcgtgccctgcggcgccgtgcagcacaccagctccctcccggcccccgtggcgcatgcgtccggcggggacaggaggcgcgagagcccgaagtcgccgaggcgggcgcgcatgtcggcctccacgaagatgttcgacgaggtgacgtcgcggtgcacgacggcgggcttcaccccgaaatggaggtactcgagcgccgacgcgatctggaccgccatggcgaggcgcgtccgccaggggagcggtggcggcgggggcgccgccgcggtgacgccgcatcggcggtggaggtggtgggagagggtcccgttggggacgaagtcgtagacgaggagcagagcgcgcgggtcggcgcagaagccgtggaggcggacgaggtgcgggtggcgcagcgccgagaggatgagcacctcgttgcagaacgacttggtgatggtggcggatgcggaggggaacgacggcgacggcgacggcgggacgtggaggcgcttgacggcggcggggcggccgccgggcgggaggtaggcgaggaacaccgtcccaaacccgccatccccgagcttgcggcttggatcgaacccagcggtggcggcgcggagctgctcgtaggtgaacgaggggcgatgctggtggagcccgttccggcgaaggaacgccgcggcgcgggcggccgcgttggtcggccccgcggccggggccgggccccgcccgcggtagcggcggacggcgatggcgacgcagaggtagagcaggagcaccacgagcagcaccgcggcggcgacgagcgcggtggtgagcacgccgttgccgccgccggccttgtccggatgctgcggctgcggcggcgggggcgaggcgtggcgtctcgccgcggccggcgggggcagcgccgcggcggcgacggcggcggcgaggaggagaggcggtgggggcatctgggctcgcgatccacgggctggacaaaagttgggatgcgctgcgcggtggaggagaaggtcacaactactatgcagtagactccacaactcacgtcagcacatgccgcgcctggcaggtggggccggattcctttttcattaaacatagtataaacgtagacgctaacaacgcgtgtgtactcacccttataaaaacacacgtgcactatatcactataaacatctccaaaagattagattgacatatcttgatattgacgaagttatctcgaatatcttattgtcgataggtacgtcgcctatcactgaaaaaataattagttgtaaatggagtacatgtgtcaaagtatagaattttaatctagtgtattggttccattataggagatctaactagttgatctatgctcacttcataagtcggattccttttacttaaactcccatatcaaatggttcaaagcgacaaatttgaacgaattttgttcgttttcactttgacgttggcgtgtttagtcactcaacacgaagttttgactccgatgatccaatctatctccgggggtgtgatagcgtacgtcgttttcacccggcggagcgaagtttcttttctcttttcggcgtcggtttcatgaattccaagagagaagtggtgggcatcacacctgatttggactcttaacagaaaagtttaaggggagagattaggcgagtcaacccaactcaaagccatgggccatccatcgtagtggagagcgcaatagatagatatatatactccatttctagatataccacacactattgactattggacattaatcgatcattcaccttatttatttattttacaaatatataaaaatacgaggtatgccacctttaataacaaaataagtaatagatagatatactccatttctagatataccacgctattgattattggacattgattgattatttatcttctttttacaaatatataaaaatacgaggtatgcaatcttttataataaaattaattatagaaaaataagtaaaatttatattattttttaaaataagatgaatggtgatggagaatggcagtggatagacatgaatcacacaaggagatcggcgatgatgctgttttgcagcagcgtctcgctgtggctgtggcggtaggttttggtcgccggtggtctcggctacttttaatggcgctcatcatgttgggcgatgccgacgtgagatatggatttagtagtaacagcgacctggcgagatgggaatggaacggaatgcggctcttgttaattacttgtgccgtgtgtctcgacgcgatttcgattagtttagtgagggtgattagctgtttatgttaggacggtcgtcgcgattacaagtcgttgtactgtggtaggagtactaaaatacagtagttggagcgcggccactgtagtagaaagggatggacagtatatatagatagatgacagtcacaggctcgccaccagacaaccagcttcatcaatgggggttattcatggtgttccgtgccaaatttcatccaacgatagctttggcatgttgcattgaccgactcggataatcggcacgagtcaatgggccagtttggagagcattaaattctgagaagcagctgtttggtaactagtttctgagaatctgtaaaagttctgaaactcagcttctccaacttctggtttcttagttcatttttcagaatctgtaactacagattatcagaagttgtgaactgtttgaggcagcttctaacagaagcagcttttgggaaaagctgcagctgggacaaactcccctaaacagggccaatgagcaggagcaaaatttactgcccaaaccgttgtggtcttgtggatgagttcgattgtgctgcacaaagcagggttttctttaccattttgataatcgtttttggtgagagttaccgcagccacgatattacggctacagctaaaaattatgagttctaaaaacaacatattgatgagttctaaaaaattatttggctacagcaagaagtaaccgcaagatattgcaaacgacgctagcacacagcacacatatgtccggcaatgcaagatcaactttaagctgtgtggcaggtgttcgattcaatctctgtttgtgtgtactctaccgttgagtattctgtcccggcactcttttgagatggaaagaaaaagaggagaaaacaaaaagaaatcgaaaggaaaaggaaaaggggaaaggagaagacggcacgcactttgcgacgacacggattcagttatccatcccagtcgcaggctcgcaactcgcaaagcagcggcaagaagatgcgaatgcgatagtagtatcagtgtttgagcttttcttcatgtatgcacgcctattgtctacttgatcagaagttcattgtccactacttgatcagaagttcagaacatgataaagcgtaatagcttaaatcgcctagaaccgctgatacaggcagattcagattcattacccccaggctgaattctgccgagtcttcagaaatagggtatccatggatatcagaaataaacttctgaaaacctctttcccccaaaaaagatcatcaataaatgaagggtatagccgtatagatggtttgaggtctcaaaactcaactatgaactataaatatctcctcttcttttctttttctttttttgcatgcgaatacctcagctaatttaatttaggctaggctatatacacacgacaattagatcctaccaagtactccactggtacagggaaaaaaatgaatggagtaaatgtacaaccaatcattccacccaattcgctaccttctctccatagattatggaccgtatggccatggaaatgtttttgccactgaaatgcacaacaaaaagggaagatcattagacgaagaaaagaaatatcaagatcatccggttgagagcactcagcaagcagctgagtacactcaacaaaaataatgttaggagagtactcccttcgttccaaaataaacaaacctagaatgatgtaacattatacaatgaatctggatacactgttacgtcacatcacatcctagatttgtttattttagaacgaaaggagtacatgcaaatggacttgtccatattctgactgtaatagcaagatggggcaacaaactcttacaaaattcttactaacaaaactctcaacatttgattcaagtaattggaagttatagaaaagctagattaaaacatggtatgccacatcagcgtcggtaagaaatttgtaacatttttttggtaagtgtagctttttcctagtaattgggttctttggttgaaataccaaaagatgctgcgcatgcgcatgtcatatagaccacaaaaccattaccaagttatgttcactgtttaaggaaaacccacgacctgaattgtactatgtttgctgctaacagaatgataccaccatcttcagtacggtagctctctatcagaagagatgtggcactagattttgtgtatgcaccatctaacatgaacagctcatggtaacactgaaccttgtcatgctattcgtgttctgcaaaatccaaggatgcactaatacatttcttcactcttctaaataaaaagtttagtctgaaacataatctaggacagaaaccgttggtagatgcaaggacttcacatacaatttgcaacaatattgtaaaaggtcaactggatctaaataacaaaaacggttggttgagctgtaatggatgtgtagtgcaacctcattaacagctaaatccatcttctttttactgcttactctctgaaatctcggctttgtgttttttatgttctctatcgacgaaataaggcaaccttcgttaaaaaaaagttactactacttactctctgaaccaaaatctgaagaggacatagtacggaaaggaacctttcctacaacttcattataaagacatcctactatcctaaacttgctgaaaagggggtgccttagcattgtaaaagttggttatgtggatatccattctttgattcccagctggttgaaaaacttaaaattagtggctgcctggctggtatcatcatatcataaacaaattatattatgttctcataaaaaaatatattaggctctagtactccagttaacaagaggtaaagtactctaggactggaagcatgagagggaacaatggcaaccattgatcctctggctctactttccagctataaaactaagcaacacactgaactaactttacctaatacccacgttatgctctgcaagacctaagtcaaatgcgccattgagctagtccatcctcaaatcatctaatcttagactaatcagacagattcagggcatatcattagcctaaataaaatttagtttcttttacttttacaatagcatccaatagaagcaggagtagttaggatggtgaaaacaacaaggaatgacaaaattcaccttttgaggactcctggacaagcacaatatgcattgctgcattgtttggtggcagctgcaagcggagaggagcgagtttgccagtgatagggctgcgtgtgcagatgattatgtcatggaggcccgtctcttcctgcaacttgtgtgtgagctcctccaagttggagccattgaatgtgaatgagcgtgtctcgtcgtcttcgtccacatcgcccttatcatctgcaatgtggtagtagattgcacggccctccaccttgtgcaatggcgcagagaaagaaagggaggactgacagcacaaggaagtctcagtgttaattttctgaatcattgcaaaagtttcagaagtaattgggaaattggagaaatcaactataatagttccaaatttcttggcacacataatgattaaaagttccaaatgattgctaattgcatttgagcatctctatttgttgattctagaagcagctttatgaaatgattggttagttcatccaaaggacgacatattagcctacgcaattaaagagtgctccaaatctgaagtcaatgatggctttctttgctccaaatctgaagtcaatgatctcaggatgagatggagaccaattcgacgaacatgcactggtcaattcaatggagagcaagggaaatgttcgaacaaatgacaaacctcgagtctagagggcgcgggcttcggcggtggaggctgcggcgacgcgtctttctccagcggctgcggcgggttcccggtgtacgatttggtgggccggtggtggacctcctgcggtcgcggcggctgcggcggcgcgtctttctccagcggcggcggcggcgggtgcccggtgtaggacttggtgggccggtggtgcgcctccggcggcggcggcggcttcttaagctcgggcgcgtgggccggcgacggcggcgcggcggaggtgggggcgcggtcgtggccgggggtgagcacctgcacgatctcgacgtcccagagcacccagtcctgcgtggcggtgcggtgcggcacgtcgtgcgtgaccgagttccgccacggcgggaggccgccgttggcgcggaggtagtggccgtaccgcgtcttgagcttcgcctggaagccgtccttgacgggctcccactccagcgacgagtcggtggcgcggccgccgggcggcggcgcctgcagcaccttgcggcccgtcatcccgagcaggaagggctcgttggaggcggagaggtagcggccgtatcggctgcggaggcgcacgacgccgggtgagtgcggcacccgctccaccgtccaccgcgcgttcgtggcggcgccgttcctgtcctgcgtgacgtgcacctcgtcctcgtcggcgtagaggaacttgtcgtggtggctcttcagcctcaccacctgcgccctcgcgaacagctccatcgccgccggatctcctcctcctcctcctctctccgaggcgagagagattttcttcttcttcttcttcttctccaagcggcggaggcgacgaggtggagttgagttgagttggccggtgacgaggaggagggggattaatgggattaattaatgaggggggacgacgcgtcgctgccggtgggggccacggttgggggagagcccacctgtcggtcagttgcgggggtttcgactttgactggctcgcggttgcgggtgtccggcacgttgggatgggtcgcgcggcgagaaggcaacgcgcggaaatggcgggacgatggattccgtttacctcgcttgattactgcctctctcatcatgtaaactggagtagttactgctttggtagccaaccttgtacgacgatttcgttgtgcctcacgtgatgatgatgatgatgatgatgccttgatcgcaaaccagatcgttcatcgaatgacaacttgcattgttgtttttagttcatgtagtacaatgcaaacattggtttttttttaattacgagctcaattactactatgaggtcaagtaaacatgaaggcagagcagagcagagcacacgcgtttgaagttgtacttgggaggatttaagcgccgacggggaaaggtgtggatggccatcaattcaagcggccttcgtagcatcttctgctgataagtttggtttgacctggagtctcgcctactagttccaaatagagctcccttccaaatacggcggcgcgtcatcaactgccgaccacaacatggccgcccccaaatactcctacgagatctccatcggattcagtgttgcttgcacccgtgcaatccaatactcacgtgatgagcgagcatcgttcgtaccggtctaccggacagcttgagttccgatctcgcagcgacaataagatcctgcttcgtaaatctctaactttaaaatttagctttaggaggtaggtctggagtagaattgtggaatagccaaaacctagctgcacatcacttattcattctgtgagattactccatctagctccgctcctaattttagatggagctaaaactgtttggctgagctccatctccaggagaggtggagctggagctgtgtcaaacataacctaaacccaccaataaacttagtgattaagtaacatgaggatagaacaacgctgcacttgctcactctttccgtctttcgtgtggcgatgaacaactaaattctcagtgtaccagcaagaataatcaggttaggagttaggagcatctacttttgccatacgagaacaaaaaaagaaagtaatagaaactttgatcagtatagctgattaatcctagtatgtcaccagtctggtagtgccgtagtggtagcgaatagcccgtgtttgtacatatgaccatatgataggataaatttggagaaaagtcttggagatgtcactgtcttccagactaaagtttgcgtattgacagtgtcaagccatggcgccctgctatgcatccctgtatcattaaggccttaaacaattagcaagagaaagcagtccaaccagaaatatagtgtttagaaaattaggacaagacaaacagctcagcctttccacgtttgcatgcccttctttaaagtcactacatacatagaagttttttttttaaaaaaaaaagtgtgcgtccatgaactccaaatgtatggaaaatttcctaattatatacaaacttttaaggataaatatattgttatgcaaactttctttgaatagagttattatcttgaaaggttattggcacatccggttcgatgtagatgctggtttttacccattttgaagagaagaaaatcacaaaaaatcgttgtacgaacgtacatctgttggttcggtaagatagtactactagtggtgaattccatcacgcaggtgacattctggacgtggtaacaacccatcaaaacttgaatcacaaatactcctatgtggtttctgaaacgtattggagtcatcaaccaagcaccggcgttgaatgcggtccacgtcaaaagacacagaaacttggccaaatttagacaagggagaacatggtgcttgaaaagtttgtcaaatgcacataaccattcgttgtctcaaccattgttgttaccccttccatagcttagatcacaaggagaagaaacggtattgatggcgagaatagcataaaaggttaggcaaataccagaaaaacatcctaatctacaatatccaatgaggcaaacaccaattccacaagaaacatacaaactgagggcattaagacaccagtctcaacgcgaaaagaatacccaggaaaaccacgtcacgtccataacacgcaaccacgcaatcaatccaactgtgtcagtgcacctcgcagtaatcaaatgggtaaatgaccattcaccatcatggacaggccaatcacaggaagcagcacatatcgtacctgttagatggatctccctccccttgagcccaacggctcaagggggccttgacccgcgtcctgatcgggggcgcccagcccaatggctggtgggcccccgtcacactgtgccatataaagaggggtggaggacgggacggcaagagacacaaggaacgaggtttgtcgccgccgccgacacttcaccccataaaccctaaccgatctagggggcgcagccagtgac

SEQ ID NO: 59277 - DNA, 26317 bp, Oryza sativa
caggctcgtgcgccgttgggtcagtccacactctgcaccagggaccaggcgtactggatgactacggttccgatggtcttcgacatctgcgttgagcctcacgcccctttccacgtgatgcggcagttcggcttccgtcagccctttccagtaccgtttccgacgaccgtcccagctgttgttcaccggtaagatctttcactatgctttcagttgttgcattaaaatctacctgtccacaataatttgcaacatctgtcgattcacactaatatgacacattaattcgcaggtactcgcgcaagggtcagcagtcagctggcgactggcccgccaagttggcgacttttgttgaggactggttgctcgcaaccgaggaggtcgtggaccacgagggagagccacacactgaggaggcgtaccaggcctacctacgctggtaccagccacgcacccgtactagggtcaccttcgctcccttggagcagcagccccacgttgtgagcactagagacctctacgccaggcaccgggaccaggacttcgctcgtgctgtgagtaccctgcatcacaccattcctttatgttttcatgtctttctctttatcaaattttacgaatatgtacgaacaaattaaccatgcaggtcgacgacatcaaccgggtcgtcgactatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtagagacatgagcgccacattgccatgatgttgatgacatgatttgtgaaaggagaaataaaattaaacaactattttcgactggggcggacggaggatttgggtggtatctggaaaaggctagtaccgtccccggtcaattaaggaccgagccatgaagttaagcatgaaacgaccctcgtacaaccgcacttctcgtatgggtatagacctagcggagtagatagccgagcggaggcagtatccctgcatagatggttcacccctgagtgaggcaggtgcgctacggtgggacagccgttgaggtagggccgagaggcgtgccctacatcggtgtcgccattggtaggactgccatgagtgtgtgagagagagaacttaacttgagccataatttaatatgtgtgtgagacttctctttcccgggagcgccagaactcctctcactgctagaaacatggacgcctagagtgcatgaggatttaagttcatggagcgggtactgccaatgcgaggttatcaaaaggctttgccgtggcgcgtctcatgtgttgggacgaggctcatgtgttgggcagtcgcggagtgcgggtaaagtgtacatccactgcagtgtgagtaaaccaaatctattcgaatagccgtgctcgcggttaatgagcaccgggacatgtattacacttggctagactctaaattcttaacttgtgttggatgggatattgcatggtgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggaactaaaatttgatcagtctatgataggtcttaggcttgtgaaaatatttgcaaaacgcagctttatgcaaaagaacctgaaaccattccttgaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttctgctgttgttctctgatagttgttggcctacctggccctaatgtaagtatttaactcttttagtctaaattcattcgtgatatgttgtgatccaactatgtatgtgtgtaccaactactgatccagggattggtacggataaacacagaagatttccgatttccaaaatcgggggtctacaccttagtaacgtttgataaatttaaatagcctgtactctagttgtacataattattctcatgattttattactatttcataattttacaagttatcttttgttttacattagtactttttgaattgttctaacacgaaacactatatttttcagagatggcacgtcaggatacacctcagttgttggacccggcgatagatcaccgacactggtctcaccttactgcggtgcagggggctcagcttgggacgttccgggcacggacgtgcggtgagctacttacggttcacgactcctttgtcgagaggtacgaacagtgtattactataacttagttgcgctgtactaatttttataatgacatattaatttgttattacaggctgcgtgaggccagagacgcacacttttcacttgccgtgcggtgaggtagcccctaccctacaggacgtatcgtacttgttggggctaccgctcgcgggagacgctgttgggccagtgaccgcgggtgtggactggcaagacgatctgacggcatgtttcgcactagtacagcgcgcaccgcatctcccgctcgagccgttggcacaccaccgcaacaccggacctacgaagaggtgactgcttcagttcaccgtgagtgttttttgtaccgaaatgacaagcgtactacatatttagtccacaagtaaggtgcctaacattttatcgaacgcttgcaggtcgagcagctacaggcagaggccgacgagtactcctacagccgctgtttggaggcgtacttgctctggctttttggctgagtgatgttctgtggcggtcacgggcacgcggtcgacaagggactcgtgcactaggccaggagcatcgccgacgccgcggtaggcgaggtgcctcagtggagctggggttccgcgttgttggcggctctgtatcgtggcctttgtgaggcttgcacgaagacggatcctagcgcgacctttggtgggtgccctctctttcttcctatctggacagctgagaggattgcgatcggtctgaggtggaccagcacgcgtacgaggagtcactgtacgcggagcgaccagaggtcaactaccctacgatcggtactctgtggtgccgtcgtcaggtacatcacatcgatcttctcgtattgttaagttaattgctaagttcattgtacatcacatcgaacgtctcgtattgcagcaccgatgggctcacgtccaggttaggcggtcgtatcctgagtttgttatggagttcgaccgccttctgccgattgacgtcgtgtgggagccctacagtgtcgcggctacccaggctcgtgcgccgttgggtcagtccacactctgcaccagggaccaggcgtactggatgactacggttccgatggtcttcgacatctgcgttgagcctcacgcccctttccacgtgatgcggcagttcggcttccgtcagccctttccagtaccgtttccgacgaccgtcccagctgttgttcaccggtaagatctttcactatgctttcagttgttgcattaaaatctacctgtccacaataatttgcaacatctgtcgattcacactaatatgacacattaattcgcaggtactcgcgcaagggtcagcagtcagctggcgactggcccgccaagttggcgacttttgttgaggactggttgctcgcaaccgaggaggtcgtggaccacgagggagagccacacactgaggaggcgtaccaggcctacctacgctggtaccagccacgcacccgtactagggtcaccttcgctcccttggagcagcagccccacgttgtgagcactagagacctctacgccaggcaccgggaccaggacttcgctcgtgctgtgagtaccctgcatcacaccattcctttatgttttcatgtctttctctttatcaaattttacgaatatgtacgaacaaattaaccatgcaggtcgacgacatcaaccgggtcgtcgttgacggttcaacgacgatccaacgtttaggcgcggggattccggtacccgtagaggagcacctgacgacgtacacgcagatggtggagtcgatgcgctcgattctccgagtgctcacctgtcgtgcagacgacgttgctcgggcagacgtagctgtacagcggccacccgtaccgactggtccccgtccagctgcgcacgttcctaggccgactccccctccgcacggaggtaagtatttttaaggatttttctgcacatgcctcgcacatatatgtgagccgtttcacttgccgattgcttcagggtttcgtgcaccgttcagcaccccgccttcctcggctaggccttctgttgtgccccccacaggtacttaaaaaataacattacttcgacaatcaatttacatgcattttatgtcttagcttacaagggtcccgttgtcgatgtgtaggtttcgcccagttcgctatgacgcaggccgcccacttctcccaggctgcagggtcagcgtctcaggcagctgcatcgacctcgcactcagcgcagttctggcagtacaccgggactttgtcacaggcagccggcacgtcgagtcagggtccaccactggaccatgctgggacctcgtcggaccgcttggtgccttccaccttgctcttcgacatcactgacttcgacttcgcttcaggctcgacagaggagcgtggtcgcgacgcggggcagggccagtagagcagtcttctctttgtttatttgcttcactttccagtactgtatgcttgtgtaatgaatacgttgttgttatatgtgcacgatacctgttggcgcatgcacgatacctttcggcgcatgcacgactactttctgccgcaccgatgcagcctcctttattcgcgtacgatacgagtatttgctcgccatttgccgcatacgactaatgtaactttcggcgccgatcaggcatgtaactttcggcgccgatcaggcgtacccaccatgccccgccacgttcacatgtcagggatatcactcgattttttgcgcccatataagtcgccttaacgagtgaggcctcacaatcttccagaactcagtcacattcagtactctcttccccacttgcttcattacaaatcctaccggctttcgtcaatggctagacgccggggtgttgaggatccgaactggcgtagcaatacttgtgtatacctactaccaccttggtgccagcgtcctctctgcctatgcggtgatcgatgccaactaatggcttcgaggaatcctgatattcgaggaaggcgcttttttaggtgccctaactatgatcgtgaggtattttattatctgcatatgcttattcattccgtatgggcaatcgttttattcttcgtaacactactctattcggcagacccgcactacggcttacgcatacatcgagtgggtcgatacagaaaatcccgttctcgacctaaccacttgtttacaagaaggtcgctggtatttcgcatccaaaagtactgagcaatacttacagagaaaagcggcttatgaacgacaatgtcgtgaacaacagagcgactggcaggtgctaactatagcactccctccatgggaagcccgtccaagatgcaggtgtggtgatcgttgtcaggttcttcattccataaagcctacaacattgggtcgaaggttctttgtttgtccaaatattcttgacgacgatttcatggtaagaatattttgattacatgaatcctttttttctcacaacatttactaactttgctcgctttaaatctattctttcctcccaggaaccaccaaggagatgtcaatacagagaatgtatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatgttacataactctccttgtttaagtccatataatgtttctacgaccgagactgcgataggcctatattaattatccgagtactaatacgtcgaataagttacaaaataataccttacttaacatatgaaattgcgaaacaaccaacttcaatacatttttataacaatattaacatgttttaccaataaatacttctttatttattattaacataacatagaaaaatcgtttggccgtactttttgcatctgggtcccttgccgccctctactggggcggcaaggggcccaaatgcaaaaagtacgagcgcaacctctttatggcggcaaaaattgcaattagccccttgccgccctctgtatgggcggcaagggggttattgcaatttttgccgacggcggcagacggcgcggtcgacccgctgtctgccacgtcagcttgtcgcccaccactggggcggcaggttctagttttgcaatttttttggccgatagattatttctgtaaatattaaaaaaaatctaaaaatgaaaaaaattctgtgcaatggcagaggatggtaggcatggtgcacatgagcgaaacctatgtgcgatggctgctttcgtcgagccactgcgcgattgcatcgcgctctcacaggtgcagttgtctgttttgggagcgtgattgtggtcttgtagacgggcatggccgcatggccgcaagggcatacattgccgacaaaacatgagataacttctgccaaaaataattgaaaaatataccgttaaaattttcttttcttagaaatatatgacaagcaaaaaggttttagaagagagaatataccgttgtcacgagggagtaaagcaaactcatgacgacgagatcgtatggtgaatctgcaaagtggcgatgacaacaacgatatcgcgggactttggactatttgccactctcttcaatagcacattctcaaatgccatcttccctaataactctaattatttgtgttgaaagtatgtcatgaggggctttgatcgaggatgccaaaaccaccacacctatgaagtgctgctcgacgatcaaggggttcgactggggtgaagccgagggggcaaggccgaaggacgaagctagaagggttcgccaccctgtccataggacttgtcgtcaagtctctgtcagaggcgaagccggaggggttcgaccatgagctagatgccttcgccaaacatgcctgagagtgcgggatggcccaagaaggccattcgccacacatgggctggcccacgaagcccgactagggccccatagctaggatggacactatgtgccctcactaatgtccttatcttaagggtatcaatataaattctcctatacacactaaaccctagtgagtatgagtctttactaagactataaaaggccctataggggcatgtaataggggatccaaaaaaatatcatcaattaataccttgttttactattcaaccactccaccgagagaaccacgtctttcgacgtgaagctattgtcgcttcgacaacaatttgccatcgtgattcatcaaattgtttctattttgccacttttaactgccaacacactaaaagaaacagaaaatgaccttactgctcctctcatctcctctatcttttcttctttcctcatctctcctatgttattcctctcctacgtgagaatcccatgtactgttgcagttggatggatggcgcgagcctccgcgatttgacggcgaggtctttgacgagcgaggatatgtcgaggtcacctcgaccacaagcgagatactcgcgctggagcatacaacttgacccatgccggctccctccccccctcctaaacatccatttgcaccgtttctcccaacatcacaggatctatgcgaagggcctgcaaccaagatgtactaccttggccccgatgacccattcgatgaaccatcaaccattgtcgcatccattgcttgtcctgctatccggttcatccatggcgctagccgtccctactgcttagcttgtctcacaccagagattggttcatgccatgccagagaggaagaaggtagaagggagatgaatgagagggtaatgaggttattttcttatagttttgctaagttgtcagtcaaaaataacgaaacagagacaacttggtggatcacgatggcaaataacaaaagttattgggaatgataacatttgagaatgtgacatcgaagagagagtggcaaatagcccaaaatccctaacatcgtgcccgacaaatgcgaagtggttgtttgcggaggtggacccggtgacgtcgccactacgcgctttgagtccacgagagtgtgggcccctatcatgtcctgataaatccaccccgaattaaaaatcactttataaaagaaaagaatagaaattattataaatctaaaagaaatctcaagcactaaacctctgtaaatattttctgctttaatgaaaatacattgctaggcaaatccctagcagctttccaggtgattttttttttcaaattgagcttggagtatttttcctaaaatctccatgttcaaaattggtccctcgatttttacttgatttctagagcaaaagaaataattttaaagcaacaaaaaccaaatttgtagttaattaaaatgaaaacctaaaaataaatctctccttctctttaggccatttccggcccaaagctcttagttgctctttcggcccgccaccggggtcctcttctctctctcctccttctcgggccaacctcctcttaaataaatactctctccgtttcacaacgtaagtcatatatatatctagattcattaacatcaatataaatatgggaaatgctagaataacttacattgtgaaacggaggaagtagctacttgttggttttacaacgccgtaatcttgttttgggtttttttttcttgtaactttccttgtaagtatttttttatgcttttgtaaaattacactattgggttaggcctggtagtattccctaaaaaagttttttttgttttttaagttaattaattaaacttgttcaatataccggataaaaaaatcccttttttctttgttaacatcaattccacatggacgcaatatatagtctgccggcctaatgaagcgatcaaacctccagactccaaagtccaaactcacctacggcctagctttgacagctacgtatcctatacgaaccatctcattattatgggaaactactctaaactcgttgttatgaattttttttaaaaaaaatagattaatacgtgttaaattattatactaacatgcaagatcaaattctatttctatttctatgagttgcaactgaaaaaaatttgactacaaatatacgttaactagatattatttaatttgtctttttcgttgcaacttatagaattcaaattttaccttgtatgtgtatagagtgatttatcgtatattaacaatttatcttgttattttttaaaaaaaatcataatcatttgaatcatatgtaaataaggattgagaatttagaatccccttaccattattaccagcacatcaacgcccgtgctgccgcacgctgagcaccgtgcacgagcgcatcgttccgacgttccctttctttcgtcgtggactccggctactcctccgctgccgccgccgccggcggaatgcacgtcgtgatctgcccattgctcgccttcggccacctgcttccgtgcctcgacctcgcccagcgcctggcgtgtggccaccgcgtgtcgttcgtctcaacgccgcggaacatatcccgcctccctccggtgcgcccctcgctcgcgccgctcgtctccttcgtggcgttgccgctcccgcgcgtcgaggggctccccaacggcgccgagtctacccacaacgtccctcacgacaggccagacatggtcgagctccacctgagagcttttgacgggcttgccgcgcccttctcggagttcttgggcaccgcctgcgccgactgggtcatgccgacgtcgtccgcacctaggcaaacactaagttctaacatccacgtgaaccattcatgagatggaagaagagaggcagaaccattgaagacatacgcacatgatagaattgcagagaaactcgtcccgcccaggcaccccggcgcccagcggtcgcctcctttgcccaatcactcctcattcgaacacgctcgagcgcgctgcagagaagctcgtccgctcctcgcgccaaaacgcgcgagctcggtcccttctcgcctttacctcccctccccttccttatcgcgacgtttttcggtctctgcttggtctgcaaatgggccgaaagcagctgaacatcgcgcatgagacgaatgggaggaggacaggaacgcttccactgaacttgtgccgttggatgtggaagcaacggcgatgcggaaagctacgtccctctgacgtagaatttaatacgtcgcgcagtaatgaagcaatcagcccgatcggagcaagcttggtaaacctccaaagtatacaaagtccaaacccacgggcggtactgcccatcgcatcatcaggcgtccgggcggtattcatcggtcgcgcccgcacatcgacgcccacgccgccgcacgctaaacccgcccgctcggccgctccacgcgcgcaccggcccccttcttccgtcatggactccggctactcctcctcctacgccgccgccgccgggatgcacgtcgtgatctgcccgtggctcgccttcggccacctgctcccgtgcctcgacctcgcccagcgcctcgcgtcgcggggccaccgcgtgtcgttcgtctccacgccgcggaacatatcccgcctcccgccggtgcgccccgcgctcgcgccgctcgtcgccttcgtggcgctgccgctcccgcgcgtcgaggggctccccgacggcgccgagtccaccaacgacgtcccccacgacaggccggacatggtcgagctccaccggagggccttcgacgggctcgccgcgcccttctcggagttcttgggcaccgcgtgcgccgactgggtcatcgtcgacgtcttccaccactgggccgcagccgccgctctcgagcacaaggttgcaccaagtcctactaatagctcaatctttgcactaaccttaattacataattccatcattgatgctacgttattcgccttaggtgccatgtgcaatgatgttgttgggctctgcacatatgatcgcttccatagcagacagacggctcgagcgcgcggagacagagtcgcctgcggctgccgggcagggacgcccagcggcggcgccaacgttcgaggtggcgaggatgaagttgatacgaaccaaaggctcatcgggaatgtccctcgccgagcgcttctccttgacgctctcgaggagcagcctcgtcgtcgggcggagctgcgtggagttcgagccggagaccgtcccgctcctgtcgacgctccgcggtaagcctattaccttccttggccttatgccgccgttgcatgaaggccgccgcgaggacggcgaggatgccaccgtccgctggctcgacgcgcagccggccaagtccgtcgtgtacgtcgcgctaggcagcgaggtgccactgggagtggagaaggtccacgagctcgcgctcgggctggagctcgccgggacgcgcttcctctgggctcttaggaagcccactggcgtctccgacgccgacctcctccccgccggcttcgaggagcgcacgcgcggccgcggcgtcgtggcgacgagatgggttcctcagatgagcatactggcgcacgccgccgtgggcgcgttcctgacccactgcggctggaactcgaccatcgaggggctcatgttcggccacccgcttatcatgctgccgatcttcggcgaccagggaccgaacgcgcggctaatcgaggcgaagaacgccggattgcaggtggcaagaaacgacggcgatggatcgttcgaccgagaaggcgtcgcggcggcgattcgtgcagtcgcggtggaggaagaaagcagcaaagtgtttcaagccaaagccaagaagctgcaggagatcgtcgcggacatggcctgccatgagaggtacatcgacggattcattcagcaattgagatcttacaaggattgaagcatctcaggatgtacacctgcaacagtgcaactacaaaatccttggaataaaatgatttttgttttgtagtccacttacccaaaatatgcaaaggccgaacggtggggaaaattctaatcctgatttttttttcatttttgtttttctttgttatttatcaatttgataccgcccagacaaagttgaaatttaattgtaaaactttttatagtacatggaacacgcacaacatactcatttcctgtagagtaatgctccggtgcaatctacttgcagtattctactccgagtagaattaatctcgaccgtttattttaaagggcaggtaagtaatctcctaatatcgtttaggggtaattttggtttgggatgttttcttcggttcgcatcgcatcaggtccggactccgtcgcatgcagacacctcgctattcctcccccggcctcgccgccttgtccgccccctccgtcaccgtctgtatcccccgccgtcgccgccttgtccgcctcctcagtcgcatcgtccgtctaggagcggacgagcgtggcagcgtccgagcgagcgacgatcttgagcaggagttctggtggtagtaaaaattctggcatgggcttcggcggcggcatcacgcacgcacgcaacgtcatttgcgtggcggcatcgtctcagctcattcgtcttcttgtcgttccgattgtttcatggattacatggatcgattaagatcttgcacgaccaactccgacgaggatgacatggtgattgatctatggattggaaaacgataatacccctacgcgaattatttttcctggatgaaaacacccctccacatttctacttccactaattctggtgggagtagaactagatctcagccctacaattaaatatgatcaagggcccaaattactttctactccgagtagaaaacaccggagtaggactgtttcctgtatgtgaaacttttttcgagattttccaaagaaaacattcattattcattatctggcatctcggagagggcgagaggcaagcatgatgcaagtgtaccatgctaataatactgtacttaggagactactgactactccacgcgggcgtcagtcgtcaaagttcataaatagccggcagcggaacgtctgattctttaattggtggagaacttaactttgcactcagcttgacaaattgtacaggcaagatatcaagatcacgggctttttcatctccaaacgatcacaatcttaacttaaacaaaccagggtggaaggtaggcaaagaagaaaagtacaaagttgcattgtgaagttgcagtaaaaaaatgtcggatgacatgcagatacagcaaatgcttgacttcctcggtggcggtgccggcctgccggcttaactaaagtagttccttccctgattggatctttcaaagtctccacgactccaaagtgcaaacatatatttgagcggttcagcccgtgctaaactggaaactgttttttggatggacgcccacctatttattacatatcaactaaacagttataatttttttaaaaaaaacaagatagattaatatgtaatatatcattcgacaaacatgcaaattcaaaatcgacttctataaattgtagcgaaaataacaaatttaattgtgaattaatttgttatttaattgacatgttagagtttaatacatatactagttagagtttaatttgttgtttttgttacagtttagaaaagttaaatttgaacttgtattttttggagtgatatattacatactaatctatattatcgttttttttaatttttttataactatttagttaacatgaaatgggtggacgttcatttaagatattagaatccatcttcatcccgcgtctgctcgatgatatccatgttcttgaaatagaatccagattgctctacctctgccttgcgtgttacaggaagaaagctgctatacgttcgaccgacgcgtacgactcaacggcggaatacacgacgtgagccagcagcccagcactgacttggttatatggtttgctgctcccactgtcccacagtcccacataatccacgtggaagcacatcaaagctcatatataaagcccaaacttcaggcatggaaaattaaatcaaacaaaaccgttgatgtagatgtttgtaaaaaaaaaaagagagatgaaaaatttagaggagaaagggaggagactaacaaagttcagcggcgaggtaggcgaagctgcgaggcagccgcccggtcccctccccactcgcggctacctggcacctctccgacctggcgtggcggcggcggctcccagctagctccggcctggcgcgggcgagggaggcgaagctgcgaggcggccgcctagtcccctccccactcgcggcggcctggcgcctctccggcctggtgtggcggcggcctggcgcgggcgaggaaggcgaagcggcaaggcggcgatgcgaccacgagggatttgggcgtcgggcggcaggaaacggagagcgtgggctgaaaacggaggctgcaggtgggccggcgcagcagaccgttcgattagatttcaacgctccagatcgctccaatgtcacaccatgccatgccataacaatgtcactgaatttgaatccctaccacacggtcatcaccgccggcgacagctattccttgcttgcgctgaggtctgctcgtcgtcgtgtgtgttcatgtagggaaaaggaggatgtaggaacactcagaaaagtaagaatggaaaaggaataggaggcgctgacatgtggatcctacatgttgattcagcatgttagactaagtcaatgagccatgtcagcaagaatcgctttcaaaaccaccgagtgattttgtatcagttttaacaatttggggttcaagatatacggttaaaggttacaaattagattagacctatatttgagggagtcaaagtggacttattctcacctagcaacacttgagtttcccaagtcaatcctctcattttctacgtgcacgtttttcaaactgctaaatgatgcatttttttgcaaaaaaaaacctatacgaaagttgctttaaaaattatattaatccatttttagaaagaaaataacaaatacttatttaatcacgcgctaatggaccgctccattttgtatgcaggaggatttgttcccaactgcatctaccgaatgcagccttattttgacaggtaaccaggaaggcagcaggcccggcctgctcctggcccaaaactcgttgtcctaataccttcacgggccggacttgggcacggattttcggcccgtacaaaatgggcttttcttctacgcggcccgatcagacccggcccattcccaggtctgccgcggggaaatcgccttcgggcttcggcccctttgcacttttgcagaggagcaaagcttacaatagggcaacccaaaccaaaccctggccaaccccacctccaaccccccgcgcagccgaaggaatcctcgacggcgacgacgatggccgccgcgacggagaagacggccgaggagatccgccgcgagctccaggagctccagcgccagcaccgcgaggtcggtttctctccctctctccctcccctgagagaccaccctgtactcagcacgatctcctctccccgtgcgcagatcagcgagcgcctccgagacccccgcggcctccgccgcggcgcgcccgccgctgcaggacccggcgggccccgcccacttcgcggattccctagaccagtacggcgtcgcgattgcgtctcctcttccctttccctttattttgtattcgtgatttgatttatttccgtgttcttgtgttgcaaggctgtggatttggtggaccagtctgcgcctaagcggaggattctatctgcagtggttaaagtatccgcctaggctttggttttttattttccttagtcaaacttgtggtttgtttgtcgataaccctaatattctgtgcatttgtttggtgtcatgaatggaggtggaggatactgaagctaaggaggatgtcaagaaggaagcggaggcagaggggccggagggcggttcggctgctgctgaaggcggtgagaggagggatggtgggttcaggagggatgggagccagcgcatgccgaggagggtgagtaggctggaactataggggattgcgggttgagtttgcttaactgtattgttttggttgcaggagtttgatatgtcattgccagaacctctcccgagggaatttcccaaggatgaggatcaaagccttgtgaagaggaacaagaggatgctggggaagcttcttgtcggtacattagaggtaaccgattcaatagacatacaaaggaacaatccatgggtcaagcgataataagatatcaacagttttcagtgtttcctctccaactgatacacacaaaagaaaattttcagtatttgttaactagctttatcttgggtatggcaacctgtcaattaggtaggaatttaatggaagtactagtggcaagccacccttagtccccttcattgtgaatatttcaaatcagtgtaattgatttttccttgtgcttggtaatccagaaatttcagcaagaggacaaaaaactgtccaacacagaggcttatatgcgcagatcagaggttcagcgaaaggtactaacaatttctcttggtcttgggccaatctacatttaagcatgatttagtggctgatgtcagttgcatccactttattcacatgatgacatgtgctaattagaaatttgattttcatacatggaattatgaatgtaatattgctgttggaatttaactattgtgtcccgtgccatgacccatgaatgaaccaaacgatctcaataaaacacatacatcaacagaaaacgtcttgtctcctgatactacatcaatgaaatttagataagtagaatgcatttttcaagcagtgttatgtttttctgttcctgtggtcctgaaaatatctattcccataggaactatctagcgcacattcactttatacaactacctttttgttgctatatgcattgccctagtagaactttggacagtaccatgagttgaatggaccgtgttaaattctttttattaccattcttttgctggacttaggctaagtgatcttccattattgagatatcgatttcattctctagggtctcagttctttctttcaaagtaatctcgcatatactatggtctagccttgattttattctcgctattaggtctgatgtagcatggaatattgaaaaagattgcgtgaatgtaggctgatcaaaaggctcgtgaggaaagtgaaaggttgcggcagcaagagcgagagcaagcaatagagaagcgtaagcgtgatatggtaagctcacatcagtgtttatgacttgcatttatttatgattggttcacctgagttaaattgatgagtttatgttgcaaatggtttcctgatatgctcttgaatagatgctgcgtgctcgagtagctgctaaggcagaagaaaagaggttggagctgttatacatgcagtgggctgagcatcacaaaaagctgtccaatttcttaaggtcgctttacttctttgcatcattctgcacctttttttatccatgaatggggtccctttttgtttccttttgttgtgccactttgcaatatttttatctgtatttatcttactcttttatgaactggtcttattgtgtgctgcaggttatttttattcctggtccaaaagtatccatattgacaattaaattgagggaagatgcgtttctgattgtgcaaatcttgatgtttgatgttcataggggtttctatatccattttgctaaattacacattagtatctttttgaacattattgttgtttgtcaggacaactgcggaaccaccaatttactacatgccagctaaaccaataattgatgatccggctattgctgaggagaacaaggaaaaggtattttctgccctatataagtcaaagtaaaaacgctaagtttacaaatttttgaaggatgaattgcgaccctttatacacacctccatctacatgcaacttgggaggcagaacactacagatgtacacaatgaggacaaacttgtgcctactacaaataataaattgtctattttgctgctgtagtatttgtgtggcatagctaatttcatcatagggcaccatcagaatgccagttgcctgcatatatccagtcctgttggtttctgctctgtcatggttcaatcaaacatcaaataagtacaacggctaactgatcagccagctatgaaattgctgcccccctcccccgcattatgattattttggtgacatgatataaaatcttaccaaaaaatgcatatcgaatcagtaaatttctgggcacttgaaagtacgtggtcagtgctatgaatttgtcatattttacaaagctttatacttgaagtgctctggtggtttgggtgggactggctgtattcgataactgtgcatcaatgctcttcctttgcatgtatggagcatattgatctaacctttcacgggatagtccttggtcaagtgcaacatattaagagaatgccacttccgcaagtcaatactcatctttcacattttgccatttacatcatatgcttgctagtttcctgggcttccttttttgtacaatctggggcaaccgatttttctttgtcctcttcatccatcatgaactcatattcaatgttgcaggcatttcaagaatggaaatctgaacgcagggctgagctaactcagtttcaaaagcaagtcgaagaacagtacatgtctaatgttgagaggcagttggaaaggatgcagaatgcgcggaatgcacggaggggtaatggtccttcaaacatgcaagaaatggacaaggagctggacacgcacagggcggagcatggtccaaaaactcgacgagttcttgagggtggcaatgacgatgaggatgatatggacgatatggccgtggaagatgagctgatggatgaagtccttggcattaacgagccaatcagcgatgagcaaaccaagccgtctgaagaagctgctgatggtgttccggtgtctgaggaagtgcaataggtaatttgttttgtattgttgcgaggtaggcatctaggagttccacatttgatatccttcagctgccctcattttctgacgcttgttgtatgtctgttgacgcttgagattttccccgctgttatcaagccatatattgttgcgggatgtattgccgttgagcgatatactctgttaatcattgcatcctttgcgtttctagtataaatcgagcaatttactgatgaatgttggcttgcccagcgacaggggttatcaaactgtcttaagattaccatgatggttgacatacgaaagtttagaactattttctgaaaaaaaaaatcacagttgaactgaaattcgttggagcttaataagaagcttgccgactgtaaagtaattccaatgggggtatatgttaattctttacaagaagatctagatgtgtggccgcatcgctgctatttattgttcagtctcgctcagggaaagccttctccaagaaacttgcaatatctatttactgttcaatcttgctcggggaaaaccttctccaagaaacttataaatcgtctcgaatacaaatttggatcaacagctgatatcgaaagagggtcgaattttagtgatttgacagcatgctcaactcttttggacacattatactcttgtagtatgtcgatgataccaaggtataggacaacatcatactcttcaatggtgtccctgttttctacttctacgttcacgtcctcttgcactttccgagctcgagctggcatattcacccctagctgaacacggaacctgaaaataacgaacaaatgagtcagaaacagaatgcatctttgtgaaaacaaagtaccacgcagaccatagtttcagaaaaaaacattgacggcatgtaaaacgtgtgaatatgtggttgggattttctgcacttatgatatgcaactgcaccaacggtaagtttaagttagtatagcaggggcacaggtgcaaaaaagtgtaaaaccaccgccgtatgtgcactaaagaagacaggcaatgtatattactgatatttctttccaaatatatgaacacacacttgaccttgttttaccatgcacaaaaatgataattcttttgacacagcctattcaaatgcacgagctattatatgctctacatctatgaatgcttcgagaattcacacttaactatcaacttgcaaacgtagatgttgcattgaatagtcataaaattatcgtgttgtctggtggagctgccatggttcacccaacgttgagttgtattgtgaatgtttattttaaagctaaagggttgatataaaagttcaaaaaatcaaataatggatcaagtcaccaacaagttcgttgtactttgtactttagaacacactgatatactaagaaatctttcctgaagagtgtgatagctatactacgcaatttatattctttcttctatgcatgttcagattgtgcagcaacaaatatacccaatgctaagttgaactttgaaataattaagtacaagtcaatctaccttccagtgcctggcaaaacaagatcaacttcttcataaccaccttctgctgccctaaccatgcttcctcttatgtgcgaaccacgtactgctggacctggctcatcagcagcaactagtagaaatccctttgaagaaattgtctcctcatgatgcagtgcaacactacctgattaaggtgaaaaaaagactaagatattaccattaggcaacaaatggaagtcaaaagctgaagataggcaattggttgatgtaatgatataaagaatctggtgtagtcctgacttcagatttagtaaaaggacaaattttcagaggaatataataaagagaactcagatgtacttaaggtttagtacgtacattccgtttcagctgaaattccagtactttcaagagcgttctgacatgatgtgatacgcttcaggtgattgggagctcggaaatggattcccaatagcatgctatagtcaattatagattgggattccaggaacatacaatcaagagctatctgcctgaaaatagtacaactgttggctctcaagatatcatcgtcaaccatgttaagaaaaatagcacagcagaaatggagcagtaatatgcaaaactgaactagacagctggaattcaatctcttgtatgcatggtcggacactgcttaaaatctggtttgcctctttaatctagttgtttatatttaaaaaaatctatttattgctatagtataaataaaaattgtccatcttaagtattcttcagatctcaagaataggataagaatcaatatcaaaatagtagaaaataattttgatgtccaccaatcatgggactgaagcaggaatctgcacaagtcatttaaatctactgttctttttaattttccagaagggactacccagtgaacacaatctccagaagtaacatcataaacggtaagttatggaacctggacttcaagccaatatagacaaaaccatgaaagacgacagtaagatgttcagaaaaaagaggagcaagaaagtagcaatttgcctgaaaagtgcctccctccatggtttatccacgtgaaaaacatatgataggtcaaggtcctttagtgttgtgttctcatttatattttgcttctttgttgatcggccttgtgtagagccctttaagtcatacttacgatgaattcgcagttcagtacaaaacatatttcccatgacaacaaaacggacctattaacaccatacatagaattaatatagcaaatgtgtacaaatagacaacaacattcaacacaacagtatgatatgataatgtacctttcttccaggtttcagagtaatcctgtgcacgccaaagaattttgtaatgagcgtattatcataagctttgacatgattgtaatactttggaagcatcttcaatagtatctgcagcacgtattacatcaaaccaatctgcagtaggcatatcttatcacttaacaaggatatacacggtttttagcacaaatctttgttgttcttgtaaagctcagttttagtcatttttaattaacaaataacactattgttattgcaagaaaaaaattgagggtgggtcataccttcagctcagttttcctcaatgtttttataacaaaacgttcatcttgagaaagatagaaaatgctgccacttttcccaggtgaagaaagctcctttagactatcaccaccacatatagacatcatgtaatctgcagcatcgatatgaaacatttctcgaagattcctggtagagtaaattatgagctaataagatatggagaaaattacaagaacaattgacagaattgatcgaactttcaagtcgatgcatttctaaacaatgtctgtatcatcctgcagtgttatctgaaaatatgatagtgatagcatatatatacataagatcatggttgcaatttcctacagttaacaagggaggggtgaaccacagaggagcaaccacccatgttcagtacagaatgcgtgaaccacctatgtaatacaatcagatgatataataaaagaacagtatgaagtactagactatcgcacaatgagaagattggaaagagatataccggaagaccatcggacaatagtctttccaaaagaaatcgacagagtagtgcggaggggtatactgggatccctcacaagggaagtacatttttattcgtgctcgaggtccaaaatcatttgaacgaacttcacgcaaaggcacaggggtaattttacctacagtatacctgcatagaagtactgtatagtcaaatggggtaatcattaaaaagaacatcaactagttacatgtcgtgaggtaaacataaaaaataacataaaaaaaattatatttcatgaggtaatcgatgtttttcataaaatatggctattataccatccaatcactattatgataagacaaataacatgctagtaaaaaattaacagatggctcgtgactagatgcattatgacatactccctccatatcaaaatacaactacttatgtcatttttcaaaaagagaaggcactttttcccgaaagaagaaactacttttgttgtcactcatagtgagaacattctaactggtggttaatttttccccactgaaatgattattgattcttcagtcactaatttatgcttgaattgtcaaaaaagagtttgctttacacgtatgtatcgatctaaatggaaggtgcccttgtcctaaatggatatatccagaacaaaccagaaaatataataagcactgagtgtaaccctccaaagcttgtatagcaaacaatgatgcattcatacaatgaagcttacctgatgccaagttgcaagttaagcattagataatagctcctatggcccttgtaaatagtctccattggtcctttagcttgtttctcccagttattttcttgtgctataccgctctccgacattcttgaatcttcgttttttggttgttccatgataagcactccttgtacgtattcccgttcataaaccgaatctttatcaacttcactgtcttgtagacactgatcatcagctgaaaatgatttacttgatacatcttggcatagatggcttccagaattatcatcgaaaactggtgtggtaccatttgaaatacgtctgggccgatgaagaaacctacgcaacctccaattcttgcacagtttttgcaatagaaataacagtccaatagtgatcttttcattactagaacttgaagcacttgtaccatcatgacttgttagacagtcagaaacttcaaggttacaaggaattttgcttccaggttgataaaatgtaccatggccatcctttagtcctctatcccatgtaccaatgtagcaagccccagatgcatatttgcagtaacctttgccatgagccaggccattgagccaattacagtcaagagtatcaccatttatccactgcattaccccgctgccattcattttgcctgatttccatcttccaatgtatacgttgccatcagcccatgtgtatttaccaaattcatcaggtaaaccttcattccagaaaccttcataagtgtcggagttagagtaaaccattgtccccataccatgcttcttgttcatcctccaagaacctttgtaaactgagccatcaactcccttgaaagtgcctgctccatcaatgaaacctccacggaagtcaccttcataggatgcaccagaaggccactgaattagtcctctcccggtcattttactcttgtcccactcaccatcataaagagctccatctgtccacatatactttcccggtccatgagggactaacccatcgaagctccccacgtagatgtccccatttggaagggtattacccctagccagaataaaaaatatatatgagattcaaattacattgtgtggtgcttgcaaaactaaattgcccaatcgtaaagcaacgcaattagtgctggacagctggagagtgggggcagtggatgattgcaaactttgcgctgattttaatgtgcttttcaatatgtgggaagaacacgatgaagcacttgtaattcctaccaagaaaaaaaaatgaagaatacgcagagatagacacgagaattatcacacctctggatgctccccttgcttgtctctgctcgggccatgtcaagattttaccagaatagctcagaagccacaagatgcattccagaagatctgaaacaaggcagcaaaaactatgatccagtattcgagcataaccaattctgaccgaaaacaggtttaatctcccagatacatcgaaatacatcgcagacataacaactctaatgccttcagcaaagcagatttccgttaccacgtacaactgaaagcagttgcaaactttgcaatcacactagcccagctcaaagtgacaaaaagcaaatagagaaaactaaatatcctcttgtactgttcaagcaaaccggataaacgctgctcccagaagagcatcatctcgagctcgcatcaacaagacagatcaagctacccagaacgactcctggttacagcgcaagcggccttccagatcaccgcgccaatccaagcaagcaagaacgtacctcagctgcagcagtagcacaacgaggaaggagaccacgtggagccccggcatccgatccgcctccgccgcccccgagccgagctgagctaagctaagctagcaaatgggatcacggctcaagcagcagcgaggagggagaagaggagggcaatcaatcgaggaggaggaggaggaggggaaagggaaacagtgcgaggaggaggaggaggaggaggcgtctgggccccggggggaggcaagcaaatgggaatcgcctcaccaccacgttgcgggttcgcggggcctttgctggcgccgaccaaatccccccacatccagctccttccccccgcgccccctcagatatttttttctctactctctccactcctttcggcggcggcgctcgcggagagagagagagcgacgcgaacagaggcagagcagccaggttggcgcgcggcgaggggggggggggggggggggct

SEQ ID NO: 59278 - DNA, 8412 bp, Oryza sativa
tgcatgctccttagccaaggaaagccattcaaacaattagaatctttacctgaactttcaaataaaaattgtcatcgcttgcagttgggtgaaaatctggggttctgaattctcttaaagagtcagccttcacaacagaagctacaagtgtgatgtggccctcctttgtaaacttaacagcattgccagagatattcaaaatagtttgcattagcctcttttcatcaccgatggcacataatggcaagtctggtgccaacataactgacacagacagtctcttgatggctgcgattggcttgatgaaactcattacctgtaagagtaagacgaagtaaaatttcaggcaagtgcaatttgcatatttagtcattaaacaaccataaatgatgaagtttcagagttcagacctccttgaaaacagcatgaagattgaatgctttaatctccaattcaaggctaccatcctcaagtttggaaagatctaacacatcattgatgagtgttgctaaaagattgctgcttttcaagactgtttccaccatcaagcgctgctcaggagtaagttcggtttccaaaagtaaggacgaaagggctattattgcattcattggtgttctcatttcatgattcataacagccaggaaatcattacgagcacggatagccatttcagcctcacgtcgagctaaatccagagcaacattttgctccattagcagatcacgcgcacgcatggactcttcaagaatagctgcatgagaaagtgcaactgcaacctgaaataaaagagaaagatgattaaaaaaacttgcttacaacactgcctcattcatatttatgaatataactaaggtgataaaaaagtaaagagggcacttttagcttgcttgctgcttctcagtatcctttgttttcaaaaaaaaaaagggaaactcttggaataatataatgatatttgaaattttccatgaatcattgatcaacagatcatagttgtgaatatgtgttgttttaggttaattggtgactgttgtctatcgattgaaagatcatgagcacacagcttttgaaacatattaaatatcacgctctctctcctataaatacccatgttataagtaaccatagcaaaagaaacagcactaacctgatcagccacgacctcaacaagctccaactcatgcacatgccattttcttgcgctatcagatggaagcatcagaaccatgattgcatagctctttgctgaaagctctggccaatcatttatttgaaagtttgaaagatgtagaagaggaactcgcactgcagccacttctggtggaacatatctccctgcaagaggtcggatccgtgccaaaggagatgtgtggggtattataattgctctgttgctactgaacacttgattgacaacaggaagattaattgatacagttgacccaacagtaatctggtggcggagagtatgagaaagctgaagacttgaaccgcttcttgatggcatccatagggcacattcttccaggcccaaggtccctcctagctcaacaagtgtagtcttcaaaatcgtatgtctatcaagagtgcttctgatttcatgggtaagcatcctaacatgcctcccagtctcttcctgtgtcctaatcaagcccatctccctatcaagctgttcagctttattcttcagaaacaattcccttgttttcacgctcagcaagtcagggataatatgtacaagcatcaaagctgtcgcacaggacacaacagccgttgaaacctttgcgactgtcatgaccatagcaacagtctttgtgtgtgtggtgaaagtccacaggtttatgagatgagtcgctccacataggactataaatgcaccaaactggatcaaaacccatctgtatgggaagaaggatgacttcttcacgaaataaattagttccaacgggatcgagaaatatgcgagggctatgaagaagtccgagatgtactgatacttgatgaggagctcatcagttggccatagtggctcgatgcagtcacatccatccatacccaatgtttagaagttcatcagtcctcaccacactccctacagaagtacaaacatacatatgagctgtcctgtccgacccaatcaaacatatcactgaaagttcatgctgcagctcgttttaaaagaaacagaaagcatctaataattaggaaactgtagccgcatgacgatgaacacatttggcatactactagaccctgcagatcagctaagatgaagcgatcatcactccgattcccatttccaatccaccctcaacccccattcccaccatctaaagccaaggttgcaaccctctcatcccacagcagcatagcacacatccgaaatcactccccccatctcgaccaccgctctagcctcccgatcggtccaacaaactcggagaagacgggaaacctaaatcccagatctgaatagtccagcaaacgaaagaagagaagcacgagcatccgtagcgtacctcgcgcgtcgtcggcggcggcggcggggagcggcggtggccgagaggcggtggagctagagccctaggggaaaggagagagaggaggacgcggcgcagaaaagggaggtaagatagccagccagatgcgcagaggcaggcggcacggcagggaggcagccagtggggagccgtcaagtccgccaccaccagtccaccacccggaaaaggcaaaagcggaggaggagaaaaaaaaatccaaccgcacggcgggtgcttgctatagtagcctagtatactacaactagcgtggctttgcttgctgctgctgccggtgcgggtgccgggtgcgtcccccctggtctttcttttctctccccctcgcgtttgtctccacgctacagctagcgctttgcttttgactgcctgcgttcggtgtggcccacgggggccacacggcccacacacctcacggccggctgagcggtatggcatcggcggggggaggtggtcgactggtcgtgatgggtggtggtgtgcggtgcgagcagcggagagggtgtaggagcgaggtgcgctgtcgccgttgccggcggttcgccagtaagacgggtgtttccggctaaggggcaacgttgccgtttttaccttcgtgctcactgtagcatttttgttggttgagtagcagagacagtgtttgagatatatgaaacgaaaaaaaaatcagcgtatacaaaacgagaaagccattaacgtataattaattgagttttaatctctactgttataaaaattaaatatgtttttatcggtattttaatatgtcatccgtgtttgaatctgtttttaagttcgttcgtttttgaaaatacatatacgtgtttaagttggattttaaacttgtttgtttttggaaatacaaaaggagacgtatgacgtatatgaaatctctttaaaaaaactcacgtgctaacttgagatgaaaatcagactcctaattgcagctcatgattttctaaaaagaaacatccaagcgaattctcacagtaaattttaccctatctaaaccgtataacaataataagattttttagttattataaagtttaaaaaatatatttattttatattttaaaataacttctatataaaagttcttaaaagacgtaccgtttagcacttgaaaataagtgttaacgaaaactaaggtaaaatcatcatcttaattacctttcatgaagatgaagataaagactaagtgtttcaggtaaaactaggaggtaataacgtgtgattaattgagttttaattattacagacttgaaaaatagattaatcttatattttagaacaacttttacatagaaagttttcacacaaaacacaccgtttaacagtttgaaaagcgtttctcaagtatccaaaagtttattcaactttcgttgcagaaaagaacatgccaaaagtagcatggtaatgcttccaacctcactcacagctcctcacaccaaccgagcatctatgtatagtctaggcaaaaaaaaaatttcccttcatatttctgaccacgctaacggtttagccaaatctcaatgactaattcactagctaaattttttatattacaaataaaaaacacactccaacaagctagccaaatcccactcatcaaatcacaatggctaatttcatactccctccatcccataatataggagattttgatttttttgctaaatcccttatattatgggacggacggaggattacaattgattatgttaaattttgcaataataacattttttgtacatggggctgctcagttcttgatgtatagattttgagttgaattactgagttttgtgattgatatgatatgttcatcttgatttttgggctagttttgtggcccatgttgttgttttattgtttttggttttggtgcagtcgaaataattcctattggtatgtttttcttttcattggatctagatcaaagggctgaaaaaaatctgtttgatttttgtcaaaaaaaaagtcaatgaatagttagacaatcccaattagtttatcaacacacattataatccatcatatcctttttgttaatctggccatttcttattttcgtgtgaacaatgaagttttctaaagtactccctccgttttataatgtaagtcattctagcatttcccacattcatattgatgttagtgaatctagacatatatatttatatatatccattaacattaatatgaatgtaaaaaatgttagagtgacttatattgtgaaacggaggaagtaccacataatgtaactatgtctctttggtgatttaagttggatctacttgtccagtgatttgaggcgctatttgtccattggtggagaaaccatctttgctcggttgacccaaatccatagtagtcctggttccattaaaaaccgggagtaaaaacgatttttagtcccggtttataagaacaacaatactagatgatctttattcccggttggtgttaccaaccgggactaaagatcatctttagttctttagggaaccaaccgggactaaagatctaactttagtcccggttgttgttactaaccggaaataaaaatctaacacgtactatataatccctattacttatcttcttatatcgtccacacaacaaactctctctatctctttttttcctctctaactctcttcctctttcctgccttatctcattctttttggatagatcgagcgagagcgctgccttatctctatccagatcgagcgagagcgagagcgggtcggcgcggcggcgcggaggcgcggaggcggcgggctgcgcggcggcacggaggcgcagcggcgtggaggcgaggaggcggcgtgcggcgcggcagcgagcggcggcctgcgcggcgggcggcgcggcggtggccagcggcgtggcagcgagcggcggcatggcggtggccggccggcgtggagaggaggcggcaacggccggctggcgtctctgtgaatttttttttagaatttgtgatttattgcatgatcctgtaatgtattgatttgtgtgtgatgtatttgcgatgaattttgtagaacttgtgatgtaatttgatttgtgtgcaattttattttaggatttgtgatatatttgatttgtgtgtataagtaactttaaagatttgtgatatagatttgggatgttaccttgatttggtatttggggtttaatttggaatacgcatctcacttgatttgggagaaaataaaaaagaagaaaaagaaaaaaaaaggagggggcatctagactgctgttatctcatctttagtcccggttgttcccctatctttagtcccggttggtgttaacaaccgggactaaagatcgatctttagtcccggttatttcactcgggactgaagatagcaatctttagtcccaaatttatagtcccggttgaataaccgggactaaatgagggttacgaaccgggaggaaaaatggtttcttcaccagtggtccttgatgtacactaaagttgccaaagaacaagaggcttcttgttaattgccaaaaagatcaggtatgctaccacacttgatagaaaatgctaagcacatttgattggatatcagtgcctgtcatgttgctgatttttcttatgcataactctcgtggtacagggatcttcacccgtatcaccttgttctcttttgaaaaaaaaaaacaacgcatttgattggatgccggtactagtcgcgtcacatacatattactctcgcagcagaacgattatcacccgcatcacttatcttcgttgtcttctcttttttttttcaaagagtttctgtagtaatagatcatgtttttgtttcctgagttaaatggatccatgcattgtaactttttcgatgttgaaagataacattactattcatttattttgagacatgccgttataattgatcaaaatttaaaatataccactacataccccttcaatacaattataaaacattttagattagattactcttcctccttccttcaccccttcttccttctccctctcactaatctctgtcatctctcccaccatttgatctagtgatcctatccaacccaccggttggacactccctttgttctcaactctcatcattcatggtgccacaacacaagcgacacaagaaactctggttcctaccggccaccgaggactcactccgccgctagctccatcgccggtggtgtgacttcatctagatcccagataaaataagagagaggaagaaggaagagggggtgaaggtgaaggatttctacgagggatgatttggtccaggttattttataattgcattgaagagatacgtcgtggcatatctcaaactttaattaaattgtaatatcatatctcttaataagcgaataataacgattattttcaaagtcgaagatattacgatggcatggatccaattaaccctcgtttaattatgttctcaaagtgtgctgcatgtttcattctcaggggaactttgtagtgtgtagtttgtgttctttctaaaaagattattactactgttgttttcaccatagtagaccgtggctttcggatccagttcctaagcagtttttagtgtgactataacttaagtagtcgcactagagctgttggatacaaatcaggtccaaattcaatatgacacagtttatccagggcattcactatagaactgttatagtaatgctgcagtatcatttaatctaggtcttcaattgaaaatttggatggatgagattgtgtgcatttctagttaagggaccctttgaatcgcatgattgaaaaaaaatataggaatagataaaatgtaggattttaatagaaatgtaagtgtaaaacagatgatcacaaaacacagaaaacacaggaatgactagttgactgaaccgcaggaaaaacataggaattagatgagagagatagactgaaagaaaagttaccaagaggttgaagctcttgctaaatttcctctaaaatctttataggattatctattctataggaatttcaaaggatttgataggattcaatcatttatttcaaaggccttcataggaaattttcctatacgattaaaatcttctaaaattcctatgtttttcctctaattcaaagggccctaaaactgcactggatctcgatatgtggctttcatgttctactaaccacataaaacatgacaccacaatattctctccgtcctataaaaaatcaacctagtatcttatgtgacacatcttattacaacaaatttagatatacatatgtctaaatttatactataacatatcacttcccgttctagatttacctttttttttttatggagggagtaggccaatagcccagaaaaaactgcagtccaatgcactgtccccaaaagtagagccacgggcccactcaacccagccacccccaattttatccaaaattaacccatagtactatgcatgagtaaacttcaaaaactcaaattaagtcgttcaaaaaaactcaaattaaaacccagctaaaatacggttctgggagcctgggatgtccaatgtaaactcaaaactaaccgggaaatctttcaccgcgctcgcttctaaacggatccgcttcgcaacctcaacctgcccccgagatgagaatcagattcccccgtcgccatccgccgccggtaaaaccgcgcgctccatgcccacgaagcaaccgacgccaccaccaccaccaccgcaagggccccccgcccacgtgcgccgcgccccgcgccgcggctcgcacggcgcaccgcacctgcgcctgctaccgctgcggtgaaccgagcggaaggaacgccccccc

SEQ ID NO: 59279 - DNA, 64788 bp, Oryza sativa
  unsure (1)..(64788): unsure at all n locations
cgctccctctcctcctccccatcccattctcggcgacgccggcgccctcggttagggcgggggagccggcggcatcgatggcggcggcagcattggcgggcgtcgtggctgcatcgccggcggcatcagcgagtgcggcgacgacatcggcgggcgccgcagcgacatcagcggtggcatcagagggcgttgcggcggcatcagcgagtgcggcggtggcgaccgtggggacggcggtggcgggcctcgggcaaggcagcgatgacgacggtggtggcggtgacatcgacgacgggcctcgggcaaggcagcgacgacggcggcggcggtgttaacggcggctaggttagggtttgcgggttgattttgttttttttttttggtttcggtttttaattttcccgtgcgtgcggcgcccgcacgcgaaaatcgattttcacgtgcgggtgtgtcacccgcacgaaaaaatcgggattttcacagacgcacacttccagacgggtagaagctccgcacgtaaaaatcaattccacctgcacgcaaaaatcattcatgtagtagtatatatactacctccgttttttaatagatgacgtcgttgactttttctcacatgtttgaccattcgtcttattcaaaaaatttacgtaattataatttattttgttatgaattgttttatcactcatagtattttatgtgtgatttatatcttatacatttacataaaatttttgaacaagacgaatggtcaaacatgtgagaaaaggtcaacggcgtcatttattaaaaaacggaggtagtatatacttacctttaggagtgaccgcaagtactccaaggaccagtgccagtgttaaaatggaagcaacaccatgctttgccatctttgtttgcaggcacaggtaggctttggatgcgccgcctctctcgatctagatacgacgcctctctcctctctagggttagcctctctcctttttagagttagccagttagtgatttagggacttgggttgggctgggaacttggggaggaattatggactatttggatgggcctttttaacttcagaaattccgacaaactttccggaatttttccgaccgattctgagttccgacggaaactgctattatcatattcaattccgtttccgaaaaattatttccgtttccgattccgtttctgagaaattccgaaaaaattccgaccggctgattccgtttccgaaaataggtccggaatctggaaaaattccaaaccattttcacccctacaggtagctatagctagttgttaaggagcctgctgaccactttgcatgccgatgcaatgtaacaaaagcattcacccctatttatacaagttcctagcacgtctatatttagcatgtattttttttcaaaaaatatatattttaataaatgacgttgacttttgaaataacgttggactgttcgcattatttaaataattagtgtgaatatgctaaagtataagtcatgcttaaatattctttaatgataaaatatgtcacaaacaaaataaacaatatttctataatttattttgaacagaacgaatgattaaacatcagatcaaagtcaatagtattatctattagaaaacagatgaagtttgtagcatgcagtttgcgaggtaatggtatataggtgattgctccggtccacattaccaggctgtcacgaaactttctttttattttgtatctatttcacaccaagtttgtttattgataaacttatagttccattctggtttggaactgataattttatactctatctgtttcatattataagtcgtttgactttttccttatcaaatttctttaagtttgattaagtttatagaaaaatatactagcattttcaatacaaaacaaatatattaccaaatatatttattgttaaatttaatgaaactaatttggtgttgtagatgttgctatttttttctataaagttggtcaaacctaaagaagtttgactaacaaaaaaaaaagtcaaatgacttataatacgaaatagggagagtatttcaaaggagtcttaaagggctctttgaaacgcaagattgaaaaaaaaagagaaatagaaataacttagtattttgttaagtgtaaaatatagattgcaaaatagattaaaaaataggaatgattgtttgagtagaccacacaaaaacccacgagtcggatgatagatattcaaatgaaatttctatgaggttgaagtttttttgctaacttttcttcaatatctttatagtatttttatttcataggaatttcaaataaaatggtgggagttaatgctttgttcaaaggcctttcttggaaattttcatgtaggatcaagatcctccaatatttcaatgtttgtcgtacaaatcaaagaggggataaatttcttatgtttttcctcttgaattgcaaggaaaagttcctatgtttctcgtttgctcattcatacgagtcaaagacatcaacactcaacagtgttatttcctataagattaaaattccttttttttccctttgcttttccttcattttaaagaggccctatagtatgtctggtaattggtgaagttataaaggaataagggataaaaatggctatgctccctttcaaacgcaggaatagtaaaatataggaatataaaaaaatggaatctccgtagggatgtatatgaaaacagaactacaaaacacagaaacaaagatatgtttggaacgctgaaaaacaaaacacaaaaatacaaaaaaaaaaaggaatgcggatgtacgtacaacaaatgagtagaaaagcacatgaagaagaatagatagttgggtgtttggaatacatgatttttctctctcccgctcctctcacttttcagcataggaagagaaaacattggttttccccgttttgggtgcaaactgcaaaggtacagattacaggaaacttctcctatattctgccttcctctgttccttagttccaaacgagcgattgacgtgaaccgttatcacgtgattatcacgtgcagtacctttttagtttttaaaactatagtatacgtcgcgataatcgtcaaatctggttgtgttcttaggtcctccgacacgaaaaacggagcaatggattaatacgtgattaattaattattagcttaaaatacttttaaaaatggaataatatgatttttaaaagcaacttttctatagaaattttttacaaaacacacaccgtttaacagtttgaaaagccttgggaacttggacttaagaacacaatataaaatggtttggtaaaccctgttaaccgctggattttttttttcttttgtttttcgaggatattggaacttcaacaggctgtgttcgtaatcaagggatgggaacaaatccctcacgtacggaaaacggaacggtccattaacgcgtgattaattaagtattagttatttttttcaaaaatggattaatttgatttttttaagcaactttcgtatacaatttttttaaaaaaatcacaccgtttagtagtttgaaaagcgtgcgcgcgaaaaaagagagtgattgggaacatgggattgcaaatacagcctggcgtgtatacgaagtctacgaagtacatctgcacgtgctgtttgtgctaattagctcagacaattacctcgtggctagtatcatatgggttttcataatgttaaccttgaggtttgcgtacgccacttgaacgaattcaccggtatctgggaaggatattattattcttgttagtcgcgacactcaccagcttcgattctcagcacctctccctagctagtcacgtttgtcacgaactcgcaatttagtattatccacggaccatgggccgttggatgaagcttctactgtccagatcgtctgaacgggtggcggtgtgctggtgttgggctgattaagggcatatttggtaaagctcaaactcttaaatctagctataggagttggagcaagcaaaacccagcttcaccttctttttttttcatttcatgacttggatctaaaataaagttatgaagcaggctaaacacgggcgtggctaattggcgcgcgcggctggcagcccctttttccctttttttttgcgattttttctctttttttcgctttcttatttttttccaaatattttcagtttcctttgtgccttttttctaattttttttaatctttagcagacttgttttcaaatgtttgagttgaaagtatttaaattttaagttgaaaattttcaaattgaaatttttcaatctcgagtcgagagttttcaaaactcgagttgaaagttttttaaatcttaaacttaaaaattttcaaatctcgagttgaaagttttcaaatctgagttgtaagtttttaaaatttgtcttataaatttaaatctcgagttgaaattttaaaagtttaagttgaaagtttctaaaatttgacttcaaagtttaaatcttaagtcaagagtttttaaatccaactcgaaagttttcaatcagttagtaaaaaaatctccagaaaaaatctactcttaatttcgtaattatccttagctaacttacttagtacgtcttaactcccccggaacgcacgctggcggcgcgtgcgcgagctagcttttccgggctacacctagctccaccttttttaaaattttgtgagagcgctccactcagttctgctatcattttacgtaaaactcttaggctgcactaaacaggtcctaacttcatgggtgattgctaattcgttttcaaatcttaacttataaattttcaaatctgaattcgaaaatttcaaatctcgagttaaaagtttttaaatccgaatagaaagttttcaaatcttggttgaaaaatttcaaacctgtgttgaaagttttcaaatctgagttgaaagttttcaagtttgagatgaaaacttgaaagttttcaaattttgacttaaaaaatttaaattttgagttaaaagttttcaaatctgggtttaaaattttcaaaatttgactttagatatatattttttcttttcaatttgttagtaaaaaaatctcgcggaaaaaagaaaaatcttatctactaccgtcattatctcaaactgttgttatctaagactaatactagtctaaccgccttatcccaacaaagcgctgcgtatgcgccaactagcgatccccaacttcgtgagcctgggctttaattcggtgtatgatgtgagccctgtctaatataatttgggcatgttcaggccgttcgatcaaatttcagcggtccagattgcttcgcgcggaggaaaacgtacatcctgatggaacgagagattgggaaaaaaaattaacgaagagagatggaaaaatgaaaaggacaaaaagaaaatataccgccaaaactccgaccccatttttttggcggggaaaacggcgatcctcattcggtgctcgtctgatctcaatgcagtatgtgtgtcatatggcaatcacaagcttggtgctcaagtttatatagattttgcattgttcttcatagagatatatgtttgtagttagctaagctacattgtcagataagattacttgagcatcacgtacggttgtgacatgaacatcatgattcattcaggtacaaaaaactgtctcaacgatgcatcaagtatcaaacatgtaaaagactgaaggaatctgccgtcgcaaggaatcatgcaaaagactgaagttcagtgagttgtccacctttatcttcatatgttttagttagctaagctacattgtcagataagattacttgagcatcacgtacggttgtgacatgaacatcatgattcaggtacaaaaaaaactgtctcaacgatgcatcaaagtatcaaacatgtaaaagaccgaaggaatctgccgtcgcaaggaatcatgcaaaagactgaagttcagtgagttgtccaccttatcttcacacctgcccttcccctntcctattcaccgcgtgggggcgccccccccccccccccccccttctctagatcctcatcctcccgaggtttctttggcacaactggttttgctttgactgcaaagaaataattttcattaaatttacatagcaagtcacaaaaaaactacgagaaaagctgaaaaaaagataaacaaacttactgttgcgaaaactcagaagtgtcttagcacttatttcttcgattccagcatctcttagcagcttaatctcagatgtcttcaccaaaacaactgtacagagatttttttggtggatatattcatccagtgccattgtcccaccaaacataaccaccaatcttttggtctctttctcttcagtgttaggagagtcatactccacaattgtgacactgccttctttactcatccaacacgtgtaaaacttttgagagagatccttaattaacttttgataatgaggagatttgtcttcaaagttgtcaaccacaataagcaagcgatgggctgaaaaagttttcataatttcaagaaaggaagcaatttcagcttcttcatcatcagccttaacccaacagattgaatcctcggattcatctgattccttaatttcatttgttgtgttagaaatttgttttccaccatcacgtttgtctggaaaaaaaagaagcaagagtacaaattaaatctgaaacaagcacaatctgaaacaacaatgttataacagaggaaaaaaagaaaacatgacaaattaaatacataaggagagacagagtaagcagcaaatgtgactataacccaaacaatgtaggatgtaaaaaactgaagtactgaaccactgatctgataattatcttatgaatgttctaactaccgaacattgaggcaatgcatttatacaaatcgcgctttacttgccagactaaaaatcaatctggaacgtgtcaaagggccaagacacttctggtgaatatgtgcatgtgagctgtaagtgttgactactacaatactcatctcatctgaaaccgagtattcttatgactccccagttaagatgcctatatatggagcattcatatctgtaggggctggagtgctggacggactaagagtctacagagcggcgtgtacaaaatagaaaaatataactgccaaaagagtaaaaaacacgagtttttggaactggcgcacccacaaaaacaaggcctttttgctagttagtcgcccgcattagtgtcgagcagagcaatttttattttatcatcagacaaggcaaaaaggaaacagagcataccaaaaattgaaaaatgcaagagtacaaattatatctgaaacacgcataatctgaaacaacatgttataacagggcaaaaaaaaggaaacagagcataccaaaaattgttcgcagatagctgctccatgatatcctgaactgcggctgactaagaattggaactgttttttccagtatactgagtaccaatctattccttgatatcagggggtcatcaaccatactaaccagacgatctgggatcagcagtagttctctgggtttccagaccggggtcaaggactcaaagcgacctctcaaactcctcagaaacagaaacagcgacctgttgggatcatcaacctttatctcatattcaccattcagcacattataacagaccttgttgtcggtccaaacagtccctcttaacaagttaaggtcaataagcttgaagaggagagctatgactgccaaagcctctgcctccacaacactcttgcaaggtacctcatggaaaacctcagcccagacaagtttaccctctttaaagatgacaaaggcaagttttgcctttccagtttgctcacagaatgaagcatcacactcccccttgaaagaatcactgcatgattcagcatcactcgagtggaggaaggtctgaacggtcccgtagcactttgtccaatcatctacaacaatgaccctatgtttaaagatgtgctcaaggaacaaagtccattcatcttccagcaggatttccttttctgtggtcacatctagggcactgaggtagcgtggagacttcttcaacaggttatttgttctttggttgaaagttttcatggatttatcaagaggctggtgaatgagtaaacactttgaaacaagtagtggacgaatgctgtcctcaaacacttgcttcaacgcagggatagcaaaggtcttacttgcatcacgaatgcctggaagtactttccgcagtaagtccgcagtgtccccagggccaacactcaactgttccaaagaaagattgggccttgtgctgaatccacgctcgccgggatctcgaaaaacacctgcatgcatacaaaagaacacataaaaacaccatcaccaaacagccaaaacgagcatgaaaataacagcacaaatcagcagcaggggataatctacgagttctaacaatagatcagcagcagaggataattcacgagatcaaacaataaaagatcagtagcagggataatctacaagatcaaacaacagatcagcagcagggtagataatccacaagaacaaatctaccaggggataatctacaagttctaacaatagatcagcagcagaggataattcacaagatcaaacaataatagatcagtagcaggggataatctctacaagatcaaacaacagctcagcagcaggggaataatccacaagaacaaatctaccggggggtaatctccaagatcgaacaatagagtaaaaaaaaaggactgctttgacattgcccccacctcccccagtctccacgccaagcaaatctaccagatctcaaacagactagagaaacaaatccccagtttccacgcccagtacaaatcagaggatttttttaatatatataaacgagagaaacaaattcgccaaattaatggaccatcacacaaattaatagggtttaatctgcaagatcaactaggaaacaaatccgagccaacccaacttaatagaccatcacatagatcaataaggttttaatctacaagatcagctagggaaacaaaacttagaccatccctagagacgagtggattgacctgagttatcctcggcttgcttgctgccgccggcggtcagcgcacggcacagcgtccatctccggcggccgaaccgaaaaagactcgacatctccgcagatctccctcccaattcctcgtcgccccttcctggccgcctcgtccaccagaagggagacggggaaaaggggtttccagagagtagaagggaaggggaaagtgaagcgagtgtacgacgaccaatagagatttttttttgccccttgttgagaaagtgcgaatagagactactgggccttcatgttcgactttgggagtttggggatccgcaaggcaggcaggaagttgaaggcttggtttgacatagctgaaacttttggcccggtttgagatagctgatttttttttggctcgacatactgtataatctatttttttcactgattgctagtatttgactgtacaaatgaaggaattaactaattcttattatggataatccaatttttatgataaatctagaaactcgggtaaagtgcatcaacaaataatcgcacagtcgtaaaaatgtttgaacaaaaccgtaggtattatatcaaagttatactactgtttcataaaaccacataattaaccaatttaatccaaatctaacatgtagggggggaggggagggggtggtttacgagttatttcatccaccatacttcactgagcatgtaaaagtttcatcccacatgtcagatcatataaaactatcatctcacgtcatatttaagtagaatttgtcaattgtgcgattttatgaaacactaccgtaatactcgtaatactcgtggttatgtgtcacatgccaaaacccatatggttttgtattacttagaccataatacctatggttacgtgcaatttactttacaaaagtgacagtacgcaatccgaactctagattgggatcatggatttatattactaacatgtactccatcgatcatggagtaagtattttggttccatcgatccaatttaatggagccatcaaagaaaagcaaacaaaacaaaatcgccctcgacatcacagccagcaaggaggggcaaaaatgacttgttaaggagtggcactactacaaaaacgatttttctgtacgggacccatgatttttgcaaacggaccgtaagttgtcgcgtctggaaaaatcgagcggcattttcgcatacggctctttaaggcgcccatatggaaaaatcgttttttttccatgtgggctcttaagaggtctgtatgtaaaaataagctcgtttttgcatgcgaatcacttaagagcccgcatggaaaaatgagttagcatttttacatgcggaccacttaagatacccgcaaacaaaaaaaatcacccctttttttcatctccctccactctcttttccctcccaccacttcaaattatttctatctcctctctctctctctattttagtctcccctctctctctctcttcctatcctcttctatctctcgttttcttatgtcctccccgctctctctccaagagcgggcagcgacgaccgggagcaggacgggtggcaatggcgtcggcgggcggcggatttggcggcgccaccctcaggaaggttggatccaccgccctagggagcggctgctgcgacggcgggcgcgcagcgggggcggcggatcaggcgagtaggcggcggcaccaccaccatcccctcctcactgtcgccgttggcggcggccggctccgtccccccccctccccgccgccgacaaggcggtggcggcaacggcgacagctcagcctcctccagcctagatctgttggcaggagcggttggcggcgacgcgtgggcgacttccacgacgacgctggtggtcgatgggagcaacggcggcgggcctcctcccgcctggatccgacggcgggaacgggcagcggtgggagcaaacggtgggagcagcgggatcccacgacgccgacgcgtggccggcatgattttttttgcgatttttagatttttatttttgcatgcggcccatgtaagcaaccgcatgctgttgccctagccgcatgcaaagatcgcgattttcgcagacctttctgtgcatgcggctggcccaaccgcatgcaaaaatgcttttcgcccttttgcagaaaaaccctttcgtagtagtgtgggtaaggcattttaagtaagttggtggtaaaaatcaccttttacaagtagtaggttctttttttaacaaaatattataacttcaagagtttttatattttaataaaacaaagggagtaatagtaaactataaaaaatataaatcactcatatatggccagctagacggcatgtagactgcatctataggtgcacctcatagggagtgctattactactgcctccatctcaaaataagtttattttagactacaatactcctactttataaaatcccaatgcaactattactcgctttatctactttcaatacaattattcactactttcgcatattccaatgcaatgattactttaaagatgaacttattttcagacaatttgaaggagcattgggaacttattttaggacaaattgaagatgttagtattatttattatggtccaagttacacaaaaccacataagttttagcactactgtttcataacaccaaataattgaccaatttaacccagatctgacacgtgggggattcatgagttctttcatccaccatatgaccatacttatgtgagcatatcagagtttcgtcccacatgtcagatcatataaaacatgtcatattttagtagaaattgtatattgtggcactagagctagagctcaacaaaacagtttcaactccacctaaaattggagacctaaaattggagtggagctgggtggagctctcacaaaatgatctagagaggtggagctgggtttaggtagctccacaactcccctctagacccaactcctaaagttaaatttaggagttagagctctactaagcaggctctatatataggtgcacctcatcgggagtactcccttcgtcccaaaaaaactcaacctaggttgattctttttgggacggacggagtattaatctacctagaaactggacgtttgcaggcgtacgggttccccatgggacgcaagatgtaaaaatcatcagcagaaacaatcaaacagtggagaaaagaacacagcaaaaacagagcaaatttatttaagagaagtagggatatattactgcctctgtaccatggtgtagtgctcatcaatacgagttgtaataccaatcataggcttcctccgtacacatttgcagggggagatcagtcgtcttttttgcacacaatgaactgaatctcctccatctcctatctgcaaaattttggcatcatgggtttcctttcctccgcaaataagtgacgccttgcccaccggcccctgcggcatgatagaagattcaaagtggtgtcacgtaatgggggatcaattaattttgatgcatgacagtacaatttaaacttagtttaactcttcacgtgaatggaagtggtcgttggttacccatccacagatataacatctctatttacatatttatgcggtggaactcagatagataaaattgttcagcatcgtaaaaacaacaaatcaaattgatacccgtctatgagcgagcgcaccgtaccatagtatggaattgtctgctgtaggacagcccacgaaaaatacaaggtttgatttgcaattatcacagcaaggaatgtgatactaagcccttatcacttttacatgttactagttgtataaaaaagcacccaacccgtgtggcatagatgcatagtagtacgtgcacacaatgcatcgcaatgctaatgcccttaaacagcaaaaacaagacgttccacctaatgaattttaaagccttagattgcgagctaaatgaaagaaatagtgataaaaatacactacaattagggccttaggcctgaaacattttggtctcacacaaaacattcaaattcaatttggtgaaatatcaacacatctgcagtgaatcaaaaatatctacacatctgcaatgaatcgaagacaaaataatgaaacaacattaaaatacttggtacaacatttcaatccaacaaaagaaacatcaaaaatgcattgactgaaacactggaaatttcacaaaatcaatgctggctaggtctggcttcttcctcctctccgttagttggatcaggcttccttcgacaacctcaagtgctgcaacgcgatgacccggtgatacgtacttcaacttccttagccacgatgggctgccccacgcctcctctttgccgctgctgcgggcgtcctctccatcgccatcttcggtggcggtgctacgcactactagaaaaaacatttttactgacggcctaaaaacatttgcacaggcgcgccagcaggtaaaggccagtgaaaatccttactttccacaagcggtcagaatactgtttgcgaaaattgaaaccaatgcgcggtgggtagttaggagcggtgggctgtgggtggtggggcaatgggatttatttttttttacgagcggtgctctaccgccacacttaagaggtccgcctaaaaaatagtgttattttttatgacgtacctcctaagtttccgctagcgaaaatcggttttcgctggcggctcatgagcgagaatcctcccatatgtttttactagcgtttgtttcattaatccgccggcaaaaataaaagggtgtcgtcatgaaaaatcgtttttttaagtagtgacggggacgctgcgccctcgtcctcacatcaaagccttggtgagagagagaaagagtaaagtagaggagagaaaacgagcaggaagataagttagagagatgagtgagatacgggagagagaaatgagtgaatgaatagctatgtggggcgcctgtttttgtcccccagattggacgccccatatggagcgtattcacaatccaattactgggtcaatacagtgcaatacagtgcaacacatgtactacaggagtagtagacatagcacaagagaagtaattcgtttaattaccttcatcttgttgaatctcgcgtacaaactaaggtacgtcacatcaaacggtaacatcatcacgcggtctgcaaaaaaaaaaaaattacgattaatgtaaagtaaagcatgtaaaacatactgctaaaagcgcactggctgtgtatgtaaaccaggggaaatataggttacaagtaaaaataggataatgataataataatccacagaccacagctcaatcaatccagccgaccaaccaatcagactgattgttgccatgcttggagtagtacttataataatgttgaatatgaatcggcaaatccatcggtccaactgagcaaccaaatgaaagcaaaaaaataaaaccgccgggcgagaagaaatagtagtagtattaaacactaacgatctgatactagggctgtgtttagtttcaaaatttttctttaaaatctcaactttttcgatcacatcaaaactttcctacacacatagacttacaactttcccgtcacatcgttccaatttcaaccaaactttcaattttgacgtgaactaaacacagcctagcagctagggtttgcaactagactgcatctgtaggtgcaccacatctggatcttgaaacgatgagaaatcatcaacacacccaatcaatcaaacaccagagaagaaatgaaagcagagcaaataggctactagtagtacttcactaatcatatgttggacttcatccgtactctgttgcaggaagggagaccccgtcctttttttcctcaaacagatatcctcctctctgcgaaattttggcttcgtaaggattccattcctatctctgcgaaattttggctccataaagattcctttcctccgcgcacacgcagcctgcagcaggagagaaaagattcatcagagatgacaacgaagtgggatggagtagggttgagaacgcgttggggaaagcagagctgactgctagggttgtagtacaacgtgtgcagtcttccacacccaccccgccggcccctttctcaagatctgatctgatctgacgatgtgaaatgtcaatcctacccatacctctatgcgaaattcctattgtagacataccccgggcgggttatccactaatctctaataattaaaacaatcgttgttgtttagggattaccaaattaagacgcatgcattgtttaggtactacagcagcgcaactactatactcatttgcatccaatataagatccttggtgttggtgatgggggtcgaaaaaactttaacagatgttaagaaaagaagaaggcacaggctgtgtttggaacggctggttcccatctctccacctcgtttttcacgcgcacgcttttcaaactgttaaacggtttgtttttttacaaatttaccactactccgaattgttattaaaaaactgccactagaaaattgcaaaaatgccattagtactatcattccagtgatatccttgcaatattaaaaaaaccagtggaaaatttacaaatgccctaaaaagtttctatatgaaagttatttaaaaaacatattgatctatattttttaaaaaattagctaatacttaattaatcacgcgctaatagattgttccgttttcgcgcgcgtacatgctgggaaccgattgttgcgacacatagacacagattaattgatatcaaaccagagacgtgtacgtacctcgatatcaaatgtagagttaaaccagttgtgagaactgggaatctcgctcggcgacagcccactaaaaaaccccaccaaccattgacggattgggcagcagctgctgattaagtatggcctcgtttagttcccaaatatttttcccaaaaataccggggctgcttggttggcggcttaggtggtgtttagatccagggacttaactttagtccctatctttagacactaatttagagtattaaatatagactacttacaaaactaattacataaataaaagctaattcacgagacaaattttttaagcctaattaatttataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcattagaatgccacgccacgtcgtggctcgccacaggtcctgtggcggacattttgttcgcctcagaaaatactgtagcgcggcgaaaatactgtagctatggcattcaatggctgggatccaaacacaccttcatatcgaatctttggacatatgcatggagtattaaatatagatttagaaaaaactaattgcacggttaggagaaaatcgcgagacaaatctttttagcctaatttgtccacgattagccatgagtgctacagtaacccacatgcgctaatgacagattaattagactcaaaagattcatctcgcagtttccaggcaagttatgaaattagtttttcattcgtgtctgaaaacaccttccgacatccggtcaaacatccgatgtaatagccaaaaattttcttttcgcgaactaaaaaggccctatgttgctgtcttcttcgtctccatcccacgcctcgcccatctactcgtactactccctatgtttcaggttacaagacgttttaactttggtcaaagtcaaactacattaaatttgatttaagtctatagaaaaaagtagtaatattttcaatttaagacaaatttattatcaatatatattcaactattgatttgatgaaaataatttagtattataaatattattatatttatctataaactcagttaaactttaaacagtttgaatttgactaaagtcaaaacgtcttataacctgaaacggagggagtatcaaatagtggatgatgatttgtctcactatttgttgtatgtacaaatgtgttccttcaagagtactactccctatgtcccatattaagcgtacttgtgggttttagtgtccaacgtttgaccgtctttcttatttaattttttttataatttgtatttttattgttattagatgataagatataaatagtaatttatgtgtgacttaatttttaaaacttttttataaattttttaaataagatggacggttagatattggataaaaaagttatggttgtatttaaaatagggagtacgctgctgcgtgaaagaagtaggaggtgtgaatctttatcttcggcctgactacaagtatttatatatggatgcatggatattgatgatgcatatccattccgtcaatattcacgcgaactaatggaaataaatttatcataatatatagtaaattatcccaagattgagccagtagtaaaaaaactaatacaacactctacttaggtggtgttcttttcttctgaagatgaagatggagatgaagattaagtttttttacgtaaaatgaggtggtattgatatatgagtgattgagttttaattattataaacttaaaaaatagattaatatgatattttagagcaactttcatatagaaagttctcgcatgaaacgtaccgtttagcagtttaaaaagcgtgtgccataaaaatcttaattttcatccaactccctggccggctcttggttcttgagcaaactcctccactgggatgctcatagatgaagaaaagagactttaggcaagtggttctggtagctcagttggttacagcaaaggttaatctttagaataaaatccagttagaaaagaaaatccaataagagttaagctgccatgagcatcatggcatagataggtcaaagggaaggaggcaagcccgacgggaccttggcctggtttagatggcaaaaatttttgttttggatgtcacattggatatatggacatatatttgaaggattaaacgttgtctaataataaaataaattacagattccgtcaggaaactgtgagacaaatttattatgcctaattaatttgtcattaacaaatatttactgtagcaccatattgtcaaatcatggtgcacttaggcttaaaagatttgtctcacaatttacacgtaaactatgtaattgatttttttatccacatttaatactccatgcatatttaatactttatgtatgtgtctaaacattcgatagaataggtgaaaagcttttgttttgaaaactaagcccaaaattagaagtttgaagaaattggaacgatgtgatggaaaagttgaaagtttatgggtgcaggaaagttcaatgtgatggaaaagttagaagtttgaagaaaaaaattggaatataaggagggcatatttggatgctatactaagtttgccactattcatcatactttttacgccacacttgtctaagttgtggcttaaaaaaaatgagccacgccttagctagcaagattggattgtgccatactttaatgagttgatgacatgtgggaccctaatagatgagaaagaatcttgctacaagcgtggctatgaaccaaataatatgctaatttagtcaaacttgtctaatataaagtgtggtaatctttgacaaattttgatagcaaaccaaataaccctttagtgcatgcatcatggaaacggtgcaaattaacgcagccccgcgcatacgatcggttggccgcgctgcatgcgggattgattaatttttttcttgaaattccatttgatttgatgttgattgatcgagaatgaaacgtggattatttaaataggagtactactagtagtgcgatcaaaatctgaaacccatcacagcatcacatcacatcgatcgatggaggggctgaaacccatgcacgcacgataatttataatttaatcgattccggccaggtgacccgcccagtatatattccccaccacaaaggttcggttgttggtttggtagcttgtactcccaccgttttctgtattactcgaaacttttaactttaactaatttatagttaaacctttttaagctttattaagttcattagaaaaattagcaacaactataacactaaattaatttcatcaaatataatatcaaatttatttatatagtatgttttttatttgaaaatgttgctacatttttttataaatttggtgaaacttatgtaatataaaacggatgggtggtattgtgctttgtcatcgatccatacatacatgcaaacgagggacttggtccaattcatttctaaaagaaaaatctcagcaaattttggtagtgttaattttgtggggtatcatacttaagagcaggtacaatagcaggctataagccagctgcaaacatattttaagcagataaatgaggagagagaaggtcaacaggctacagatttgtagccagctatagcacggactccaatacacaatgtgtgtatgacatgtgggaccagatattaatagtgtagtatgtaactattgtataaatgagctattagattggctataatgaattaaagctagtaattgacaatactatacttgctcaaagaaagatactgtgtactttttccccatagaaatttcttccggcccattagggataggctcgtgcagtgatgtcggccgccaagcgattgccggctgctgcgggcataggtgtatgctttacagatcgatgccaattgagctcacgtccaaggttctgcaccgttcaacaagcgtcgaactggtacttggcatggctaagttgcatggtcaaataacgttagtgttctcttccaatttgcttccatcgtctcgcatttgaaacctaaataaatggtaaactttatatttctgccactttgcctcatggctaaatgtcagtacaaagtaagatcgtcaaataaaaataattctaaaacaatggttggtcaccctcacgcaaaaggacaattattgtaactagtaatatgcccgtgctaaacgctacggtgcaattatattaatctttaataaaactctaaaatgaatttggatgtcgcaaatagaaaaaatatatagagtacaagaaaatatattttccacatgtcacgaattcggatgttcccataggccaattccattcatttttctaaattggcttatgtacttaaaaatattgatttttctattcatcacacatggcacacgctggtcgcagcccattaaggatagcatgagggcatgaatttataaacccaaataccagtttgatatgacacaaatgtcaaagtaatagtttgacaatgtttcacaatataagaattgttggttatctcgttaacgtcttctttcaatatttatatgaaacgactactaaaattagtcgatgacggaaatgcatatttagagagacacaagtgcatatttaatcatcttattaatcacacaatattccacctgaatggtgatggcgtgttgtacaaaacaagaggacattggtgagtaacattccagttagcaatttactattttctaaaataagtttctgaattaattttgatcacgcgaacctacatttgctcaccaatcatgaacgttttgatacatgatattctgttcttccctgtaggttcgacttctttctttggctttgccaaaatccttgttgtttgtcaagttgccttgacagacccctcgacaatgtgacaatgtgccaaaatcaatacgttatttacagagtaatttgacggatgaacaataagtaatgttaatgtaaaaacttcataatttacagtcccactccaaaaagccggtagccacttcccatcgtttctaaatgatcaaatacctatcaaacgtttcgtctcggttgatgtgattccttcaaaataagaaattatgcttgtttccagcaagaagtaattgagctctatagctattggacattcccctgtgtcatctatagttgcttccataaagtcatttttatacaatgaatcataaaatatttttatctatctcctaaagaatcataacttcctaaagactgacaatcaaagtgcatcatgtatatttttgttttctcaaccatttgtgttttacataaaaaattaagctcagtagtcttttagttagaactgtcactccaagcacggctcgatgatgggcggctccagaaacggctcaaagcgcgacgtgaaggggttcgccgccgatctggatacaagaaacaaattttctcaaatgaaattgtaataaacctaaaagaattcgaaatcggatgagcacacttaaggctaggggtaggcgttcggtcataaccgagacttcggtccggttagttcggtctttaaaaatttcggttatctagaattgacacccgaagttgctctcacaagaatcaagaccgacagttcggttagccgaaacttcggtctcggtcttcggttagaccgtacagaccgaacaggcatacagcatgtggcaattggcagccaacacaacaatcagaacatgattgcaaaacaaatcaagcgttgaaggattcaggctcatacgtacagtacattacaagattgtatggactccattgtgctgctctgttcgtcaccttcacttcaatggccccctcctcctccggctcggcgattggccccctcgctatctcagcagtcgggtagacagcagcacggctgcacggcagcaggcggtgcgcgccgcgacgggcgcacggaggggcagcacgccggcagcagcgcgcgggcagtgccgcggcggcgcggcaacgccgacgagccgacgagattggggtagtgggtaggccgagcggcggcgcttgaggcgaagcgacgagattctggttcgggacttaggtttgttgacttgtttgtctcgtggagaaatacactaatcactaatgggcttgccagccacccaacccatgagcccaacaccaacacatgcctatgtttgcctatgtttaactctgtttttatacagatcggttacatcgagtacccgagaagaatgaccgaactacccaaaaaaacttcggtcttctcgagtgcatgaccgaactaccgaccgatgaccgaaacttcgggtagttcgggttcggttttggtttgtttgggttcggtcttcggtctcggttttttctgcccacccctacttaagatcctggtctatcatttttacaaaaagtgtagaacacgatgggtcaaaattatgctcagaatagaaggattaaacactacatttccaatcgtatgcataattattgaaattatctcgaaaataatccttgtaccaatattgactcaattgttcgccatctgtacgtaaatagagcaggaaagcacatggttaccaattgctttcgagcatgagcaaattaatttcagcaactaatctctatgtactattctttaagatcctcagaaaataagggaataaaatcgatcagctttggctcactgcttgagtctgatacagttgatctttaaaaaaactaaagtacctgggcggcattgactgggattcacggcgagtcaaggacgtcggtcaccggcagaggggacaatggaggcgacgtccaacaggttagccttacttccaaagtattttttttgcaacgtggatataattggatttattttaaaattataccgctgaatgtgattttttttctgtgaagcttatatttattttttgttatttttagacattccaaacatgctcatagttggtgaaaaagggaagcaaacagttgaagattattaccagttgaagatgtaatccagaggtcaaacctgagaattaaaaaaatgaaaattaatatagcagtacaccactctaaagattattagtcaggttatattttacacaaatttccggtcaattgatgtgtataatgcatgaaattcaaaatatagccaaaggcgctttccagtttccaacagtaatgacaaattttgatgagtaaatgaaaataaggcagcagtgtacatataagcccatagaactttattttaatggcttgtgcattacatatcgtaatttgaatttgaactgtaatggttgaaggaaagtgatcgtgcaatgattaccgtgttcgcggagaggttgagactggagagggttccagtggtggcgtcgtcgatctggaggacatggagaaaaaatcataaacccttgacatcagttgttatgcatatggatatataattggcatcatggtttttcggtaattaagctcaactaaagggtagtaatatataaatcaacatgcagagcatgaatcaaacagtcttgatttatgaacatttccattgaatcgcacaaatagatagataatgcaattatctgaacctgaaatcgaaatcccatttacaactacaaattagttaaaaaattgatgcaaatatagaaataatatcccttaacaacaataatggactaaaatcatgtctatcaagagcatcagttatagccccacaccagtacaaattgagttatatttttcttgagctttatggtgtgcacaaggtacatcccccatgtttgtcaagtgcattagctgtgttccaatttctccaaacaacccttaaaaagattactacttccccattcctattcacgtcttacccaataggccaataccaaaacattccatgacagcagaaacttattcgcattcattcacaaatcacaaattggcaacctaagcttgagctacaagcctatgagcaatgaggcatgagctatcaaccactgaccttcaattgccaatcggagtcgccgagtaggagcctcggatgtagggatgtggaggcgtgtagtgacagagcaagagtaatcaggaattttagttgggtagtcctacttcagaggttcaaatcacatatcaaaattttggaacactgcaaatctcatacaagtacaagttagttaagatgtgattaaaatatatcaataatatcttataacatcaataatgaaaaaagcttcggtctccctgcagcaagggggaacttctgaaaaggaattaattgtacggagaagagatcacaacagatataatttatatgaaagttgaaaccatcctggagcaacaaattgtactgcttgttattccttgacaggtttgtgcagaacaatacacagcaagaggcgattccaaacagcctcaagaacagaacgggcttgcaactgtaaccatggtttgcgcatacacatgcttaaaaaacatttcatatttttagagaatggatcatatttaaatatgtttattaaaatctgtagaaatttcactgggagtaatatctcactgttgtacacaaaataaaccacccccatacagaaaatggagatgctgcataaatgtttggcaaacttgtgttagagcaacatagcagcataaaatccatgtgcttctacgctgttaccatcaaatttacaacacttaagatcactcatatttactttgatttttctttaataaagcaattcttagttgttaaagaccataagcttagcaaatggcaaagaaatgaattttgtttgcagagagccttttttaatacctttttcatgcaagcattactgaagctgtgagggagagtatgcagtacctgattatgcagtccctcctcttttctgaattttgtgggggagattccttgccaagcaagcctatcaaggagcaaaagaaggaaaaaaaattagcaagattaagagttggaaatgaccaacatctccgtaacgatcagcagactaattagatcagcataaaaggcaaaacatttgatatagtcactccatatagaagtcctctagggtgagaagatataatttgcagtgtatcccctgattcggtttgatcattccgtaaaaaagaaaaatacctgtagcctttaaatgcgatgaaacaatgtaattttctggtgtaatagaattaataactgatatacttgaccaaataagttccaattccgttatttcatctacatggttcagaaacgaacttaataaaactctctaaaaaatgtactgataccaccaagctagtagctgaactacttaataaaactctctacaatcgctaacatccagatgacaaccacctactggacaatatttgcaaaaactgaattatgctagtccagatcaaatcatccagtcatatatggaatatggatattatttatttaactaaaagttgctgtcacagggaacataattgagagctgcacgttgagccaagaacacgataaaaaaaacacaccatttttatgcaaacaggcagatagatagaggtcaaaacatcaaattattagttaaggaattaaattaagctaaggcaaatcctgctccaattcggcatgtctacctgatcgataatcgatcgttttgttctcgagcatttcccatcgagagctcacaaatccgtctccagtttacggtgcggcgattgcgccgacgatcgatggatcccaggctgctcagtgccgcgcgccgcggtgaccgcgagtggctggaggccgttcttggcggcgccgcaccggcgccggaccaaggcgccgttgacgtcgcggggccgccggacccgggacaacaagcgcccgctcagccgccaccgccatcaccctccgcggcggcgctgctcctggacgtggcgacgacgccgcggggggactccgcactgcacgtcgtggcgggctccggcgacagcgacgacttcctgcgctgcgcgcgcatgatctaccacggcgccgagggtctcctgggtcacaccaacgcgacaggcggtcgcgcggatgaggaggaggcgcggcgattgcggaagagaaggaggtgcgggagaggatgcgttgcggcagagaggtagatgcgggagaggatgcggagggaggtgggggacacgcgcgctgatataggacgttggatccaaattcttcagatgggtttcgaccgttggacgtgtgacatgatgaatgagtaaaaccatttgtttaagaaaaaagtctaaatacccccctaaactttagataaaagtccgtctagcaccctgaactttaaaaccagatatccaacccctaaactttgtaaaaccgttcatattacccactatggtggttttgtatagtggtttttatctaattcgtatataaattggatgagtttgatcacgtgacatacacatcagacatatatattaaaatctccacttaaatctttctttttaccactttttagctctcttacaaacaagtaccaacataataatagcacggtatcgctgtataagtataaattgatgacttacaactgatgatatgtaaatatgttatatatgttatttaaagttattcgtttaagcttttaaaatatgcaaaaccaccatccaaaaccaccttagggggtaatataaacggttttgcaaagtttagggggttgaatgtccggttttaatgtttagggtgctagatggacttccatccaaagtttaggggggtatttggactttttcctttgtttaactatagggtagaagatgaaagggctataataacgtatcacataggttcgtttatagtttatgagttacgctacacaatgcatacatttgattgcagaaagtatagtgcatacagaactcatttccaaagaatataactgtttcaacgttcaccaatgaccagacgatcatagcatgagacttcatgcatgaccatcaagtttgagcactgtcaaggtatatatcctttagttttgccacgttggacacagtctcgcatctcctacaagtttcaaccacaggatgtcagtcatacaccgccattgatatattgttgaactagcaagtacataactgtcgggtcccgaaactaatgattcgaaaaccgatatatttaactgtatcaagccctgaatcagtagattgatacaggttcaacaatctgaattttcattacatacatttgaatgtctctaaaggagattttattataacataatagggtatttacaagtttgtggctaactattattacaacagaagctatagaatgactcaactctaatgttttgctatagacttaaaccatctaactacgctagacttggaagttaagttggaatgaaactaacttatatgattaaactcccggctttggcaaaatctccaaaatgactctaaaaaggtggggttgaagcaagggtgagtacaatgtactcagcaagctattatattcaatattgaatgcatgaaatgataatatcttagtagagctagatttacttgcagaaagctgagaataaagagggacaaagcctatgatgtttgaaatgcatcaatatttaataaaatcttcaattaggtttctaaccaaataccatatgagtcccgatactcaagtccatgagcacggctattcgaatagttttaagaatattcatactgcagtagatgtacgctttacccgcagtccataacttgccaataatcattagcttagtcatggcccagtattaggttactaacaatagtggtacctgttccgtgaactctagtcctcatgcgctctgaacgtaacgttatcagcagcgagagtagttctggcgttctcgaggtttttcgagagaactagttgagagaccccccgtcatctcaatcaggttttcacaattcacacatacagctcgcgagataatcaagatatttacctgcgcctcggtaaatattacaatcgccctgctcggcgtaagtttgcctcctgcgcgagaacttaaataagaaccactacacagagataccacattattaattgacataataactaggtatatccccattctagaagctgcggtcatacctgttcgtttgacataagtatttggtgaacaattatatcgactgagacagcactagccacccggaaatcaaccaattcctacgtactgtcccaatctaagtttattatatttttatgcaatctaactaggcaaggctaagcaaaagctagcatatttggtttactatgttcaggttatgcatttgaaatcatgtatgactaatgcatagaataatagaggcatggaatatgggacaattatgctcaaaggagagggataataacttgccttgctccaacgtaaataaatccaatatagcagcctgattatcgattcttgaaataccataggttgccatccaaaagataatagactctacttgaaggaagagccaaattcaataaaagccataaaatagaaagagaacgataaatggttaaaagggctatggtttagggtatattctatttcctttatagggtatagggattattgggctagtatttgctggcggtaggtttaggtagtataaggtttagttgtttgctagtcgttgctagagttgggtagcataacgacttgatttggtatcttctttagccggtgtcaacagacagcatgacggttagaggaataggaagtttagcggtgtggaagtgttactccgacaaccgtgagtggcggcggagtggttaggatcacacagagctcaagaactaactgtgcggcgtgctgtaaaggtcgagggaatagtgagctccgaccgttgtacgcatcgaggcgtggagtgtcgagagcagcacttcgaccttgggtttgggttttgccgggctttacaaccaacggttcaacgtcggggatagtaaaccgcgaacgtccccatggaaggcgtaaagtttcaaccggcggctttttagtggcttaaggggtagtttgggataaaagaaaatatttgaaagacaaatataaattcaaacggtatttgaataaattcaaataaaatagcaaattgggtttcaaaatgaagcatttgaatttagatgaatttatgtccaagttttactggaatcggatctactgtttaggagatatgggcttctaaagaatatgatttgaattaaatctagaaatgtgaaaatgcactgtgtataggcccacctgtcagcctttctttttccttttcttcttcttcttttcgttctcttctttctgtctcacagtgagccgagagaagagagaggagaggccgagtggggcggcggtgctccagtggctgggaggctgcgacgtcggcggaggtttgtgttcccgagcgacgcgcacccggggagggtggtggatggaagagaggaagagggatgtggccggaacggcgagtagaagagcttatctccggtggtaaagagaggggtggtggtggcttgattcaaggggaaaaggaaggggagatgggcaaaatggattcgccggagtggagccagcatagtggcgcaagggaagaggaaggggaactacgaaggaggagatcggccgacggcggcgacggccggacatggatggagggagagagagagaaaagagcttcaagctcgatgtgaggaaatgatggggtattgccggctatttataggcgacgaagggcggtggtcaatggcggtttgcagaggggaagagggagttggccttggtggcggcgacgtgagaaggaaggcgacggcgccggctgtggcctgtgattggtcggcgacggcggcgcatacacgcggcggtcgcgggagggttggctggcggcagtggagtgcacggcacagcgacggcttgccgtggttggcaaggcagcggcggcggcaagcgtacgcgcgccacgcgcgcccatggcgccggcggcagcgcccacagaaaggaaaaaatacaccgaaggtccctcaacttgtcaccgagttacaaaatcatcgccttttgttttctccccttcagcggcctcgagcctcctttgcgccccctttctcatagaagccgctgggttgaccccgagagccgctgggttgacccagagggccgaattcaatggtagagaaggctttaataagaatttagccatgagtgacctttttaagtattgcaaaagaagaggcctgctgatagagctgggcgggaagcgatactagttatcaggttagagaaaggcctggcccgtaagctggcccccctttaaaagccattccttattaataaggatttgttacgcgcgatatgccgacgacttactactggaaatcgtgggtgccgtatttcttctcatagaaatacaaaaacgtatcacccacttcctacaatccggcccgaacctttgggtgagctccgcagaatcaacaaccatagctacacggagtacggtagaattcctcggtacggtcattcgggaagttcccccgaggacgactcccatacaattcctgcgagagctggagaagcgtctacgggtaaagcaccgtatctagaggtgagtgagcctacgaccaccaattgcttatcggcaaatattatgcggcgcatgaggggcgagcgagggggcatgccaagtcagcaaaaagctacagtcctacagtgcccggggtggttgttttgcgagaaagccctccggtttgttcgtaattccgagtaggtcccttccgaacagtgcccctgaggcgatattgtgcgtaaggacccttctaaaatcctgatattacatgcgcaggaggggagaaacgcgaaataggagctctatgtaaaaatataaagtctaggggctttttcgcaaaagtgccgcgcactgacccccttgccgcctctcctcgactcctcctccctctcgtcctgcgccatcatgacgccgccgcgtccgcctcccctcgcgccgccgccgccgccgcgttgacctccgccacggtggccgcatccagccctagccgccgccgccctcacgcactctcctccctctcgtctctccctctccctctccctctccccttcacgccgccgctgcctccgcctcgcgccgtcgccatcgtcgtccccgccgcctccgccttcccctcgctttctcccccaactctatcccccttcgcctcaccccctttgctttctccctcgacaggatgacagccgccggctgcggcgtcgcctcgctcgcctgaggtggaccgcgcatcgtctcctccgccagcaaaccactgctcttttccccctctcctttagctctcaccgcttccatttcttcctccccatcagtgttgtatcagccctgtggtctcgccccaaaccctagcgctgtcatggcggcggggtcgagcccccttgtgccaggtgccgagaaggcgctggggtagcggcctgtctcgtcccaatccgtagtgcggccatggccggcggggatgagctcctgtgcaccggtggcgtacaaggtgttggggcggcagtgagaggaaggtccagcttggaggagctgaggagggagacgcggtcacggaccggtggcggtggccttggatccaagcaacagtggcgcacatcgcaagcagaggagatgttggagccagggtcgagagggacggcaggggcattgcggaggtcggcgcgatggatttcggccacggcacggcgacaacgacggtgagctaatgccacatcgcatgttcctaacttggctatttgtttcaatctttcatggatgtgcagttcccagatgtatatgttgctgacaaagggatagcagcatgcgggttttcctcattatttatggattgcttcaagatcatggaaaatgtactggagaaacaagagtaagtccaggatctgttcctaattattttacctcacattattatttcctgttactttgctttggaagatcaaacatgcagtggttcaccccctatgtttcaatggcttgacagtgaccattctatttcatctggagttgcataagccttaccatggaaacgatatggccttatgttgaggcccagtattcaagtaaggtagttctatataaacacctctgcaactcaaagccaagttagtgaggcctaacaaaagggtcctcaactctattttttctattcctgcatctattttcatgtatctgtgtttgccccacattttgaggaagcgatcctgggtatactggtaagaatttgccctttcattagagggggggggggggggcatctaatgcaatgtgtggttttctccaaacctatgagactgacatatcattatttaatacaaatcatgatgccattggattttcccattcatgtgttcagatatgttgcacagacgttctccatgatatgttcagttcagcagctggaggcagagttgccactcgtggagaataactcttgtgatctttgcatacagactacctgtatgttgcttctaacaggggtatgtgcagcaccacataacacaaactcctctaaaagaaacatctttcacgtctacctgtttctgctaacaaaagcattttgtatttctctcattcacatggagagttgattggtttgtttgcaggaatttgttggcatttgaattcgaggttagacagtggggttgtgacaaaaggtgacacactcacacactttgtttcattatggactccatcaagcagtgtcatgggcctccaaaattgttcatacgtgacaagtatgatagcttaacctcttctattcatgtgtgagttaagcttgcatctactgaaaactaaagagaatgctggccttcatggatgtgatcatgcattttttcaggtatgacattaggggtgagggagcttgcttgaagagatacacagactcgtccttcaatactggttttgcatgttctaggatgctagagccaataactcaaagagtaagaagacctcttagagctatcgtaacgaaactgaaaataatagatttctttagctgattatttttgtggttgtggatgattcaatccactcagacatagaatcatacctgacctaaccttaaagatcgagtgcttggcatttcttttccatttcttctaggagattaggccgcccctgtagaatcctcagattttcagaccacctaatgcagccaacaatgtctccaagtacccccccctctctatatataatcatctcatactatccagtatcctttcgcttctattttcttcccagaaaaacaatatcttttttgtaggttggagatagatttgtctaggcaccgatgactggagtaccgacaactaagtggatctgtgtttcaaagcttcaaaccacatacgtagaatctgtacatgagaatcttcaccagatgagaacccctgctccatgaaccattcagaagtgtagatatctttcattgcctcacctgacacaaacactgtagaggacatcatgtagacactttcagtaccatgtacaacggcaagtaaaacaagtatgtgtcaatgatttttgctcatctcagcttagtgttatgagttttacatgtggaattttcagcagatgctgtagggcaaggtcttcctttagaagatttactgctcttaggtattttctagagctttaacttttagtcatttgtatcaacattacttagaaattgtatttgtatagcagctaacctgatatttcagttcatcgtcaattagtagataaatttcctaatttgtacaagctatcttctgttctaggttatagttgcgagctagattttggcattgtactgctgatttgcatgctctctaatgcaatcaagtatatacggtgctatccttcagacatatacaatgacaatacataatgattgtattgatatttcagttcgttgtcaattagtagggaaaaatgtggttatgatgttggaactactcacaaaaagaaaaaaattgtgacagtaacaatttcccctcaatggcagtgcctccgtggtgagatggatatgaatttttaatatgcccctgacaaaataattattctacatcattttcaacgtttattatactagagtacagtggtgccatcttagatatgcaatgccatcactctggatgttaaacaagaaatgaccgacgttgctcttggactttaaattactctaatgccagaatcatatgcatataactggagaacttcatcaatttcttgcagctacatagtttgcacctcagcatggaaatcttccaaacaaaaaaaaatggaagtttttaaacaaggcctagatttgtagtttatgcagacacaggaaatggcatgactaggtcactgttgcattcttattgtgagacgtagtctatgaaatgcagtatttgccattatcataggtcttcatctatttcaatgacacatgaaatttgctccatgttgatttgctcatttctaatggacaatcttatggaaacatcaaactttttgttgcacaggtcacaggcagtccttggttgtgtgcaccattctgcaggcgaataagaaaatttttagttcctaccatatgtattggggtatgccacaaaattggaatccatttaatcgaatcctaatgatactttgttagctatcactatgtaggaataatgataataataaatttcaggtttggtggctgatatggatattgagtttgagtgagaagtgcatgctttgattttgtattcagcgtttcgtttctttagttgtttactcgatcacctctgtcatcaatggactacttgtcttcatgcacctttatgccatacatgcaaatatgtagggtgtaggcctcagggataaaaatgcatttaacaatatggtgtatatgcaagcttaggcaaaattttcagctacgaacttactcctttagccttcacctaaaaattgcttactattattttcctggagttgtcctcaattttctcaacatcactcatattctagacgcgttagttacaacaaataatgtgattactgagcaggaagttcaagaatatcggcatatttgtaggaaaatgatgtcttcagtccaaactgagaaaatattatgggagtcttctcttaattgctgccccaggcagcaaggcatatggatatgccattaaccaactcaagaattgcactgtaaaatgtcaaaaactaaatggaaagtatttgtgttcttatcaaggtctttctgttgagttttaaggttcagagttatgatcccttgatggtccatttgtgttggtttggatcaacaacatgccatgggctgctgatagtatcatggcggctcttggggccaaggtaattgaattcttcgctgtaacaattgtttctccagtaatgttttgtccatatagtatactttgtatttcaaacctatcttctgaaatggggaaaaagatccatatttccacctagggaatatagtaggcatgttcatttctgatgacaaacctgtgattaggactagccattagccataagtatttactgaccagaatgtggacagaaatcctttttctatagttcttgaatttatacagatcaagaataaggatatttctatttcatcttgtagcaaggcaaactttatgatttgttcgttgtaaccactctatgaggtaagcatgatttcgttgaccgatgaagggggtaaaccctgttgtgatttgaagaaataaattggtatattgataatgctaaaagaacacttagttgtgcttgtactttgttatagggaactagattgaactaggtttatgttttgttttctggttcgttcatcactttttacaaccaaaataataactaaggttcttgctcaaattttttttttgttattctaataccagtcaatataacatctccattgttcgatatttcagttatatctattaaactacttctccgaagctaaattcaaactcagcatgtcaccctatcctatttaactggttttcttttttacagcgtgaaatatatgctattttgcccatgtaacgaagagtagttaatttggggatcactgatcagtgatcacataagcatctattttttctgctgaaaaaacaaaacaaacattttttgcgaaagcatttgctggataatctatctaattggtttatttgaaaaacaaaacttccattcatggtaaatttctatttaggaaaatgagcttatgtttcctccaaacagggactttacccaagtttttattgaaggtctttccatcaagtatacattttgaatgacaccatggtttgctagcccaactgcctttctagctgatatttgatcatgtatatcttacaattgctttacaaaaggcattattatcctctgtatccatgttataatttgaatcagtttcttctaaaacggattgagatgtttcagatttcaaaaaaagggtcctaaatcctatcatcaaaataatacttttgttggagagtgttgaatattttcagagttatttaatacgtattgcaatattatgtttttctgctatttcaatcagaattgagttgttggtgataaattttacccaaggctatcatttcattttctattctgatatttctacatagattttctttagaaatttgttcgattaatgctctttgctaccctcaaatttaatttttaatcttgtcataccaaatacatgaacatgcacctttcaagaattcggtgtattctaagccacacctctaccatgaagcagatgtcatacgaggagttttttgacctacatctggcacaatcacttaagaggtgcaaataaaaatatgctcactatatgatctttgttttctcctttctttcagcttttcagccttctcttttgattccttcaaatggatagacaaattcttcaactcttccgccttcaccatttgttcaacaattctttgagtaagatccttgttcttctcttttaaattcaagcactcttgtctgggatcctggagcaataatgacattttattatgttcctccttttttttttttatcttagaaccatgttttgtagatagcctgctcttcaagatttgtcagtaaaactttaagctgcaaaatgtcatcttcaattttcttgttgctatcaactgatactactatatcttcaaaattgagacttgctggtaccaactggagccaatttctctgtgtttctttttgtaagctcgtcaagtcctttagataagcttcgagtgtgtcatttctatcagcttattttgctttagttcacatgtgtactctaagtagcttatcacgtctttctcgttaacctgcaggtttttaaggtcatgtctgaagaaatcaagttacacattgatctcctcagtccatctcaaataacttagcttcagtttcagtgatgagtgtgtcctttagaacagttgctagctggtctctaatattggaaaggtgggactagagtcatatttttacagttgaggtacatctatatttgttcagtgtgaaaaaccatcttgcatcaaactgtttgtcatctatttccaaaactgggtctcttagacaatttaactatgtttttgtgctcatcaaaggaaagccaaggaaagcaggggcctgactcttctgaccaagttgttacatcgaccttgcaaagggtagagtgaagatctcgtcatgatctcatatcatcgtgcaaatatgtgatttcattttccatatgcatcagtgcttcattcttagagtataacggctatgtaatagttttgttctctccagattctgtaacaccactcgtacgaaattactcaccaatggctaacatataagccgtttgattcatatatattatatgtgccttcaactttattcagctttaatcttacaagaccagtagttcagcctaaaaacagcaaaataatctaattaatccatctatgtgcaggcggcgcgtcccaacctctagtctcctattaccaattgcagcagacttggactaatggaattgcttgaagtgaagaccagtgaacaaaaggctttacacaaaaagaattgttgacctctttcgggataaggcccggaagaagcagggattgaaccagggcttgttgacacagcagatatcaaaagcctatgttatctcattttcagggaccgagcaagggatgagcgccctctgatctaacgtccaaacaaacaactgcccttgttactagaaatatgaagcgtgctagcgcgcacttcctattaaccaattcaccaattttaagatttgtaaacaaagataataggagccgaagtcaatcccttaaaacactcctccccgaggggacgttatcggtcgcttcgttcccttgtttactgatctcttttcaggagataggtctaccgttgcaaactcatctgcttgtaaattcattgtgtaaaataactcgtaaattcattgtgccagaattgatcactgatcaggtgtgatcagtctcatccgtctaagagactgatccggtgcgatgagtctcatccgtgtaatattttggaattcctcttccaactcgtcccggaatgggcgttatggcaaagaacaagaagaaaaagaaagaaggaacttgtccaatagtaacaaatggtgcctccacaggttgacatctgatccaacctagtagtaagcaatccgccaaaagcaaccaaaatattccttggtgaatcggtcgaaaacttgaactacgcacatacatttctttaaaaaaaggtaaagccaagagatataaaaactggtgctattgcggctacacctggagtgagcccacaagagcttttactgtaccagttccgaatataagaaggggctcgcggattttaacaggttaggcttaatctacccaattggaaatctcttgcagtagcttttactagaaatccatttctcccacaaagctcctgtgacctaaccatctagatagaagcctcgcaaagagtatatgccgaaaatcctatgtttggagtgaccatgaacactgcttgagacccttctttcgtgagagttgtgattccgctttcatgttttggattgagctttaagtggattggaggcgggcattttcatttcaacgtagcagtagggaaagtgatttcggggggttagtacacatgggcagttgggacagttacaggtagttaagttcggtcttattcttatgggcaagtggtcctagaatctctctttccttctctaaagtatagctttatgaaactagaatatgagtaaatatagaaatagaataataagaatatcatatagccgtgtattggttttgatcccagttttatcctacatggcggctgagtcagcgtgggacccacgtggacccacatgtcagcatgccacgttatctcttctttcttcccttttcttctcttttctcttttattttcttctcttctcttgtgagggtaggcggaggcggaggcggaggcggtggcgcacgccgttcagaatgaccgcctccccgtgcgctccgtgctgcagatgctcttttccgagcacggcaagctcaaccgcctcgccgagctcagcggcggtgcctccttcggcgcgcccagcctggtattcgacctccccggcgcccgctgccctccaagcgcgaggtgctcgcccagcaccacgagctccgccgcctccgcgaggacttcgcccgcctccaggtacggtttcatcacggccatctccgccgccaccgttcatcaattcaaagctttgaggtgttcgtcattgtcttcgtcgcgacgtgcaggtccagtgcagcgcgctgcaggctcaggtggacaggctaagcatggagaggaggtggcacggtggcggtggcgggttcttcaagtggagcacgttctggttcggcggcatgagctccgacgtcgcgagggtggaggactccgagagcggcattgagcggcggacgccggcgagcgggaagaagggcaggggaggcgcacttgactagttgcagaaagaactctgcaaagctatgtatgcctcacttgagtactaactgttaggtttgtctattggattacctaggtttagatctagtcggtagaacactttggatggatgaacaacaatagatgaactaacaaagaggaagtgagagggtttagggatgtgaccggtcgatgttgaggaggaggaagtgaggccggccatcgtcgttgtcgttgtgcgcttgacgtgggcggcggcgacgatgctgcgcggcagtggcggtcgtaggcgattccggcgaggtcatggcgcgacgatggagtcttcccgtcactggctgtgcccccttgatcggttagggtttgtggggtggagtggcggtggcgacgaacctcgtgtcttgtgtcgacccgtcctccacccctctttatatggcgcagggtgacggaggcccaccagccattgggctgggcgcccccgatcagggcgcgggtcaaggcccccttgagccgttgggctcaaggagagggagatccatctaacattctcccccttgatctcactatttcttttagctttttctattccatcacaggtttacatatagagcatgtttcatcgtcacggttaattaccgctggattcgacagccactatacacatctctattcagaaacagatactttaacttttgggccctatagtccaggattcataaggcttcccttaaacacatgcatgctacatgttccttgaacatgttgggaggtaggcctttcgtgagcggatccgcgagcatcctttctgttataatatgctcgagactgattgtttgatcccggactttgtctctcacaacatagtactttatgtcaatgtgtttggcagtaccacttgactgattgttgtgagagtacattactgcgggttcgttattgcagtataactttattggtttcacaatactgtcaaccacctttaaaccgggtatgaacttctttagccagttcacctgccccgttgcttcatagcatgctataaactcggcatacatagtagaccctgcagtgatagtctgttttgagcttttccatgaaatggctcctactaccagggtgaacacatatcccgatgttgactttgtattatcttttgcaaagtcagaatctgaataccccactatctggagcgattctgattttctgtgagacagcatgaggccttttgttccttgcaaatagcgcaagactttctttacaaattccaatgctctaggcctggattactttgaaatctgccaagtaacccggtaactaatgccacgttaggtcgtgtgcacacttgcgcattcatataaacaattttagccatttatatctggtattgatactgccatctatattcagggcatgtctcaacatattgccaattatcttgttatacacagagcttgaactgagataatgaagagatcgcaaaaatgtgtattcgtggtctattaaattctggccaatatcaaaatcttcaactgattttcctaaatataattttttaaccatcgcagttgtttcaatataattcccgggataatggatcctactccagatatgatggctaaaagacttgtaccgcaatataacatcgttactttaaagacactacaattatctgtctaaactgaagcctgaagaccatgaggttcgtctctttgaatgaactccagtatccaaataaatataggggcaaaaatagaggagcaacaaatcaataaaaaatcaaacagaggcaaatgcatgggaaggaacatactggcacattctcattccttggtaagaaataaaggaattatagaatatatagctttgcattgaccaagtggcttaggtataaaccaactggcctgttataaactaacaatattatctgaatatcatctaatacaatattcaaccatacttcagatttttaaggtaggaaaaatgtactgacctccctccttattcagggtgaacaccttattccaagtccatgtatagatcaagaatatagagaaaatacactgagaactacaatgtgaagaaggcaggaagaactgcccacctaatgatctatcatacatatatcaggaaagtgagctagtaaaaatggagatataaacaaatggtacttttggacttgccaaattggaacactggatgcaataatatgtcaagattgtcaggttcaccgagaatctttgatgtcatcagaaaatttaagctttgccgggtcatatgtaatacttccagattcaagtccatgtttagtgtcttctatttctttctgacagcgctgctcatttcccatttgcacacctgataagaagcacaaaagggaacttattaccaaggatgaaagctgaagaacttagtttaacatggcttgcatgttccatttggaaaataaaattggcttcacctttacactcactataacaacaaaaataaccggcatgtatcatggaactataataatgtacaccccagagaagactgtctagacctccaaacagaaaataacctcatgaatactttggatgggaaaaatattgttcagtaggtgccaacaaactaaaacggtgaaatgtaaaaggcttagaagttggtaatataaattacttccaataaccaaattgcacagtagataacagacctacaacatatttgtttggttcaaagcacattgtagtcaatatagcaaattttggttgtatcaaatattgagaaagcctatggaaacggaattcatggtactaataaacctgatatgcaaaatgtaagaactaaccaattcaaattacatatggatattttgtatccttagacaatgggtaattctaaagataaaatacagcattgcagttattattatagattaatgacaggcatatatgtcactcttgtgttcccaaccaaaaagtacatagagagctagaccatggcaacagttcgtattaatactgcaacactaatgtgcaaacaggtaaaactaatttgtatagacaaatgatctgttaaaactcatgctcaaagaatgaagaagggcatctaggagacaaaccgaatcataatatcaatacactcaattcatatacaacatatgcatgacagaaggagatgattaatttgatctgtacctgggtggtgatgtttaaacattagtactgaataatctagccttcactcccttttttctttccttcctaccaatcatgtgaaactcacaatgagcagcaaatcaagaatagagagcaggcgctagaacagatatgtatatatgcatataatagggagaatcaatgttttagcagtagtcatgttgaaagaatgaagaacatctaggagaaaaaccgaagcacaatgtcccaatttacttgcagccgtcgtcaccataccttgccatagtttgtgccttgctgccgtcgtcgccgtactttgccatagcccatgccttccgccgtcgtggctttggtgcccaagctgctgctcttgctctccccatcctggcaccgaggggaggtgagcggcatggagaacgggtgaggaagacagtggagagtagcgttgtactgccgaagagggccacgaccggatccacctggaaagtcgagggaatcggacttgggatcgcatcaggcatagaggatagggtgagggagagagaggctaacgtggagatgagatgaaagaggagaagaggagtgcagtggctcgcatccctctcgtccgggcaaccgacaatccaccagcgaggaggccgctgttgccggatctggaagccccgcctcctcactggtggacatgacggactcgcttgccggcgcgggagcgcgggcacagtaacaatggctggatgagggcacgagggaggcgaaggacgacgaagctacgacagcgacggcgcgcgcgaggaatgaagagaagagggcatggcggcgcgcgtgcgagaggaagcggcgacggcggtacggcgagatagctggagtaggttgaggccttgagggagtggaagaggagggagttgcggcagtgacgacgcacgggagtgaaggaggagggcgaggctgcggcgcgattggaggaggagggcgaggcggctagggtttgttcaggcttgcgaaatccacaccgtccgttagagatccgacgatcccacgggtgcggaagggccagcacagtgaggaacgtggacggccagatcgaccctacctcgagatcggacggcggatattagcggggaccggtgcgtaattaaccaaaagtgtagggttttttttgcaaaaattgctgatgtgctggtagtcttccaccgatcgcacggcttttaagtaaacctatattccatccttccataacgttcaatttaaaactcaatctctcaatctacaaattaagaatgtattctttcttataccttatagtttgaatttaaacatccgtgtttatatttattttgtagtttgcatttaaatttacatgtttatattttaatccatagttgtatcgagaagtatggacttactggttattagtagaactagatggtgatggtgctgcatgcaaagcgcaaagctttcggtacgtagctgacgactacacgagaacgaattatttggaggcgtcgaacagataaatattagtactatactagaaaatctcgcgccaaatggcgcgccccatttagcatgttcttatgcatgaacgtagaaatttcaaaagatttggtaggattaggccaacttcattaaattgttcatttaacatgtagatttattcaattaaagatcatcatattttaatctatttatggcatagctattaaaaagtgtttttttagtaagtctacattatttaaaatgtacttattttaaaaatattaattatcaagctttatcttcagctaaataagccatggtctttaaaaataagctttataaaatggactgtttttttatgtaagtctacattatttaaaatgtacttattttaaaaatattaattatcgagctttatattcagctaaataagccatggtctttaaaaataagctttacaaaatggacatttttaaataacgaccgtactcgttttttatatatataaaaaagaccaaatcgaatttatgataaaagaacatcttttcctcgttcaaaatataagcattcaaagtttatatcagaatatagcaattgagtatccagtcccttgtctcaaccaatcataatatttcttatttaatttttccacttacccacctagtttatatttggttaatatttcttatttaatttttccacttactcacctagtttatatttggttttcaactaagaactatgtaataatggctatagcttctattgaagtaaacactggattttatccattatctaaaaactcacctagtttattaatacctatacccaatttcaaataatgttttagaccttacaatgacggggcatttctcacgaaagtagaactaacaaaaaaaaaattctactccaaccctgaaaactttatttctagcaattctcatgcaaatttgtagtggcaagaaatatcctttgcgtccttatcaatttttaaattttaattaaatatgtatatataccttgatttgattggctaacagatgttcttataagggagtacgtaacatatcttttagtatttgattgttttttttacttgacacagcctattaaattttaatcgctctttattttgcaaaagttctataaatattgtataatactagcaaaatacccgtgcgttgcaccgggtaatgatatggtgactgaaatttgatttgaactatttatatgaagaaaatgaattgtaatttaatgaaatataaaattttctgcaatattaattacactcttttaaattatagcaaaagtgatattgcgttgcaacgaatagaaaaaacagataaagttgaattaaaacatattaaattctaattaaatgaaatataaattttctgaaatatttaggtattttttaagtaggtaggtatacaattaaattaatttataagtaaagtaagtgtaagaaataaaatgttgtggttggatttaacttttattaaattttctatattaattacactcattgaaattttattggaatttacctagcttaattgctaattttgataatacaaatatcatttcagcatttattgaaataaaaatctaaataaaaatccttttttctctatgggcctttttcaacccattttcttcttcagcccgcaagagaccaaagtctacttaatacccccatactcctttcatttagtggaccgcgggcccacgtgcgggcccaaaccctcaatcgatctcagccgttagttttgatggacggctcagatcagattaaaattgatgaaaccctaaccctaaccctccccccagccgagccgagccggccgcctctttctcccccgccccgacgccgcctctccccctccctctccccaccggggtctctccccctccccccagccggccgactcccccgccaccggcgccgtccctcccttctcgccggcacggcgcggcgatggtggggtgcggcggtgtgtgccggcgcctccgccttcccccaaggcgagcggcggcggcggcgccctcctccccgcgagcggcggcggcggccactctctccacttcttcccctttctctttgtgtggcggcgggagggccggcgacgccctcccctccgctagatcggggggaggggatgtgcgccggagcggaagaggcgccggcctgaacgacgtggagacaggcgtcggcgccggccgcctttttttttttttgcaattttattccatggctattgctaaccgaatcggattgtgtatggacgaaaattagatgtgacgaccggaaaaacacgaatatttatattagttatagattttacatgttaaatataactatatcttttgcatccatcaaaacatcacaaaaaagctgattccggctatcggttggcaaaagtgaagcacttattaactctctttattattttattggtcgatacttatcaactgcattagtgcaaagagataggtaaagtaatgggttttctagagattctgatgtgcaagggacatcacaagagcttatatctgattgacacgtggcaaaaattttggtgatgtttagctaatttttcaggctgccacgtggcccaataacattctagaatcatgaccctgatataggtagaagagattgctgataaagaaaaatggcattttgcaacacatttaacttgttcagtgttcaagctaacgttgaacctggtacaagtacaacatgctggcacgcatgtccacatctcgcgggtcgagggttcaagccgaatacaacacacggcatgttgcatttcatcataatttaaagtacttagcatcactttgaacaaggttttggtggtcacatgtatattcgcaaccttcttaaggtgtccgcaaaagacgtgcgcagcataatactttgcagacctatggttatcaacagcaacatgccactaggcacctgcacgaagaaaaacaagaaaatattactgtaaatttaaacaagtgaaattctattgaggtaccctaacaacttgacattacgatatattgctcaattaataatataggcgtcacagcaatgatttccacatgttcagtaactgtagactgaaacaaaactcacgacatacctttttgctcatgtctttagcaccttcgtgagcattctgaatgcagcagtactgtaccttctcgattcatgagtaccactcagttgctgaattcttcccaagaaactaatattatggttcagactcgaagactcgttactcactactgaattacggaactgtggacgatgaagcattgacttctcatctgctgctccattggatacagacagctgggcccctaatactgatctccagtaggggaaaaaatttctctttatgaatgttggatcccatcctttaagtgccttttttctcgcagcctgtcccataattaaatgaagattaagctttgtgaaacccaaaaaaaaattgttaaattccagcttgatcaaccaaagagcacttgattcacaatattttcatatatcctgggagaggtgttttacttgagcaacagaataaattgttttctggttatattcaagtgatgtcaacaaactgaattgcttaagcaaaagcagctgaaccagtaagcagctgcacggcagaaacataacaaccagaagcataacagacatctatcagcttgatttattaccatccaactacaaaaggactaatcatactgagttcgttcattctaacatcttaactaggtcatgatcaaatatcaaaacaaaccattgcacaccaaaaatctatcgcaagaccacacacacacagaaagggaggcagatcaaatctaaacacaatacttaaagcaaaacattctatctcattggagaaaatcaattattttcagattgttgacagtactataatctagaatgacgcactgctgtaaaaactgccgagcaaccttttaccaggatagagaagagaccagacatagagtttctacttttctagaatcccaactacaagataatgatctggcaggcactctggcttatatgcaccagccagtaagatggcaactaatagcaaacctaacttggaacctaagtaactgatcattagctgctgctgctccctgcatgctttggtacatcatactccccacgcattgttgcacaataattaacaaggtgaatataagaaatcatcattggtaacatcggaatacaattacctttttttctgcagcaggcagagaagtagacatttgtgcaacagccttggttacatctatatgaccataaaaaatttaataaaggctctttctgagaaattcagaaacagttacttaaataataaacacacacctttgtgaactatgtcgctgtaagaaatcttgttatatggacagcttcaataacaagtttaagaaataattaataaacaacaaacatttgcatagaaaaaaaatattatattgaatacaaaaagagcagtacaggatcatggtgtcaatgtattcttcgttagggcaaaacccgaattccttaagaatatatgaaacacgcgcaaggacctccacattgggcacctgaatgacattagaaccattatatcagatagtgaaaaatgtcagaaaatgaaacataaaaatagcatatattgataatatggtcatgtagtacaatgatatcattggtggcaaagaaatgacaaaaaagaatggtttagataaaatttaattataacagatgaactgaaagaaggtagaacagtttgcaatcacatcgaatacaagcttacttggtaaaataaagtgcatatattgataatatgatcatgtagtacaatgatatcattggtggcaaagaaatgacaaaaaagaatggtttagagaaaaattaattataacagatgaactgaaagaaggtagaacagtttgcaatcacatcgaatacaagtttacttggtaaaataaagtacatatacaaacatattcaaaattacgtaactatttctcttcgtttgccttaactatattcaggattaggaaccaaataatacgactagatggttcaaaaggtacaaggcatgaacattagtcattcaaatttcaacttggtaactgtaattgactataaattataaaaaggtaaaagtctattttttggcatttgaaatttccttgtagtccatttttcaccctgaactttgaactgggcattatacatggtgcattaggcagatgaactaccttgggtggtgttctgttgctgttttagtgtaatttttttcaatattttttaatgtaatgtgtttgggcctaggctcatagtgctttcttgaagcatatgccctgaactaagaaactagttgttttttaccccaaatttataaactggacaaataacacactaaatcatatttcatggtggacaacatgatagtggttctcgctaacatgaacttcatcaggtcagtttcattgttgtggacctaatcatgcgacatatatactaccaaaatatgcaaaatatgagcctgcactagggaaaatcaccactaataccaatatattttttttaacttttccaacttgtttgtgtcaacaatatcaaaatatcctcagggaaatgtagtcagcttaagacaataacaaaacctattggttgccacttgccgccatgaaccaataattaatacgcaaagtatttcgttttttgccgttatgtgctgtgcatcaagaaaattcacaaggagataatagcacacaagtattcatgaaacatgcaaaagttgcaatggccaacatcactaaaatatatcaaaaagtgtacacagttactctgtatatgcctgcgctgtggttacaactacgattaaagaggcttgttgcatctctaataaaattgatataaattgacatttttatacaaagatttcgtatacatttctgtaaataatgttaaatcagttttggttacttgaagcaaaagcaaaaaacaactcacataatatccaatacaaagttgaattgaaatgcaataatatttccacgctataaatcactaacacaaaaggttgatacaaatgcatgaaaattttattactatttgagatttgtttcctaaatcatctccacaactcagatattagaatgcatatcagcatctgacaggaataccctaaagttgttcttttggaagggtgagccttcagaacctggctcccctaagaagctagtagttgttatgaactggtgagtaatgctataacaggacaaattgtaggggatatggtactagagttgggcgagggaggaaatttcacagggattacttgacaaatggcatgccccaaataatagtaccaatcaccagctagagtctgctacaggctctattcagatactatctcttacaatagataagacgacaaaaggttctgacattaatgcaccaaaacagtttttttgttatctttcttttcttttcttttatctatcctcatgcaacaaagtttccttttataaacgctaagagtcgatgttaagccgttgttaagcttaacaacgatgtttcaccctcctttcccctctcatccatgtcagcaaactttaccttgttaccaatgctaagagcctgctattagttgctgttgtatacatgccctaattcaaacctatctcaaatcaaccagaggatagtaatctaatttaatatgtttcaaggatagccatgactactcaaaataacccaaggtacagaagctcctgcaacatgctaaggtcacatccctaacaatagagggctccagcttctcaaagcagcggaggctcttacgtcataactcataagcttcattagacagcttactcttgtgatggttttaacacaatgttgaagatagataaaactggactgaccgttcactttatgctggatatgctaccctatagtacaagtaacggaaagtggccacggaaatcaacaaatcactagcattcttgttaggatcagggcatggagccatggaattacctattaaaatattaataccaatatgaaaaaatatacagtgagtaagagatcatatggtgctgtgattttacaccattaaaaaaacaatagtacctctgaatgtgcttgaatgtagttatccaaaacctcaccagcttgcgaaattatagtgacaatcagacatttacatttcaaaagtgctcttctttcctccagcagcttctgcccctctgcagtatcacctttatcacacactagggaatcatagtcctcatatatacgttgcgcgataatgtcgaacccatcaggtttgccctcacggatatgttttcgggctgccaggagtaaaactgcggattctacaagcttgtcattcttcatgtaattccagagctcatcagctagattatctgttttttcagcaagcagtctaactgtatccaaaaaaaccttctgcacaataaaaagaaggcaaaggaatgaaatctaaatgactttgagcatttgtatgcaagcaagcagtgaaaaattacttcctattacatctcgtttccactaattgtagcaaggatgaactaggatcaagcggaataaaacctactactccctccgtcccataatataacaacctaggaccggacgagacatttcatagtacaacgaatctggacatgcacatccggtcctagattgctatattataggacggagggagcatttagctatttcctctgttacaaattactagctttatccaaagtcaaatatttatatccttgaccatcaatttctataaattcgtgtgttttaacaacatgcaaattatatattatgaaagtatttctcatggtgaatataaaaacataaatcttaatgtgttaaactatatgaccagaaatagacggtcagatacagatagctcacttaggacaaaactacaatgactagaaaaggagggagtaatggaattttgaactgctgacttcttgcctctaaatttgaaataagaaaatgcctcagcacatgtgaaaatttttaaaagatgacaaacaggaacacattttgttgtcatgctgaaaagatgatactttggaaagagcgttaagtgaaacaaaccatctcaggtagacacagcagatgaatgagcttgtagatataatcctcatgatactgcacaggagatagattgtcctccagatatttatgcaagcaagtatttccaactgcaacatggagcgggagtagtccgggaatgccagcatcattgactgtgtgtaaattggctgaagcaccatggcagaacagcaacttgatcatgtcaacagagaaccgttcagcagcttcatggagtggaaaaattccatatgggttaatgcagtttggattggcatgcatacaactgagctgaggtgccttgccctccaatacagttttcgcacatcgcaaggcattatgcctgacaatgcaggataaggtttctgaggtgatgttacacttaaatgccatggccgcagtacattccgcgaacaaacggaagaagcaccggacactgtcctttctcaagacggagtccaagcggggagatatatcaaagaaggcatcccgcaccacctaaattggtccgttcacaatcagaagagatgaaaagaaatcagctttcaatgtaataaagcaaaacataaagtctcattgccgtgcaccttcatgacaaaacatttcatttcagcaaagggcaccctttttttttgagaaaatggaagagacaacttacgtaaactaaaatgctgcaggattaaaaaaggacaaacgtaacaggatgatctagcaactgaattctgtacatgaagactagagagcaacctgaggggtagggtctgggatgattatatcatttgttaaggacttggccatccaagcatattttattttaacccactggaagagagaatgtcagcagccaggtaccaatggaagacagaaacctagaggaagagtgcagatgggctaccatacctcatcagccttatccaaatcagacttcttgataactagaaaagggcgggacgggtccatgttatctacggttgctccatcttctttacctttaccaacactttctcctatgaaagcatctggcagaaaatgatcgggaattttcaccactatatgtttgtctgtaacaaggaggattaatctctagttacattcaaaagaatatcataactttgtactgctagtaatataatataatatacaattggtaaacaatgatccttaagactgtgaagacaaaataaatgatatttaggacatggacacgatctacaaagtggcacttaggctagcaatatctatggaaacatgatatttcaagtaaagatgattaaatattatgagtattttccgtgatgaatatactgtcaatatgtgcagtactttatatactgatggtcaaagttaaaatagtttgactggtaggaaccataccctgcaacaacatatattttgaatcaaacggcacatgcatcactgaaattgatgaattcattgaatttccacccccacagctggatataataatattgtgtgtaatagtatagaaacctatacttcattcttaaagaaggcagtggtggtggcagtgaatctgccaccacaccaactctgttgtatagattatttcttttaccaactactccttcgtgttttaatattacaaaatagtccttctacataatctacaagcacgaaactgtccccaaaacctcgcaattaatttgttccaagcaatattagcacgcgtttaatttattttaatccatcgcaaatcacagatatttatctagtatatgtgaaatgaacggtaaaaagaagtttttcacatactagttgaacgagtgatgtgtaaaacttatggaaatcgaacaaatcaaaaaataagattgatgtttctgttcaacaaaacaatacctcctgctgtactagatacgccgaaaagaaatcaaatcggtaattaggctctgaatgtttcagaagagatcagaattatagatttgacatttcgacatgaggaacagctccagatctgagggcgattcgcaaataattttggagatggaagagatatacaccgtagaagactccgagttgaagaagaagaagaagaatgggaaagaagtactgaaataacaaaaattggttgatgtaactattaccgagggccgattccgacatgacctccttgctatgataaagattggggctttcctggatgagtagaaccagatctccagatgagatgaagggctggcttataaaatagtggtgggatgtaggaaagggggcggtggagagttcgccggaggcgatggcggtggaatgagcacctagggtttctttatgggaagatatttgtgatggggaactggggatggtggacaaggaagaaaaggatatgatcaagggctcgaggcccggcctgagtgcctgacatgttgcgggctgtaattaagcgcctggccaggccgagaaggcccaaatgaacttctttcttttctttttcatttttttaaaaagtccactttaggctatgaactatgtagttttatttgagtcccttaaccataaaatctgatataaaactcccttaattattaaaactagttggatgacccgcacaactacacggctatcatcaatttaaaattatctatttttacacataattttatttaaaattattattcatgctattctaataattttatagtttttaaaagcaacgccagtcgctaccctttactcctttgtcacatttttatttgcttacttgatctatcactacttctattcatcctcttgagaactttaaaagttaggccttatagtttttagagtaccttatcttattgggtttcgtttacataatttttagaagtatcgtcaaacatcgccaatttactactctacggccatctgttgccacctcaatttattgtcatcgggattttaaaaatcaaatataattattatttgtgttcctttttactttctataagtctcgccaatcgttagtggcttcaccaatatactcctctacagcaaacccgctgcttccccttcttattgccattgacattttaaacataaaatatgattatcattgtggtttttttaattatccataagtcccgccaaccgtcgtgaccatgctgcttaacggcatacctatcgtcactcctcttaatcatcattgtgattctatttggggttttgtttatagtttttgttgatatcccatcaaccaccaacactctactcctttacatgcctattgcttctcccctttttaatgctatttgtcatcgttgttttctagatggactttttttaaaaaaaaattgcatatttttcattccgataatttttattcataaattatattcaaacttcaattcttataatttttttcctatttttgaaaattattttatttgttatttcgaactttagttaatctcatcatgtgttctagattgcctcttaattcaattgtctttatttttttcttacaaatttaagttatttataaattttattcaagttgagctcttatttttttctttttctatcttttgaatttattttattttttattttgaattttaattaatctcgtattgtgttctatatagactattctcttaatatttttttcttttttatttctaatttcaatggtttagttaagataaaatacactgtgggatttcgcttggatatatatatttttttagaaaatcatgagctgtagttaggagtccgatcgtctcaagttagcatgcgagttttttaaacatatttcttgcatgattctttcggtattaccaaaagcgaacgatcttaaaaaccgactcaaatacggatatgtatttccaaaagcaaacaaacttaaaaaccgactcatacacggatgacttaccaaaataccgataaaaacatggtcgttaacaaatttttataatagtagagaagagatatagatagattaatacaaaaaaaaaaccgactcaaacacggatgacgaaccgtggaaacatcttcaattttttataaccgactcaaacacagatgaccgactgtggaaacatcttcaatttttataatagtagatatttggattgtttcaatattctattcctacttgaaatctctttttattttttttctaattctggattttatttgttttttattttgaattttaattaatatcgtactggtttcttgtatggactcttctttcaatattgcttattttaaatttcaaactttagttatttttaaattgtatttctatacgaaatattcttttattttaattctaatttaggattttattttatttttattctgaattttaattaatctcgtattgggttcttatatggactcttctttcaatattccttatttttaattctgaatttcagttatttttaaattgtatttctacttgggctctttttttttctagtttctaattttattttatttttatttaaaattttattaatctcgtattgtgttcttatatggactcttctttcaatattgcttatttttaatttcgaatttcagctattttaaattgtatttctacttggactcttttttctttttctccgattaatgtgggaatttcttgcccccacagcgatacaattgtattcctaattgaaatcttatttttctttttctaattttggaattttttttttcaaattttaattaatatcgtattgtgttcttttaatatttttattttttattttcaatttcagttgtttcaaatttgtattcctacttgaactctcttttattttttctatttttggatattattttattttttattctgaattttaattattctcgtattgagttcttatgtggattcttctttcaatattgcttatttttaatttcgaattttagctaattttaaattgtattcctacttgaactcttttttttttgctaatttcggattttatttttatttttattcttaattttaatttatctcgtattgagttcttatatggactcttcttttaatattccatatttttaattcctaatttcatctattttaaaattttattcctacttggagtatcttttcttttctaattttggattttattttattttatttttttcaaattttgattaatctcgtattgggttcttatatgtaaacttctttctatattgcttatttttaattccgaatttcagctatttttaaattgtatttctacttggactctgcttttttttttctaattttggattttattttatttttattttgaattttgattaatctcgtactgggttcttatatgaaaacttatttcaatattacttatttttaattccgaattccagctatttttagattgtatttctacttggactctccttttatttttttttctttttctccgattaatgtgggaatttctagcccccacagcgaacgtggtgcctcctttcaaaactgttttaataatataatcgatagatagatatatagatatactagtgcaaatcgagtctcccagcggtttagttaggtggttttgtcccacgtgacaatggtaaatcgtaccatgaaaattgaaagaatttcgttgaatctacctcccatcctttctccttttcttcttcctcattcctctgtctccccatctctctccaccgtgcacatgtgggtcagcgggcaatggagacaccgatctggtcggagagcaccctcagccatcgccgtcgcaagtggcaagaagagacggcgtcaccattttcctcgcttctcgttgtcatgttgattacgctatccttcacttagatccagaatacgccgatggctgaggactctggagcactgtctgtaattacattggtgatgttcttttcttctgaaaataaagatgaagatgaagaatacgttttttacataaaacaaggtggtattaacgtatgattgattgagttttaattattacaaacttgaaaaatagattaatatgatattttagagcaactttcatatataaatttttcgcatgaaacgtaccgttagcaatttgaaaagcgtgccacgaaaatcttaatcttcatccaacttttattggagaaaagaacaggaccattgcccccattcttgtgaacctcatcatgctccagaacttcttctccggcgcgctaccaaccgatagtgacgggtgattggctggtttggtggtcgtcggagatgtctcccttgattgttcgttcttggatgggtggtagtagtcgggttaagcaaaaaaaaaaaattcaaagattgaattaaggtagttgttatcacaacttctttttgcttggatggatgctattgtcggtgtctccatttgttgcttggatggtgttgatggtccttaagtaccaaattcgatttatcaattcatgcataataacaattgaaagaatataaaatagaataccaaacttagaggtagtagtcttggtgaatatttatatataggtaaatatatggacaaaaatcatccgccatgtgaccaaatacacctccggacaatcggacacgattacacggtttggaggccccacgtgtcaatcaaaaccacctaaaattgagtccagccaaagtacaacatgttgggggcccaccaggcagcctcccaaccgaatgagtggccggtaggtgagccagaagttcggtcgaactgcctttgcatcccctcgccatctgccaacacgtggagcaagatactggagtcctaattgcggttatgtgtggtttctgagcttaaccaacccacaaaccatcattacaactaggggtggcaacggggagggtcggggctgggttggacgggaacgtgtcacaccctgatccggcaccgccgtacaacggcacctgacaggagcgtgtcgtaggaaaaacggcgcgaaccgcttcctacgaaaccgcgatcacagtaccagtcccaggacatagcgctggtacccacggtgacaaatatgaatcattgcaatccttaaaataaatagaggatttatttaccttgacttaggttgcagctcgggacaacccgagaatacaaccgacgacacggacgaggcaaacaccaacaacagcagcagcagtggaaccaacggtctaacacccaacaccacaggcaatactagggaactaggacgaaaccttaatcttcacttcacttcaacttcaccttcagagctggcagaactatatatatatagagcaagggtgagtacttatgtactcagcaagccagggggacttaggtggttaattcaagcttcaaggaaaggctgttattttagcaatcaaatttgttttcaagttttcaacaatctaagtgtgtgctttccacaaacagagcgagacaagtctcagcttggttgggggcgagacgtaaccaaatttgatttgcaagatttacacaactcccagagttggcctcaaagttggtttcccaaaccaaaccaattttccaatctttcagagttttggttgtctccaaacaaccagtcattctcagggactccctgtcccgctgtctccctgacatccgcttgctttatccaaacatcaggtttcccaaacctcaacatcttttcacaaagctgggtaaaacaaaaactacgctaaggaatcacctcacatccgcccatgaccgtgggcatggctgttcgaacagtttgttaacctctgcagagggggtacactttacctacatgacgttactagccttggtcacctagcccgtgcggatcaaacacgtctggtgacttggggctttcacgacaaggcatttccaaagccaacacagggttgccatatgccaacgagaggggtcccggaccaacaacaggttaggtcccagaccatactgtgccatgaagcccaggggtcctccccgacaccaccccggcgaatccacttgtctcttggcatcaaggcttccctggcctagcttgttactcagccaggggtgtcccattccacccatgtggtcgcacttgttatatgctcggatgtaattccaaaggaatcggtccttaaatgtgaccgcacaagcattccgcccaggaatggccttgtgtcgcgagttttatttttaaaactcattttctttcacaaggcaccgacccaggcgtcgggttttccaatcctttcgtaaaccaagttttacccaagatgtttctcagattttaagttttaaaggcgaccgtcgatactcgcacagagtgtatgaataccgaggcgcaaccaggtggttacaagggagcatgatatagcaattaacaatggaaggatcaaatgcaacaagttaggtaggcccaccaatctgcctcgcaggcggggcaaacatattaagtgcaatcctatcaatgaataatattttacaatcaatataattaagttcaaatataggctcaagatgttcaaaggtggcttgccttgctcagggtcttcacgaatcttcgagaaatccgcttgacgaaaaatatccggtaaccgcaactaggcgcatacaatcaaaaatctaaacaaggaccaaatagaaaaggatcctatttagactaaaataatagtgccattagatagatcacaattttacggaattactggaagtggaacgaggtcaatcggagtcacggatcgggagatatgaatttttggaggctttaaatgaatgtctggacaaggaaatgatttatttgattctttggagcggggaaaacaatttgtggaaattttgtggacaagggaggatatgtacttatccgatgggaataagagaaattatttacgaaggttgtttgaattttctgggaggaaggaaaatatttgtggaacaacggaaaaaggatttattgaattttctggattaaagaaatgatttattgaatttgtggaaaagaatattctttttagtcactcattgacgtgtggggccaacatatggtgagagaggagtgaatagggagggagcaattatggacttttggccactgtgtttggggaagggagtaaagatagactttccttgttttttaggccgaggaggaaggttggccaatgggccaagcccacgagcagggagagagaggagggggcggctgactgggcaccatggactgggtcaaacgccacatgggcagccacggtggcaaggcgagaggggaggaggaggcgcctggatcggacggctcacagcggcgcaacgccgccggcgagcggcggcaagccggaggggccggcaggcaccggaagcgagaggggctcaaggcggttccatccaccggctcggatgagggagaggcggcgcgatggcggccatgcggcggcgggatgggcggcacggcgcggacgcggccggcgaggcggccagccgtggcggcgtcccggggagattctctagggctcaagggggcgcgacgatacgaggggttcggtatgaggagaccgatggcggcgcatggccgagcgcggcgcaggcgtggcgagcggccgcggtgagaagaggaggaaagaaggggagcaagctggaggagaaagaggcagggacgaccaaccggcggtgacgcgcgactacgcgcggcggcgggagcagagcaggagggaaagggtgacgcggcgaccggggggaggaagaagaagccgacggcggttcttggcgcccgcggtggcaaaacagaagaggtgcgaggaactcaccgacgaacggaggcatgggcgcgaacgcacgccgaggaggcgtggcgctgagatggcgcggccggggaaggattcaacggcggcagcgagtgcggcattgggtaagggatgagaggagcgcggccatggcgaaaatggaagggaggagcgaggtgctcaccggcggcatggcatcgagtaggcacgacaaagagaggataagaaaggtgaacgaccggggcatgcggtggcgtccttggtcacggcggtggcgttcttggccgccgcgactaaggaggcggcggtgctccggggttggccgtgcgacggcgaccggagttgagggaggaagcggcatggcttcaccgtttgaggcacggagcaaggggagggaaaaagggggtcccggagtggaatttataggcggggagggcgggagcttgcgagcggcatagtcggtttagagggggagcatgcgagctggcgcttggctgccaaccacgggcgacatgaaaacgacgaacgacggggatgcgctcggtggtggaggcggtggatcgagcggtggaagtcgaatcactagggcaggagcagctgcacggcgtggtgaaagtggggacgtggctgagggctctgcctccatcctttggacgcatgcgcacaggagtaggggcggaaggatgacgccggcggtgatagcgtggatggtgcggcgtggagcggcgacaaggtggcagcacgcgatgcaggtgttggtattttttaacgatattactagaaatataatttctaacaatgacgcagaaatattcatggtatattatggttacagagtttatccgtaagctcacgcatataccattgtagtatttcacccaagggtatcgtatttattttatcccatgagaatatcatgtagagagaacttgactaataatttatatattacttgtgataatcatatcctgagcaggggttaagataatccaagggtagagtgacacacaagcaatagctactcattctcataatatattatctaagctaagtggaaagaaatgagaaagaaaatatattcctatacttctagtatacatacattctagttatctgatatactagctaatactctctatccgatgccctcctggtacttcgagaagccacccctaactgtcgagttccttatgacagcccgtcatgaccatacaatcggggctaaatacggaggaatatcctccccagggaattaacttaggatcatatacacgcgcggaggaatacccgtactgagctgtcaccatcagcggcccacctctcatccgcagcatataaccccaaataatgatatcacgtaatctagacaccacgtctaaacttccagatactactctaatatcatcatcatgacatagagtaaatgcataagtaaacattatacccgcaccaaagcatctcccagataagctagcagcatattcagtataacatgaacataatgtaaaattggcattcatactctcggaaagtattccaataccataaatgtataaagaagaatatttaataatactacaaagcttacaaaagaagataggaaagctactaaagccatacccgaactctttcgaagacttccggactcctaatttctactctattcctattccactagcttgatactactaaactaaacttgagagaatatgagagaactttacttgaggtgtgtgagtgaagtgggaatggcaactccttttatagccttccaatgacgttgtgaatgttggaatggtcggaaataccctctaaccgtcattgggggctaatccacaccttccaggcgaagccctggatcggatggcactgaggagggttcagccgaacctggggcctgcccaatctagcccaatttcggctggcggcctcctccgttgttcttctccacagacttgtgaattttggcccagtttgtcgtgtcaattccgagtcttggtccattcatatataagtctggttctcgacatcatccgattgatttatcgtctgtgttgatgtcgattctcctccactttatgattattctccgcacaaggttagtgaacctaatactagtggaatattattattctaacatactctcttcttttttaatagatgacgccgttgactttttctcacatgtttgaccattcatcttattcaaaaaatttacgtaattataatttattttgttatgaggtgttttatcactcatagtactttaagtgtgatttatatcttatata

SEQ ID NO: 59280 - DNA, 2989 bp, Oryza sativa
  unsure (1)..(2989): unsure at all n locations
aaggagtgaaaaatgggggtaggtggacccctaaaccaagaacagccaagaatttcttctgtgagtttgtaagcttccatcgagtttagatactttgggactgctctaaaaaaaacgctccgccacagaagcctcgaaatgcaaatttaaaaggtgaagaagaagaagcttctccagacgtaaagttaaaggggacgtgagtcccgggcaaagtgaaactcattctcatagaatacacgaagagacctttctcttacatatattagagaaggtcacagcagttgtacacatatatacacttgataatgccctcgtgcatatccctatccaaataccgttggctcatcccgtcggattaattgttaaaagttttgaacagactttggcgcgccaaacaagtaaggtaaggacgccattctttggttggaccccggcaaccatgtaagancaggaccnggaaagngggannnnnnnnnncatcaacgccacataggatcctgaaggggttgtgacgatttgggacctagatgacacattatgacaagttctgggacttacatatgcattttaagagtttagggaactagatgacacacatctacaagtttaaggaccgcctgtacacttcactctagttttaaagaccgtaccaattttgatcgtactttatattatggaatagagggagtaattaattatgcgcttatcagttgggaaatggttccaacccttccaaactaacaaagccaagctcaaaaatttcttgattgggatttataatattttttaccatttgaattaaccggtagaggcgtgtcattctgacgcggacggccacttcagtttgatcttcttttcggaaatgtgaaagagagctggctagctagataggaagaacgaaacttgaaagctcaagctataaatatgtgtatatccaagctatagctaccaccatacacaccactgaccagtcgctacacatcaaagcaccagcaatggagacggtggaggcagccatggcggaggaggaggaggcgaagaagagcaagatgaggaagaagggtgggttcagaacgatgcccttcatcttcggtgagtaggaaatctcgatctgtttgaaacgctgtgagtttttgtttcaaattcgcatgagatttggcgtgtttttgcacgcacgcacgcacgcagcgaacgaggtggcggagaagctggccgtgctggggttcacgacgaacatgctcatgtacctgacgaggcagctgcacatgccgctcgccaaggccgccaccaccctcaccaacttcggcggcgtctccgccatgaccccgctcatcggcgccttcctcgccgactccctcgtcggccgcttctggaccatcgccgccgcctccctcatctaccaagtcgtacgtatacacatccacgcacgcacgcacgcaccacgcacgccgccgcggcgcgctgagctgaccggagcgttcgtgttcgcgtggcagggcatgctcctcctgacggtgtcggcggcgatgccggtgttccggccgccgccgtgcagcggcgccggcggcgcgggcgcgtgcgacgaggcggcgccgtggcagctggcggtgctgtacgcggcgctgctgctgaacgcgctgggcgccggcgggtacaggccgtgcgtggtggcgttcggcgccgaccagttcgacgagtcgaaggcggcggagcgggcgcgcacctggggcttcttcaactggtactacttctgcaacggcgcgtcgcagctggtcgccgtcacggcggtggtgtacgtgcaggacaacgtcggctggggctggggcctcggtgtgcccaccttctgcatggccgtctccgtcgtcgccttcgtcgccggctacccgctctaccggaggctccacccgtcggggagccccttcacgcggctcgcgcaggtggtcgtcgccgccgtcagaaagcggcgggtgccgacggacgccgacgacgccgcggcgctgtacgagaacgacgacatggacgcgcccatctcgctctacggcaagctcgtccacaccgaacaactcaggtaccagctgactgcgaccggttctgatcgagtgtggtttcgattaatttcagctgaattcggaccgaatttggttgttttcggtcttgccgtccccggcaccatcgaaattttgagtgtgtatatatatatatatatatatatatatatatatatatttcaatttttgaaaattggatgatttcctttttttgtggtgaaaattcaatctttgctccatttatagcatttttatcttctttttttgagaaaaaggaactctttacaatgcaaaaggtgaacaactatagtttcgacatgtgatcggttattacctggttaactggttttctcttacctatcaattattttgcactactatatcgaagcatccaaagactcacatatttacctttcttttactttcaaaaaaaggtgaaacaattaaataatgaaataaattaatataaaaaatgttatacttttatgaatttccaccaatatgaaaaaaaaactaatatatagatgaagcatgagaacacattagcataaaccaataaaaatataaaacagagcagattaattgatttagtaaagttacattaaagttgcgattttgtatagtaggaagcctacgtggtagacaaaacaaattttcaggcaactaatgcatagaaaaatattaagttttaatttacatttctcttcttgcaaaatatttaaacacgtttagtccataaggaaattaaaatcattgacaagtaacaccacctagcaactcttatttagagaactactactaactaccacattccaaaaccagaagagacatgatgagtctcttctggcatgggtcactgattcgtggacccgctgattatggggctatatagcaatcactcaaaaataatagaggaagtggtgtttctgaactctgaagaa

SEQ ID NO: 59281 - DNA, 761 bp, Oryza sativa
aaaatctctccatatcacctggaatgtgtcaactccaagatcaaatgtggttccacagaaactataataaggaaagaaatctttgatttatttcattacaagacattttgatgattaaaatattgtaccgttataagatgcaaagagctcaagggacatatttggaaagtcccatgacaaaatatttcagaaacatgctatttaccaaaagtagaatagcgaggcaaatcacatattaaaacttaaaagttaatgaaatactaaaaaaaaaatctgcggagggtgcataagggtcaatggaacagtcaaggtacataccgtcacaacaacagatttgtcctcattgtacaacggctggtctccggatgtgggatcaacaatagccaaccgctggtgtgcaagatagcaatcctgatagcagtgtataccactccaatcagggcctctatgacgtaacctatgaaaattggaaaacttgggttagtcagtgcataagcagttcaaaaaattctatcagaagatttattaaatctatgaaaactatgaattacataccgtcacaacaacctatgaaaaatgcagcatgccttgagtctacaacaagttggtactaattctatcagaagatttattaaatctacgttgaaaattatttgctctaatataaggacatacacaagaaactgtaaccattcagttcctaaagatcaagtggttgcagagtgcagactacagtgataaaaacatgccacattatacta

SEQ ID NO: 59282 - DNA, 2286 bp, Oryza sativa
ttagaaattcccatattaatcgaagaaaaagaaaaagatattaatcgttagattgtagaagatctctattttgatggtggagattaatacataatataatcttatttatagaaagtagaaaaaagatttatagatacagtccgtatgtagagtcatatcaagaaaagtaattaatcagatcgagtacattacatacagaagtttgaagagaaatcgtaaacggagaagataaaacaaattagaagtccccttccctcccgctttatgtatttgtagcattggtcgagaaagctaccgatagtgctaagtcatcccttcaccgttgacgttgtggtgcctggcactggcagcatggacaattggacgacaattctcaaggcataacagcacatgatgtggctggcgctcgaaaattacaaagctaaagtgctagcagcaatccaattgaaaatagcaccgttcgttgttcctcctaacattctgggtagggtatatatctacggtttggtgtattattttttaaaaaaaaatccactctttgcgtatacgtttggaaaagaaataatattagctcaccaaaatcatttgagtaattttgtatgagcgcaatcgcgcgggtttaatccaagaaaaagaaaagaagagccaaatcaaaatacgatttaaaaataactgaaattcaaaataaaaaataagagtccatgtaataacccaacacgagattaattaaaattcagaataaaaataaaataaaatccgaaattaagaaaaatagaataagagttcaagtagaaatacaatttaaaaataactaaaatttgaaattaaagtaagcaatattgaaagaagagtttatataaaaacccaatacaagattaactaatttataataaaaataaataaaataaaatccaaaattagaaaaataaaaaagagagttcacgtaggaatacaattttgaaacaactgaaatttgaaataaaaaaataatgaatattaaaaataatagtccatatagaatattaattaaaatttgaaacaaaaaataaactaaatcctgaaattagaaaaagaaaaataatatttcaattaggaatacattttataaataaataaaatttcatcataaaaaataaaggctattgaaaaatagaatcccaatgatgattaagaggagaaatgacgagcccgttaaacaacatagttatggcggttggcgggacttaaagaaagtaaaaaaaaaaagccaatgataaacatgttcggttttaaaaaatctcaatgataataaggatgggaggcagcggtagagccgtagaggactgtagtgacgaagctgctgacggtttggtgggactcttagaaagtaaaaaagaacacacacaataattatgttcggtttttaaaatcccaataacaataaagagatgaggcagcgaacgggtggtaaatgagtacattgacgacgtttgaccggacaatgaactctaaaatctacaaggtctaatttttaaagttgtaaagagaatgaatagaagtagtggtagatcgagtaagcaaataaaggggtgacaaaggagtgaggtgtagcgattgacatgacttttaaaaactataaaattagaaacataataatgatatttttaaataaaatcatatgtaaaaaatagataattttatagggtgctagccgtgcaattgcgcgggcacccaactaattcacattaattaagggtattgtgctattttgttttttccttgaaaactccttgggaagctagggtttgagttatttagggagagtattagtaacttaggcctagcttagttaccaattactccctccgtcctataaaaaaaatctaattctaataatgggcctaaacacacttttaaaaaacataacgtataatctttgaacacattcatatccttaagatgatactcatacgtacatgcgctctcagattctttcgtggaccaccgcggcacgggtctctggccattttgacgcaaagccctagttttgtgccttggggtgcaatctacgagggtgaggacagtgacgatcccgtccatctatccgtccagttactctactgtacctgtaggagtacagtacgtacttgtgcctagaggcacatactcctatactactttctgccatgcatagcctagctggctttctctctgtctctctaccacactcatcatctgcaggatcaggctggccctggccattgagcagcaggcagcagcatagcagcagcgcctggatcgtttatt

SEQ ID NO: 59283 - DNA, 19528 bp, Oryza sativa
  unsure (1)..(19528): unsure at all n locations
agagaagaaagaaatccaaagcaaagaaaagcaaacgaaccaacggatcgaaaagatcgaaaccctaaccctaatcttacctcgtcgccggccacggagggggagaggggcaaagaggcaccgccgaggagccactcgacagccgcgcgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagagcgtctgccatggcgcgacggcgcgaaggctgccggcgtcggcgacgccgctcggcacggggcacgcccgcaagagaaaggagagggcgccgcggcacaaccgctcgacggcggcgcactcacccttgagtgagtgcgcgcatcggcgaaggggagtgcgacggcgccgccgtgtcgccatgccgccgccggcgctgtgctagggttccggcgacggcgtcgccgctccgtgcacccgcaagagagaagagaaggagaagctagggtttcggcggccggtcggggcgagagggggttttgatccccgttttcggcgcccgaccgtccgatcataaaccctaagatcggacggccggtggcggccgggccaaaaatggcccaagaagggagcgcgcggcggcggttttcccggcccaggcccaagttgcggcctgggaaaggggaggggccgctcgcccgcgcgcaaggcggccgtgggccgaccggcaaaggccgaaaaaaaaaattcaatttaggtccctcggggccgaaagaaaaagaaaagaagtttaataaaagtccctcggccgaaggaagcattttcaatatgtttaatgattgtgtttatttctaagcaatttgaaccaacgtgaaaattgtttagataacagataaatgtgagaaatgcttctgaacatgtattttgtatattttcatgcaaattacaatagaattttgaattgttcttacatgttttacctctgtttaaatttgaaccaacgggagaatttttacagagagtaaacaacagagttttgttattgtttatatgaattgtatatagatcttccgctgcaaacagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcagatggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccggtttactggttcttcaaagttttatgcgacacagctgataaagcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaagcaacagtttacagttgagacaagatcagtgtctacattgcaagaagacaagacattccaagaaagatcatcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactacgcaaagaagtgaaagatccattagagttgccaatagagttgaagcaaaagttgaggctgttggagatcttcgcctagaactcgcgaatggcttcacacttttacttccagacgtttttatgtcccttctttgcaaagaaacttgataataagtgtatccaaattggattttgatagatatgattgccattttggaaatggcaaatgtgaactatggtataataatgaatgtattggtcttatgttgcaagatcagctttatttgttatctctttctgagaatgtgaatgttgtgtcctcgttgacaaaagaaaagaaagcgaactcctgatgtctcatcgaaattatggcactgttgtttaggccatatttcgagggggagaattgagagactgttaagaatgtagttcttcctccattggagttctcagttttagaacgatgcatacaatgtatagaatgcatcggtgcccaaaacaccgtatgagctatggatcctccgtgtgtgggggagtcctgcaaaggataaagtatttaacccaaaacagtaagctgccattttattggctattctgaaagatcaaagggtcatcgtttctactgtccaaacagttatacaaagtttgtagaaacgagacacgccgtcttcttggaagacgaaatgattagggggagctcggtaattcgagaaattgatcttgaggagaggcgggtgtctgtacccgctccgtcgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagctgcaacagcctcaaacagataatgtgccagaataggaggcccctagaaggcctgaaagagtcgcatatggaggatgatcccatctcatacgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgactcgtggcaaaaggcttcacgcaatgagaagggattgattacaatgagactttttctccagtctcttgtaaagtttccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgccgtataaagagatccatttatgggttaaagcaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaatagagaaattcttgtcctcaaannnnnnnnnnnnnnnnnnnnnnnnggcttcatatgtttttgggcatagagattcaccgaaatagaacaaagtgtgcattgggattttctcaaaaggcatatatatagaaaaggtgttgaagaaattcaacatgtacagatgcagtgctacacctgctcctataatgaaaggcgaaaagtatggggcatcgcaatgtcccagaaattcagtatgagctcaataaaatgaaaacaaagccatatgcgtcagctgtaggaagcctacagtacgcgcaagtgtgcacacgacctgacttggcatttgttaccgggttatttggcagatttcaaaagtaatccaggcctagagcactggaaattggtatagaaagtcttgcgtgattgcaaggaacaaaaggcctcatgatgtcttacagaaaagcagaatcgctccagatagtggggtattcggattctgactttgcaaaagataatataaagttaacatcgggatacatgtttaccctggcagtaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccaggatcaaacaatcagtctcgagcacataagaacagaaaggatgctcgcggatccgctcatgaaaggcctacctcccaacatgttcaaggaacatgtagcatgcatgggttgtaagggaagccttatgaatcctggactatagggcccaaaagttaaaatatctgtttctgaatagagatgtgtatagtggctgtcgaatccatcggtaatcaaccgtgacgatgaaacatgctctatatgtaaatctgtgatggaatagaaaaagctaaaggaaatagtgagatcaagggggagaatgttagatggatctccctccccttgagcccaacggctcaagggggccttgacccgcgccctgatcgggggcgcccagcccaatggctggtgggcccccgtcacactgtgccatataaagaggggtggaggacgggacggcaagagacacaaggaacgaggttcgtcgccgccgccgccactccaccccataaaccctaaccgatcgagggggcgcagccagtgacgagaagactccaccgccgcgccaccacctcgccgggatcccctacgaccaccactgccgcgcagcaccgtcgccgtcacgaccaccatcgccgccgccgccaacgtcaagcagagcacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaactctaacagtaccattttaaactagcgcgtttctgtagacataagcattcccattcaaatggtcataatagatggctccaacgaccatcagccactgtcatcaagggtcaagatcgacaagagtgggacaaaacaaccaaaatgtagcaagcaaaattttggcagaccaatggtggggctgcaaagtttgtggaaagttctctggaaacattttagccttttgacaagctggtccgggtcaccatgttgttctccccacgatgatcacactcaattatcctttggttttgttcagaccatgttgcaaaaatttggaacgatattgctccaccagcgatttatccacgcttccttccccagccagctctttcttggtctttctttgagcccttcctctcttttgctccgaatgactatcatttctgtttttcctctttgccagggcatctgccggattatgtttactcgacagagttcgctgcaaaacggagactatgttaaactacttcgcttcatcgagatcgataattttgtggtgccgaaaaacaaaaggtccaatattacttacattcctatcagcggttggtgttgcatcttgtctatctccatccaacgcggtggttcccttgtttgactttcgtgctctttttgcaggcctttgatcctttcttttatcttcaaccatactttccacagtgccaccatctccagctgccgaaagatcctctgcaggcccttcaccagcgtagggtaacttagatgatctatcgtgtgattttctcttgttccctttgttgaaagcccttctgttatttgcatcagggccatcagttgcagactgatctcccagaggcctcgccttatcttgcgcagcttctcgcaacttatcacggcggtccttccaaattttctggagtctcactttctcaacgttctcaagtgcaaactccacaattggacgacgttctgcaccaaaagtttctgcaaatgacaaaaaacaacaatgtaactggagataaacagacaacactaaaaaaaaatgcagcagcaaacaagcaaatgctagttactactagaaaggaagggaagacattaagggtatagtatgtctctgatgatctgcatactgaggaaaagtgaaaactgcagctagagctaacagcagctcaaagacacagaaagctcatgattggacaagaaacagcacagataggtagcgcgaagccatgaacaagtgatacagtgattccatgcaatccaaggatgcagcattatgcaataggcaagattaacacatcacattcttctcagagaaagacatattgcacattagaaagtaagtgagacgatgaggcagttagacagcatggctgcaacaaaacaatacttagaagcatttggtatagaaaagagtaccagggttattgtttaggactcttagagccacaagagcatgctcatgttcttgaaaatctacgaaggctacaccacgggaatgtttctgtgcagtactgctgctcttcttttcatttttcagaatatttacctgttcaagacaaatgcacatgcataagcattataaagatacctagaaatagaataaaacagaggttgaataaagaaaacccaacaaacctttcggatgacgggattttgcttgtgagcacgagaaataactgcttctctacaaagcttctttacatcattaatggtcatagtctttggcaggttgtagatgataagccttgttttggacacatgaaattttggagactggagcatttccgcttttcttctagctaacctacatgacaaaatcaaagatttcgtgagcattgttcacatgatcctttggccatgagcccatgattgagagcataataaaactccatcttaagaaagattactggacattcaataaaaaaactaaatacatattatagaagaaacaattgaaaaatacttgacaaaataaaattaatggaaaaagactatgattcaatagtttcatctgccgtacagagacacctttttattatagaaaaggttgagacaccacatgctgccaatgaattataaaaattgcatctatcatagctgtttattcccagagaaatattaacacacatgtacagtggacatttaccaatataatagaaccaacactttgcctatatttcttgtcaaaagacattggctatattggtactagctgtagggtgatctaatggtgcacagaaagaaggaaaagatcaactcttaccaactacgtttattcatgtcagcatcggatacgccttctgcagctggcgtcccagcaagtatttcaccttcctgccgcaacaatgaatttgagataggaaaattgatttaagagatgatgagagagtgagagaggggggaagggaggggggaggggggaggctctagtaaaaaggttaccttagtcaagtataggttacgtcgatcctccacctcattctttgccttctcaagttcctttttgtgagctgactccttgtccagtgctttcattatcttaagagccctgctctttataaaaattcccaatccaggagcagcattggcagcagaaactgctgcatcagctgcctctggtgtagagaacttcagaaaaccagttcctctaggtctcctgtatagatagcacaaaaacatgcattaatgagtgtacatgcaaacgacctctggttgatacaacagcaggaaataaaggaaatatgatgttctaacagatggtgaaacatactttgtgagtttgtgaagaactgggaagaaagattcaaccttcccaaatgctgagaagcgctctgttacctcctcattacttagatcaaaaggaaggttgcttatgaataatgtcctatccagcccagcgtcttgtttcttgaattttgtggcaggaagggtgttttcctcctgtgccacacgtttagaattttctaacttgtcagctgcaggtacagatgtaggtaaatgggtctgcttctgtttcttttctgatgtatcttgttctgtttctgtgtctgtatcaatatcagaaccctcattgccagatggttcagccctctcagatgacttgatcaaattttcaagaacctttcttgaaatatccatttcagttttgaaatcatcagcaggacaattggaagtctcctgctcaagttcatagctatcatcttctccaacaagattatcttcagactcctcgtcactgcctctgtctgatacatttgccagctctgtaggtacagcaagttcatgatatttcagcttccaaagtagtagttcagaaagcacaaagaattgacaggatttaagagggcacacggtgtattaaaacaaatatttagtttttaaacaagaagccagctggtcattttgaacaacatgaaccaccgtttatctgttgcctgagaaaccataccaacgaaatgacatggtacctttgccaaaagccaaatgtccatgttaaaatagctgttaagaatatcgttgaagtacataaagatattgcaggtcacaggatgaacgaaggcaataattaaaataattgatacaaaagtctatatatttaccatcatccttagtgctggattttgcagcaacagtgtatactttctttggaacagcccaatcaacagctacagttctctttgcaactacttttccattaacattttttatagcctgttaaagagaaaaaaatataaaatattaggacttccaaagattttttttttttttgctcttactgaatagggcactgacattttctgcatcttgtttacgtgtgaaagacacaaaagcaaagccttttgatgccctgtagaagaatgaatgcaacagagttatcatatcttgcaatttgcttaaaccgctgaagaaataaaggattcaacgcgaaacatacccgtcatcagacttctgtggaatggacacatcccatataaatcctgctaaactgaatatatccatgatctcctttactgtaatctgcaacaatgaaacaaaaacatatagcctctgttttatctcttctaggaaacaaagcttggaacaagtgaacttttgcattcaatcaagcaccttaaatggtagattccggactatcactctccatttcctgatctttgagccctgtatagcaagcaagttagaaacaactgcaggtaactggggaaatagctgaagagaaacatatgatagtggttccagagtacagataaacaccatgcaactcttgtgaagaagggggacacacaacaactgaaaattaggattttaagtaatctcattctatctcctacccacctattctcacagctgcaattgtagccatgcaagatagtagtagtagattataagtggagacaaagcggtagcatatctattgtgtcattcacggaataatattaggatctttctaactgaaagtgagaaaagcttgattaactcactgactaatcaatctctagaggcttgtacatcttttacagatacaaaaatggagttagcggtggtgatggtagtatcttatgatgaataatatagtagtgccttttgtgaacgattgcatgtcaccatctgatctaatgtgaactatgtatgcaatatttaaaatttggggatactaacttttttctagtttagaacttataatatttagtttagatccattgcaatgaacaggcactatgttggttctggtaaaatatctagtttacttattgcaggtcttacaggacactgtaactaactatatttgaaactgtagtcaggagatctgtaatatatgtggtattcaggacgttgccaggagacacagcagcagaaagttattgttagtttgagactccagaatttgaagttccaacccatttttaattagcacatacccatccgttttaaattaccgtactaattcatgatagccaccttaggttagaacataaggataattatatgtagctttgaggagaaactaaatgtgtgcacatgcactactacactggtaaacaaaaagtggaagaaaaacggaagtatttgaagtttgtttaattgtagaatagaacaagtctatcaagctaaaataatgaagtaatggcagcacatcaaggtaaatataatgcaagaagatacctctccaccaagctgacgagcccaaacaactgctcccttgacctccttacgatgcaagtgaacaaccgaatcccaagctgatttgacactggcaaaaagtacagctgctgcatctgttgtgcatccatctcgttcaagccctgttgagaatgacagccattccataaattatactgtttcaagaaccacatgctagtggtattaaaggagaataattgtgtgtacagcaggaactgggaaaatgagataaaacttaataagtcataccatggagctccatttcctcttttggaagtggatagctaacagatacaactgtgccaatctctccagctagacgaaatacttcactcgccatagcaaagtctcgaagaccaccgaatatcacagtttttgcaacccttcatcacaagcaattacaaatgtcatgctggatgaaaaataaacaattacagcatatatccatgaaaaaactaagaattttgtgaggttatggaaaccaaactagaatgggatgggggaaaaaatcagcataattacttaaattgtttttaggtaatgttatggcttgatggtatagaatatttgagtccacacctttgcttttctgagcttttcaccttagcagtattggaaatgctgacttcctttgatagtgtagtttcctttttcaacaactgtagtggttctggttcagtaatacaccatgaatcagaaaattaaagcattgataaaatttaggaatggaaacagtgttggaatcgaacaattttcctttcaaacctgtatctgttttatgagatgtctccttgtgttttgcagtagaagtagcatatgcttcatttgttgcattggcatccttggcttcatttgttgcatcagcatccttggcttcatttgttgcatcggcatccttggcttgcacggcttacaagcaaaaacagccaggcaatcaaaatctcaatcaattgaaattcagaaccaaataccagaaatagaaatttaccattctccttcttctgtaaacgttccttcagtggagcacgatgcgttgctagcttaactctaatttttctaccagcaacagagaatccatccttttgctgaatagatcgctcagcatcttgaacagttgcactgtatcaatgtaaatatgtcaaaaatgtataacagattacgcgtcagttttatgccttatgcctatatattttctgcagaaagatattcctacatgaataatcacacgacacatctgtaagagaaacaaaaagatcgagctaaaccaacctcttgtgatttggtttgtgcattagtacagtacataacatatggtgaaagcttcgtgcagtaacatacttgtaataagaactatcggtgtggggctaacttctgtgagggacctgataggctggtattaaccagacaccatcactagagacactgaataaatgtatttccgcttagcattaaacaatttgctcactagagcattacactactcacgatcaaaatcacttctcgaattctggaattgtggcaggaaagggaaacacatttccatcggaaaacaaccagaaaagcaagcaatgaaacttacaattgcacgaacccaaagcctctgctcgtctctgaccctgcattagaaacaaacacaaccaaattactccctgctaaacagccattgaactcactgtcactgaattctcatacctttcggcgcgaccatgaagcatcgcctcaccggcccgacctcgctgaacaccgcctcgagctaaaaaaaaacagcaatacacaccgcgtatcacagcctcgcagaccgaaacagcaaaaaaatgctagccgcatagcttcgcaggggataaggctttgggattggggctcggcttgcgcttacatcggaggacttgaaggtgtacggcaggttggagacgaacacggtggaggggctgtggcctccggcgccgccgccggtggccgcgccgccttccgtggctgctcccccgccaccgccgccgccgccgcgctgcttccgcttacccatcgccggcgtcgtaggggaggaggcgtgtgaacaagctcccgtactcgacgaggcgagaggttttgttgggctaggccgctagggtttatagcttagaatgggccattgtttttgtcggaccggatgtcctagcggtgtatgcttggtttgggcctgtttgcgttaagtgcaaaaaggtccactttacgtccctcaactaatggtcgagtgctcgagtttcatttacatacaactatatactccatataaaaaactacgatggtgatgggagtaaatctgttattctacttgtgcttcttcggtttttataaattgccgcttgatattttctgatactgtagaatattctaatatttgattcaagtaaataccatatatgcaaataagcaaacaattacatgcttgataaaataatattatgctatgatattataatatattttttatctataacaaaacatagacattttctagtcaactataaaattaagtatagattgtcctaacttctaaaactagtgttaatcgagccatcaatattaagagtagtttcaactgacatgatgcttatcaaacttctaggcaccatttaaaaaaaaaatgaaacttcatcaacatttcttaataataccttttcattaaatcttcaactttctaatatcttatccatcatctctactttcgaaataaaaacttggttctgcatatcatttttcagcaactttattttttttccgtaactttataacacaacagccttgagacatgtttaagggagcttttggtagctgaaaatttttccagaacaagaaccccgcgcacacacaccaaacggtctagatttttgttcggattctgataagttgtagttgtaaaattcagaaaataaattagaaaccataaactaaaaaatcgctccgctgtattattagaagtaacaacttctcgtaattttaagttccctgaacagatccagacccttggattatgaaataaccaaggtcactaaacacaccctcatctaacgggcaggcagctcgcccgtgacgcgtgccgcgtgcgtgactgccagcagcagcagcaagcggaggagaggagagacgcgccgccgccgccgccgcctgcgaagcaaagcggcgagcgagaagccaacggcgcatcaaagtgaggatatggagaggggcgccgccgccgcaggagcgctctcatgcaccttccgctccccttccccttccccgacgtccccggccgcgccccattggcggcctctcctcggcttccgctcccgctcccgctcgcgtggccggggctggggccagcgcgcggtggtcgccggggcaccgcggttattcctgccgccaccatgccggcgcttcaggtagcgagctccctgctgtctcttgttcccttttccttgtcctccttgtctcggttgggattgggagtattgctcctgcgctcgcaagctgttcgatgaaacgcctgtgctttttgggggtaagtgatgatgccgtcatcttaggaatgggattaatcgattaggacactttatatagtatggattaggactggcaactttggatcgttgagcctgttcaatctcgtgccagtgaaatgttaactttgacagctagtagctttgctatggttggttggaggcttggagcattcggacagttctttgtgcttgtcttaccacctttccgggtttgacaatgtacattaattctaattttggatatttcagtctagatactttgagcttctagcagatgatgggcaaaagctagaatttcgaattagctgcgaggatgaaaggggttaaattagcatgtctccatgtcaagtactttcatggctcaaagttgcgggtggcttgttgcattttactggtttagtaagtgtaacgttaaacttgtgcggaactttctaacgtcaggcaagaagtatatcttgcccaagtctagcctgttggcaggtgaagccaattaaaattaaagagattatgtggaacaactgtgcccattggatatttgcaaacgaaaaataatttgtgaataaaacttttatattacgtgttcttagcgatctaaaagcaaagactgaaaaataaactttgatgaaaaaacctcaaaatcaactccaaatttaaggttgaaaattcaaattttggttgataagcataagcgaaaagatgaggccgtatatttgacgtgttccccatgtaaggctcactattgcggtattgccatatgatttttcccactggtaatcctaagatttcaggattttatttctctcttacagacctcgcataaagctatggtttataatcacatcaataagagtcgatcttttatgtttactgctgtaaatgcttaataatgtgaacttggtttctcatttaaaactttaaaatttctcttacacacttgtagatactgcagtcaaagcaagcttctaggcacgaacaaagggcaaaacagatgctcgttggcaactttcagctcatttggacagtcagggatcagtctgaacaatgaagatttagtgaaagataagctcctaatagattgtggggaagatcaagattgtgtgattggtatgcactatgtttttttttcttcagattatttaagtttcatacttgtgtgcttattttgcatgtaaaacctataccatgcacctccagtaagtgataattgcatgccaaatctattatgggcagctcatgtccttttctaaggctgcacatatactttcttagaaaactctgcacaaatcttgcatgaggctaggattaaaccagattttcattgggtattcaatgcatgtttcagatgggatagttgccttgggaaagtttgatgcccttcacattggccatcgagaattggcaatgtatgcttctaaggcaggaactccctttcttctttcttttgtgggaattgctgaggttcttggctgggagtataggtgagtgtaaaagaggctattcataatttcccttggtaatcattagccccaaataactgagtgccttgcttgtggcaattcatgactgctttcctttcatgcaggcctcctatagttgctcagtgtgatcggaagcgagtgctcacctcttgggctccatactgtaagaatgtagtgcctattgaatatcaagttgagttttcaaaggtcaggtacctaactccgcggcaattcgttgagaggttatcaagggatcttaaaatacaaggtgttgtagcaggtagaaacatgttgtcttctcttgtaggtgcactatcttactgtattgtcataaccttttacaatatagctttgtttgttattatgacaggtgaaaactacagatttggctacagggcatctggcgatgcagctgagctagtgaaactatgtgaagaatttggtttaagtgcatttattgtacggtcagtcatggacacagctagatcttataatggagttacaacctccgtaaattcaagcgacaaggggcaggtttcttctagtcgtgttcgccatgctttggctatgggtgatatggaatatgtttctgaattactagggaggaaacaccgccttgtgctgacagttaaggaaaaccaccttcaggaaaggaaaaggatcatgctgccaaaatcttgcatgttgaacatgccaccagctgatggtttgtatgagaattgtgaccttcttaatggaggccatcttggactatgcagggtgatcataaactcagagaccattgtaattgagatgaaagatgagaacagtttattaccaaatactattcaagaaaatcagcaattaggtattgaatttggatgatatggtacagctcaattcatgattggtgacatggcaggtcatattttgtactatatcttcattatatctggcaccttgcggattagtttgtgttgatgctaaatagtgctgattttatctggaggggatatagagcaagaaagaaaaaaactgagaactttgtattcaagggtgtatacctcatcgtgatcaagccaaagagcatcttatagatgaacagagattttgtgcaaatttgcatttcatgcaacgagaagacatggtagtcagagaggacattgtcctttttctccctgggaattggcaacgatagaactgactagcttctagctagctgtatcagcaaagctgaagcacaaggaaacatacaagggaactcatttcccaaatcccacctagtacgtttttccagcttatgaaattgtgatttgtacaaataggtttcatttacacagcaacttcccattgttagatagcagcttgttccatcaacagttaatgaaatatgttgcttgatcttcgaacatctggagaggtctggtccctaacaacgttgagtttagcctaatctagcttatgaaattgtgatttgcacaaataggtttcatttacacagcaactttccattattagattgctgcctgttctatcaacagttaatgaaatgtgttgcttgatcttcgaatatctggtccctaacaatgttgagcttagcctaatcgatcgctggcgtgtattggagctctgaaaaggctaccggacaaggtaaaactctgtaaccttaatcgtctgtgtaggtccgtcagctcacaaggtctcagacaaacagttcatactttcggaacatagttcaaattcaacgccttcattgctatgaattaagcaaaaggtccagccagataaatagaaatatgtacctccaaagttaaaaaagttagaaccctaaaattgttctttgacaaaaaaagaaaagaaagaaaaaggatatacaacaatgatactctggtacacaagttgcgctgtacagatctgagcttcccaagggtaaagcttattgccacctgactaacccaaacatgtcacaaaatggaggggaggccccgctttgagcgtaagatgcacaaataacaacagatgcaaagatcctttaggccagaggcagctgagaccaatggcttgtatttcactgaacttccgcaaatatgactcgagacaaaaacaacacgtcgtgacgctgttcttgttttgacttagtgcacaatcaggtagtttttatttgctcatatttttcacctatgctcccacctttctgcttctggaattcaatgtaacgtaaagtgcttgcaaagaaggcctctgtcgatggatcagctacagtgttctcactttgcttctctgtcctaatcaattcaatcaaatcctggattacagtgttcgtgatctctggaattcctttctcgaagaagtacaaatacctggaaataatagaagcatgtggattacaacaatagcaatcatatgcacaagagaatatatcagactaggtcttgagattacttgttcaaaatttcgataaatagcgcgacagatccgctacttccccttgttacattagccatctgttgagcggcatttgcaattcttaaggcacgctttaaacaaaggaggaccctggaacaacaattcaaagaagcaacaaataaaaacttgtcagttttcatagatacaagaatataattcaaggataatgaatatatagtagtgccttttgttcccatgaataattgacataaccatgggaaactcaaaaggatattgcaagtttgctgtgtacttgcgtgtgcacctgctgttgctgacagctgcagctgtgttttatctaccttgtgatcttttaaaacagtttgactcaccacaaaattataatagacttgtttccgtatcattaggaaggtcctaacatttcatttgcaagaacgaactaaaagttgaaaattacggatggcataactagtctacaagtttcaacaaatcagtatgcttagaagtttacctttcaccatccattattccgtcttggtcgtcagtccagaaaaggtgtgaacatgcataaaccgctcggcattggtcaggtttctttagaagttttgctgagtactgcacaattattcagcaggatgttattatgtgcatagaagagactgatttgagagagagagagagagagagagaagagaaaaacataattcaataaggaaacagcatagtaattgttacccctgttgtcttgtgagtcagggtatctctattttcaaccccgaatatattcatccgttgaagggttccaattataagatgaattgcagtgatttgagcctttgaatcctgcatgtagcatgcaaacattgtaggtcgaaaatcgtatagagttataaaatgagctattgaccctagtgttggaatgcatattgcatgtgtttatgatatgatccaggggttatatcaaataactcaattgaagtaatgtgacaaaatggatgtgcacaaggaagggcaacgcagggcttataccgcaatttcttcttcatataagatgaatgcttgagtaaagaactcataagcaaccggttccagatcacaatcattggccgcctgtaatatgaaaggtagttacatgatatgcagagttatggaaagcataaatcaattgttacagcaatacctctgcacactgcagatataatctgagagccagttcaggagaaggaacacatgagagagcttcaatggtctgcggatgaaaaaaatgatgagaacattgatgagggagaacaatatccccatcaacagatttatagccctcatccttatgcaagcaagtaaatcaagccagggagagtttctgtgctagaggaagttggataaaacagttcacacttatgt

SEQ ID NO: 59284 - DNA, 17848 bp, Oryza sativa
  unsure (1)..(17848): unsure at all n locations
tggggtggaattganancctgatattcgagctcggtacccgatgtcgcgattccggtatttgcatagtatggggatcgttggtactaggatatacgctagactgagataaaagagatggggacaaggagttttatacagggtcgggcccctgaatggtcaagtaataaccctacatcctgttggccgaagccggtattgctcttattcaccataatcacaccagtacaatatttggggtagcctatataactgttgtcgacatggcggtctgaagatctaactcgtagtcaacaacaaagtagtcttcctcctcgaatccgtgcccggcgagatcagagataacgctttcgtctctcctgacagtatccggagacaccgtaggggactagccgtgcttatccctgaagtcgatatccgacgtcttgtcttggcgtatgttggcttgtatattgatcttctgtcttgatctatgttccgtgtcttctatggtggatgttgattgtgtcccctctcctcctaaggggccttttatttatacccatatgtgtccccttgtccaagtagaactagggaaaccaatatggatacaattcgagcagtctttgtcgtttccatgtagaactttggttgtctttccttatccggaactccctcgaggtcagtttccgtataagacatagtatgtggtgggccctaccgacatggtatgtggtttccataaccctgacaaggatgtagggttattacctgataattcaggggcccaaacctgtataaaaattctcgtctgtctcttttacctaagtctcgcgtatatcctagttccaacgatccccataccatacaaatacctcacgcgcgcgctcctttggtgtcggtatatcctaagtctcgcgtatatcctaagtcgtcgcgtcccgccacatcggcatttcgacaaacacctcacgcgcgcgcttctttggtgtcggtcgtctgcctcgcggcgggctgcaacgtcgtgacgcgctcctcctcctcctcctcctcctcccatggccggtgccagcggcgagcggccggcgagcaactgggactggtcggactgtgacgccgcattcaccgaggaggccgacggggcgatcgccgcgctgcaggacacaggcggagacgggctcgccaccaagcagctcctcgggaggtaccacaccatccttgcgcaatggtacttcgcgcgcgcggatcagcaaaaggcgacgaatcacctcaggagagcagcatggatggccccgtgctgcctgcacatcgcctttgcgctcgcctttgtgctcatcgagatgggctccttcgatgaggcagacatggtgtgtgcccacaacctcctcgtgccggatctcaccaaccctgcgcacaacttcatctccccgaaagagcaggttgatgccatcatcagctccaaagctccagagtatagattgggacgcggggcaatttaggcattttgaaaaaatactcgccactttcagccgggaaatgataaaataataagctcggtgtcctacggcaaatttcacaaaatttgtagtgtcctggagcagttaaacattttctcggtgtccctcagctaattacgcgttttttgagtgtcctgtagcaaattttgctataaaaatattaaaagaacactatacggtattaattaaaatttggaaaaaaaataaattctgaaattagaaaaagaaaaaagatttaattagaaatataatttataaataactaaaattggtgataaaaaataaatactattgaaagaaaagaccatgtaaaacacatgacgacataaattaagtaacagtcctataaaagaatagagaggtggtggttgatacgacatataaaaattgttaataatacaccaaatagaattataagtaattggcctataaaaatgtagagtggtggcggttgagaaaacatataaaagctgttcataaaacaccaaatagaatccaaatgacgattaaaaggagggacgacaggaaggccgtgaagcaaacgggcaatgcggttgccgggacttcttgaaagtagaaaaaataaaccccattgataatcatattcaattttaaaaatctcaatgacaataaaaaggagaagcagcgggcggggtgtataggagtatagttacatagccgtacagttggcgggacttctagaaaataaaaaatgaattccaacaatagttatgtttgatttttagaatcccaatgataataaagactaagaggcgaatgggtcgtataggagtatagtggcatcgtgtgacgatacttcaaaagttataaaaaaatgaaacccaacaagacaataaaccaatttttaaaggttcaaaacttctacaaagtgaaaaaaacgatgataatcatgttcgattttaaaatctcaatgataataagaagggaggcagcgagcgagtcatagaggagtacaatggcaaagctgtcgacggtttggtaggacttctagaaagtaaaaaaatgaacccgaacgataattatgttcgattttcaaaatcccaatgccaataaagagaaaagacaatggacgggtgtcggtgacatgggaccgggagtatcatgactcgaggcttgaggcagacacaatcgcccacgtggcctggcaccctcgggggacgtcgggcccgagggtgatgtgtgcgcccacctcttggtctccccgagggggggggtcggaccactccagcctcgcccccgagggccgaggcgccccgacccctcgcgttttctactccacgtgtatgggttaggtgagcacagcagggctcacctaaccgcatttattgcgcctcggctaagcgtgtcacgccgcacgaagtgcggtgcagtgcactcgattatccggtctgtgaccagtcacagaccggtcaaatcgcgggttaggtggcgacaggcggtcagacgcatgcttcgccccatcctgtcaagacgagagcttctaggcactcgttcccggctggagctagcgtgttacatcccagagatgacacgttagccccgatcgatatatgccaggcttcatcctaaccattacaagcaagatgttgtgtgaagaagggcaaacatgcacgttgctgagccgacgcttggtggacaagaatgaccgatttgtgaccggtctgacactgctcatgtcgtcagcacacagccaccttcccacgacgtgcccgcctcaggcagaagtggaggtaggtatgtgccgtcccgtcaggaggatgttcggaggacgaccgtgcaaatctccgtccatttatgaaaagaagaaaagtccagtttggaaagggaggggtgcatgtggtatccccttgaagtataaaaggaggaccttgcccatagagaaaggggttggttgattctttccagattcagagcctagaacgagggagaggtcggctcacactttgtagctcctccatacacagatccaccaaaacacaggagtagggtattacgcttctcagcggcccgaacctgtatacatcgcttgtgtttcatgttctcttgagaggtggcgatctttccgtcatctacagcgagagcttgagatctcaccctgagcccccggccgaaccggcaaaggggggcctgtgcggtctcccggtgaggggccacgagctccgtcatctggcgcgccaggtagggggctcagcgagtgttttctgagctctcgcacttttccgggtgcgtcaagtttttcttgatcagcctcatggctgagcaagcaaaggcacccgacctctctcccagtgtgagtggcgacgacggggagccgaatccacgccgtcgagctcgtactccaccgccccctcctcgccaaagtcctaagcagggggaggcgctcgaaagggtcgaaagatccgcggcttcaccgatcgcgggcgatggaggagaacggcgagatggggagcgtcgcctcctcgtctacggcgacggcagcacgccccagggcgcgctccaagctgcgggcgcgctcttacgccacccgcctgtcgtccctgacccggaatctccagcccaacgatggctggacgacgtggccaaattggtcatgacggcgcggcagcgcctagatgctggtgggcggtcctccgccaccaagacctctggtgctgctaccactggctccgcgtcgtcaagacgaagggcacgacgagcagcagccgctgttcgccgttcagtagccactccctcatcgactccttcgacccgagaagatctgcgtagggagcagggcgcccgcgccagcctcgagcgccggcgtaatgaccgaagtgctgcccacgcaatggaaggcgcttcctcgtctagagtgtcacctcgacacggacgtgggaatcagccctccgtgcccccggttggtggtgttggctgtagagccttcgtggtgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaagcacggggttggctaatgaacttgccacccgcgtctgtccactcctgggaggatttgtgccagcagttcaccatgaacttccaaggcacgtatccgcgccccggtgaggaagcggacttgcacgctgtacagcgaagggacgatgagtcgcttcaatcgtacattcagcggttttgtcaagtccgcaataccataccatgcatccctgcacacgcagtaatctacgcgttcagggggggtgtgcggcacaaccgcatgctcgaaaagatcgcctccaaagagccccagactaccgcagagctttttcagctcgcggaccgagtggctcgcaaggaggaggcctggacttggaacccctccggttccggagtggcagcttcggccgcccccggatccgccgctcagtcagggcggcgtgacaggaggaggaagaagaggtcagtccgttccgactacgagggtcatgtcctcgccgtcgagggcgcttcacgggccacccgaaaggggaggcctgcgagcgacaaaaagaaggaggccagcgttcccagcagggagcgccctaccggcaagtggtgcaccgtccacaacacctccctccatgaccttgcggactgtcgcgcagtcaaaagcttggctgagcggacaaggaagtgggaggaggagaggaggcaggagcgccgggaaggcaagtccccggcggttccttccggccgtcggcgaagtgaggccaagcagaaggcccccgccgaggacatcgatgatggcgataatgacctaggtttccaagagcctggggctaccatagccactgtcgatggaggagcgtgtgcgcacgtttctcgccggagcctcaaggccatgaagcgagagcttctggccgctgcccctactcatgaggcgacgcgccgggcgcggtggtcggaagttgccctcacttttgaccagtccgaccgcccgccgtgcgttgcccggggagggcaaattgcgatggtggtttctcccaccgtttgcaacgtgaaacctacgaccttctgcttaggaaacagcctaagcagaagtcctcgctcctcaccgggagaccgcacaggcccccctttgccggttcggccgggggctcagggtgaaatctcaagctctctcggtatgtggaaagatcgtccgccaggaagaaacgcgagacacgggcgatgtatacaggttcgggccgctgagaagcgtaataccctactcctgtgttttggtggatctgtgtatgaaggagctacaaagtgtgagccgacctctccctcgttcaaggctctgaatttgggaagaatcaaccaacccctttctctatgggcaaggtcctccttttatacttcaaggggataccacatgcacccctccctttccaaactggacttttcttcttttcataaatggacggagatttgcacggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaccaagcgtcggctcagcaacgtgcatgtttgcccttcttcacacaacatcttgcttgtaatggttaggatgaagcctggcatatatcgatcggggctaacgtgtcatctctgggatgtaacacgctagctccagccgggaacgagtgcctagaagctctcgtcttgacaggatggggcgaagcatgcgtctgaccgcctgtcgccacctaacccgcgatttgaccggtctgtgactggtcacagaccggataatcgagtgcactgcaccgcacttcgtgcggcgtgacacgcttagccgaggcgcaataaatgcggttaggtgagccctgctgtgctcacctaacccatacacgtggagtagaaaacgcgaggggtcggggcgcctcggccctcgggggcgaggctggagtggtccgacccccccctcggggagaccaagaggtgggcgcacacatcaccctcgggcccgacgtcccccgagggtgccaggccacgtgggcgattgtgtctgcctcaagcctcgagtcatgatactcccggtcccatgtcaccgacagtagcccccggcgttatgccagggcgatcgcccttcttatgggaagcggccgggcgtgacgccactcctaaagcctggtgacaggtgggaccggtctccatggttgggcaaaaacccaacggtctcaaaccatgcacaccggtaatggtaatttggctgtcaataatgggcggtctcttcaagactgccacatcacctgagcggcgcacgaatctgggcgagccgatttgcctcgcctggagatacggtaatgtcgcttcggtcggcgagcgtaattaacgcgcgcacgatacgatctatctcgactgccgcaaccgcatatccatctcacgcgccgcaagcgggcgaatgggattagtggaagcgtgggcgcgagaaacgagggggcgaaataatgggcgcgagaaacgaggagccgggcacagcgttggcaagggtataaaggcactgaggatgagatttgtctccttcctttcgccatcatttcccttgccttcgccgcttgcgtcctaactccttcttccctgcgcccttctttcgccacacgcgctcgctctgaggatctggctgcgctcactgcatgtttgcaatgaggacaccgttggggcgtgtcctcattgatggaggagcagccctcaatatcctttcccccgcagcctttgatgccatcaaggccccggggatgatgctccggccgtcccagccaatcatcggcgtgacgccggggcacacttggccgctaggtcatatcgacctcccggtcacctttggtggacccgccaatttccgcacggagcgggtgaacttcgatgtggcggacctcagtctgccctacaatgcggtcctggggaggcccgcgttggtgaagttcatggcggctgtccactacgcctacctccagatgaagatgccgggccccgacggccccatctctgtccatggcgacctcaaagtcgcgcttgcttgtatggagcagcgtgcggaccgcctcgccgtcgtgtccaagcccgagggcggcgacgagaggcttgacacatccgcccccgccgccccgaagcagcggatagtcacgtccgatgaggtcccggtcaaggaggtcacactgggcgacggcccgtccaagaccacacggatcggtggtcttttggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccacccggagtggctggcgaacccggtggtcgttcccaaggcgaacggcaagcttcggatgtgcatcgactacaccgaccttaacaaggcatgtcctaaggatccttaccccttgcctcgcatagatcagattgtcgactccacagcagggtgcgaccttttgtgttttctagatgcatattctggttaccatcagattcgcatggctagggaagatgaggaaaaaactgcgttcattactcccataggaacttattgttatacgacaatgccctttgggttaaagaatgcaggtcctacttttcaacgtactactcgaatttctttgggtagccaattaggacgtaatgttgaggcttatgtcgatgacttggttgtaaaaacgcgcaaccaggaaacgttgctttcagatttagcggaaacttttgagagcctccgctccgcccgcataaaactgaaccccgataagtgtgtgtttggtgtacctgcgggcaagcttctcgggttcttggtctctgcccgaggcatcgaggccaaccccgagaagatacgagctatagagcggatgcgcccccccagtaaacttagggatgtgcaatgtgtcaccggttgcatggccgccctaagtcggttcatatcgaaactgggagagaaggcgctacccttatttaagctcctcaagcgctccgggccgtttacttggacggaggaagctgaacgcgccctcactcagttgaaagcatatctcagctctcctccggttctagtcgccccggagccaaacgagcccctgctactctacttagcggcgaccccccaagtagttagtgcagcgttggttgtggagcgcgatgagggcaatcctcattccgcgcacccccaccctgtgctaacttggcccgggagcgagcagggaggagaggccccgagccgaacggtggcctaaggcccctggcgaccggagtcggccctctccccgctcgtcagatggtgctgggcgcccccgaccctcaggaaggccccgaggccactgcgggaaggctgcacctatcgccctctgaccccgaggctaaccctgtaccgattcgacccgggagggagcagggagaagaggcccccgagccgaacggtggcctaaggcccctgacgaccagggttggccctttgcccgcttgtccgacgacgccaggagcccccgacccccaggacggccccgaggccactgcgggaaggccgcccctgtcgtcctccgaccccgaggtcatcggcacagaagacgagtgcgccccgaggggccacttggacgaggagcgccccggggatatggcccttagcgaaggggatcggccccaccgaagggtgcagcggcctgtctactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcacggacccctctcagctgcctcacaccgcccactgggtgatgcagttcgacggttctctgtctctccagggcgccggtgcgggggtcatgttgacctctccgaacggagacgtcctcagatacttggtccgtctcgactttcgagcgaccaataatatggcagagtacgagggactccttgccggactcagagtggcagctggactggggatccgccgtctcttggtgttaggcgactcccagctagtcgttaaccaagtctgtaaggagtaccggtgctctgacccgcaaatggacgcttacgtacgccaagtgcggtgtatggagcgccattttgacgggatagagcttcggcatgtgcccagacgggataacatgattaccgacgaactctcacggctcgcgtcctcgcgagcccagaccccaccgggcacctttgaagaaaggcttacccagccgtcggcgcgacccgaccccctaggggagacggatgtgcctgaccggcccccgaggtccgtcggagtccaggcctcgggacccgaagggagcgctgcaagctcccttagattgattgcttggatctccgagatccaagcatacctcacagataagactctacctgaggaccgcgaagggagtgaacgcgtccaacgcatttccaaacgctacgtgctggtagaagggatcctctatcggcgcgcggctaatggaatcctcctgaagtgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtagcccgaggcttatccggtcgtcaagatcgataagcactctgcacttaaatttattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcatggcgattcatggatcgaggagttaccagcggtgctctgggcgaaccgaaccacaccaagccgagcaaccggggaaacgcctttcttcctcgtctacggcgcggaagcggttctcccatccgagctcaccctgaggtctcctcgggctaccatgtactgcgaggttgatcaagatcagcttcgtagagatgacctcgactacttggaagaacgaaggcggcgtgcggccctccgagctgcacgctaccagcagagcctgcggcgttaccatcagcgccacgtccgggcccgatcactctgcgttgacgacctcgtcttacgccgcgttcaaacgcgtgctggattgagcaagctctcaccaatgtgggagggtccgtatcgagtgatcggtatcccccggccgggctccatacggctggccacgggcgacggcacagagttgcctaacccttggaacatcgagcaccttcgtcgcttctacccctgagggggggtcgggtgtcaggtttcgggctcgggtcaaccccgcaccccccctcgggtgtgcagggttgaccgggggctgccacacatgcacattctcatttctctcatttcagtatttcaataaaagcagtttcaatttcctaagggctgtatctgtgccgtttttttttcctttttgaagaattttgacttgaaataaggtcactcgtgctcaaccttgccctcgggggctcggttcggtcagctaaaatcgccaaacggggcccagaaccgagccgtgcccggggcgtggtgaactccgggggggaatcggcaaaaacccacaatcgggtcacccataaccctcggtcaccacgttcccggcctggccagtctcgacatgcggatctccccaggcactagtcccgacccgcgcttttcgaggactgggacttgggcacgggcccttaaatcaagctaagacacaaaaagaggatcacggcacagatcatcctcatctcattcgcatagcaaaataaaattaacacaaagaattttttcatcatttttgattgcagattgtaagttgatttatacaaaaaacaggcccgagggccttagaagaaagaaaaagaagaaaattgaagattggcgggggcctgggggctcaatccgatgcgcccgggtcgccggcctcgtcttccacgtcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttgaagagcccaggccatcttcgtgaggtgcggagcgaggccttccaggttggtggagtgcgtccttgtctggcctttccagaggcccgcttgctggccggcgcgatccagacgggagactgcatcccagagcatgccgggccctatctcgcccgccaagcggagggcctcggcttccccggcggatgagtctagcgcgcgctgcatgtccgcgacggtgtgttcggcatctgcgaggcgggcggctaagtcgctttcgcccgcagccgccccgccgatgcacgccctcgcgtccagctctttttcccgcgcctcgagatcggcagcccgctgctccagtgcggctctctcggcgcggacggattccaaattgcggcgggcctgctccgtcagcgctgcctcacggagggacagggagtccgccaaccgttgcgcttcggcctcggcctcttcgagagctcgctcccgctcggcaagcgcgtcttcgcggaggcggagtgcggactcctcttcggcgcaggcagactcgtgcgccgccagcgttgcctcccgggaggtgacggcggcctcgcggtccgccaggactttctccgcgacgcaggcgcgctcctccatcgccatggcgcgcgcctcgagggcctcttcacgccgccggagcgccgcttcggtctccgtcgctcgctgctctcgggcagcggcggcatcaagaaccccctgggcggcgtcgagctttttcttcagctccgcctcccagttcccatgctgaaggcggaggaaagtggtatcagagccatctcgactgtagggtaagccaagtggataaaacctaaggacatattttataaataaaactatttgcgaaagttcctctttttctccttcccctaatgctatttgcaaaaggtttactcttttcttccttcttcaaatttcaattagtactagttggtcagatttgtgaagaaaaagatatcgtcagttgtttgccgaagctccggaagactgcaggattcgctagcgaagtgtaggaagcagtgaagccagctgtgaagccgaagctaagatcttggagaacctgtcgctgaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagcaaaacaaacaacacatcaacaaaaagagttagttcctttaaggtcttgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtacctacagtccagcaacagtgcaagttatcagaatttctcaaaacggggcctccaacctttgccatggccgtcgatcctatggaagccagtgattggttgcgcacagtcgagaagaagctagggttgattcagtgcaccgaccaggagcgggttggcttcgcaactcatcagttggttggaccggcttcagagtggtgggatagctacgaagcatcacggccagaaggacataccatcacctggaacgagttttcatctgaattcaggagatcacatgttcccgcaggaatgatcacactaagaaaacgagagtttcgctacctgaagcaaggagatttgaccgtcacagagtacctgcatgagttctatcgtttggctcactatgcaccagaagatgtggaaacggatgaagacaaacaagagaagtttctccaggggttaaaagatgagcttgcagtgcaactacttctagaggattatgaagattttgagaaacttgtggacaaagccatgcaactcgaaagtgagcataatcggatgacgaactgcaagagaaggattgtcaacatcccagtatttccaggtggtaaccaaagacagcgcactgagccacttcagatcaccggatcttctgttgtgcatcaagagttcctgccccaagaagatgaacacaatgcagacaacaacactagcaatactaatgatgatgataccaccaacaaccatggttcttgccccattagtgaccactcgaataaagcgtgcaatgtcagtagcattcaccaagatgtcaacgatagtatcaatgttggaacccagaatgacaaccttagcaatttcgacactgagaaagactccaatggtgatagcaactatggtaccactgatgccaatgttagcaaggattcccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgctgtacctgtgaggcctcatgttaattctaacccatagtagaaacaatgtaccgatgttaagcaccttccctttttgtttaagacagtgccttgtattcatgaaatatgggagaaatttgtaataaaaacaagttctaagaggattcttttggaagatgcggatatgtgatcatgtgtataattgtttactgacaaaggagacctagggtctcgtgccagaggaactatattctaacctcgagctaataaccaacctgaggatggaaaagaaaatcaagtgattaaccaaagagacatttgtttggactaagagtttcagatgtgtctttttcggatcgaaggcaatgacagtcagtatagcttttggcgaaacacttcaaggtttcactgaaaggtagcagaccaaaggaccacatcgtcaccagaagcatccacaactctcggagagaagagtacttggttggcaaagtttaaaaggtgattgatagaagataccagcaaaggtgtttattaccgggcaaggaagtaggtcgaaaggtgattgataagagaaatttgaaaagaacacatcagggttgaatgtgtaaaggaatactttgaatgctaaatgatgacaaacatggtatcctagtaatgacaagctagtgttgacgcatgacatgaagtggtaacttgtatgaggttgactccaaagatatgagttataagaagttctggaactgaagccccatcttccaatgccgcagcccagtcgaagtcagctagaggtgcaaccagggaaaagtcaggtgaagagaagattccatctgcaacaggagattgagccaagcagtccagagtggagaagttttgctaggcaagtttgttataaaagatgcgacggaagaagtcggacaagaagagaagaccgcccaacctatcttcttgctagcctcctcgaatctcggggacgagattcctgtaaggggggtggatttgtcacgtcctgataaattcattccaaaataaaattcattttctaaaaggaataatagaattaattaaaattcgaaaagaaattggcaaacactaaagtacgtataagaaaaattcgaatgtggcccggagaatttttgttaaattctccttggtctaaaaggagccctcaaattttacttgaattttcagagcaccggaaataattattaagcaacaaaaacaattatcaaagtttactaaaaaggaaaacctaaaaaaataaatcctcttcctcctttgggccaagcccagcccaaagtcttcctctcctccctctctttctctccctctccttctctccctcctcttgggccccttcccctcggcccagtccctccctttctctctcttcccccgcgtcccatcggctactccccgcgcgcgcgccgctgacaggcgggcccgcccgccgccctcgctgacgggtggggcccacctgttattcccaaccccgcgccgcgcccgccgnncgccgtgccctagcgccgccgccgccgccgaatccgccgcattccgccttcctcgcgcgccataaagaggggcgaatcactccccgtgattccctctcccgtttccccctcttttccctctctctctccctcggattcgttcggaatcactcccgcaatctccgccggcgcatatatggagcccgaaaactccgaggagggtttccttcctatccggccgctttccctctctccggacgctataaaatcaacccccgagctccgctcctccgtttccgccgttcgcggctggctctcccggtaggattcgtgctcgcgccgctttcctctctctccgccgtcgccgacgagttccggttcgccgccgccgtcgctccggacttcctccccactcggcgtcacctccatcgggttcgccgtgttcccgtcgacctcgtccgcgccttcgcttcgcccgccgaccgccggagctccgtcgtcctcgccgtcccgaaccgcgccgccgccttcttccgcttcggccgccgttcccgtcgtcgccgtcgaccggggtgagccgaagaccgttccgttcgcttcccccttccctcctctctctcgggtgccgctccgccgccccggtggtcgccggcggtgaccatcggggcgcgggcgcgttcccctcccgtcggccgtgccggcgagaccgctttcgggcgcgccctcgcggctgccaagtgggcccggccgtcagccgcccgcgcccgcgggtgcggctgacgcgtgggacccacggcgccgaccgccgcaagacgcgtgctcccggtccaccgtggaccgagaggctgacgcgtgggccccactcccgtggacccggtccgcgcgccctctccctcggctgacgcaataaatgcgtttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctcctgttatgtgcagtttattagagtaaaagccttttcttttcagtggggaatccagggctgctaacgccac

SEQ ID NO: 59285 - DNA, 27706 bp, Oryza sativa
ttcctgcagcccaatgaaagcaatgggagctatggaggaaggagatgctgtgtttggttcaggagctgaagtgaaccttgattcacaggtaacatgaatttttttatatctagagaaacagcaatgctatcactgtaccaccttgccttctaaacagaacagtatctgatacccatattgcaatattctgtgttgtaaaaactttgtggttggaatgcttttaccagagtccagctctaactctgcatactttggcaagtttttagcccctacagagctcataaccacccatgtctggtaaaaggtggtcctgttgaatcatgaaccttatgcaggatagctttacactaatttgttcattgaacaaccctctacaacatggtctgtcacaaagaccttcactgcacttgttatttcctcatttaaccccaagatcatttgatctggattgtgcacataatattagcccaaagcaatattgtggaggctggcttgcttttacatgctagaagatttatttaacaacttaagtgcattgatctgcttccagtgaacttgaatgcaagctgactttgtttctgatgaaaatatgcctgtttaatgtgctcacaggtatattggtggcacgacaagtatcgaccaagaaaaccgaagtacttcaatcgggtgcatactggatatgagtggaacaaatacaaccagactcactatgaccacgacaaccccccaccgaaaatcgtccagggctacaagttcaatatattttaccctgacctggtggataaatcaaaggcgccaacatacacgatagagaaagacgggagcaccggtgagacatgcctcataagattccatgcgggccctccatatgaggatatagtaagcctctattcccatatcttcaaatttaatcctgtagagtttcatgggcacttcacttaattactctgttttcttcaccaggctttccgtattgtcaacaaggagtgggaatactcacataagaagggcttcaagtgcacattcgaacgtgggattctccacctctatttcaacttcaagcgctaccgctacaggcgataaaatgccacgcaaggaagacgttttgatctccattgtgctgttagaagttggtcttgcttttcttacctgagagccctatgcaaataggtttgctcggataccaactctggagtcgactacacatgctcatccgagatcatatgtactaagtgagaacagggtagcatactagcatcccgtacttatgctgattaggctctttgttagcggtttgaaaatagcaacgaagtctcctgtgtacattgtaacttccttttttctgctttggaaattgagttcagatgtcaaaaatcaacacatctttttggtggcaatcaaactaatagtgcgtatatcattaaacttcttgtttctggaactagcgaaagtgtggagtacttagcacaacatcagaaggcatgaccaattgacttatagctaaaaatgtaatagctgttttttttttgttttttttgttttgctcctacacaactttgtgctattaacaggatcagagatgcaaagtggcagttggtccgaggctcctagctccgaaccactatcagtttgcagctattggcctctacatccatcttctacacaagattataaggacaagagatgattttaaaaatggaaggcaagtattcactcaaagtttagatgccattggatggtagaatctaaactgcttctaaataagttaccgcatacaaaaaataaattaacagagtcccctttttcacaagtgaggtttgctcacttagttcccttcgcactggcaaactacgacagtgtgtaaatttcagaagggatattaaaacaattaccaatgcagcaaaggtaaatagtgcaatgggcaaaattgaattgattctgaggacaggatatctccaaaaccactagccactttggacttggtggctaatggtcgggtttctccgtccaatttccagaacaaaacaggtcaactcctatgaagtcagagactcaggagttgcttttaaaaaacaaggaagaaagaaaaaaaatattttgagttgagaaaatggcaaggcaaatatgatatactagtagagcacaggagcaaataacaaaagccacagggaaatttaaaagacttgcattgtctcaagcagagttaaggccttaaagaccacaaaagctcagtcacaatccggctactcggaaacagcaaatggaactacaagcaaccagctccaaaccaaggacacaaacaagtctaccaaccaaaaaactaccagaatattgggctctccttgccaacaatctcctcagcagtagaacatgacgtccttgacgttctccttgatcttgggaagctggcgcacctccacagggccctctcgcgccacagcctgcccgctgctgccaggggtcgagccaccatccgaactctctccttccacgtagtagcgagcgcggaatgcagcaagatgagcatagtaggccggtgggactgcacaggaaagaaaaagagcaatacatcagtgaacaaatgcaacagatttgaaaaggagcaccacgtagaaaagaatctctgtagttcaattgctagtgcctagaaagtagcatgagagcatcgcatgcgaaatgataggattcagcagatttgaaaaccacatgtttaggaacagttaacatgatgacattgatggtgcttgacaagcaaataacactaggttcgattcacttcaaaaagcaagatcacatgatgtgcattacatacagtagacagacacaatttcaatcttaatgaaatttggtcggctccttcgccgacctggcaaaaacacaatttcaaaacatgctaaattgcacagataggaaaatgagtactacatcagtgaatagaaaggaaaatgtttcggtagttcaattgctagttccagaaagtaacatgggagcatcacatacaaaatgataagatacaaatggaacacattcgaaaagaaaatgctgaggacaattttgaaaagcagatgttgtggaacagttaacaagatgacattggtggtgcataacaagcaatgacagctgtgcagttcccttaccacatgatgaattgggtgcattacagtaaacaaaggtccaatttttaacacaagctaaataaggatttctactgttgagaacaacagcctactcctagcgcttatcttttccagttcacagttaaaccaatgccaaaaattttggtgtacacatttgcttgctcatcgaaggaggtaaacaaagctaagcaaactaatgcagaaatgagaaacaaagatgcaagaaaagaagactcacccacagacactgcccgggtgcatcgcgcatagctgcattttgccaacagtaggaattatcagagttggggcagccgaaataataagggagctaagcaactaagcagaaacagagaaatgaacttacgtatagcaaagattgttggtcagggactgaagtgcatcggctgtaaaatggttctcatcgtaaaggacatggtaatgagttggcctgctagtaccctgagaaaaggaatgtcaagagcacacattaactgaaaattttgttggctggaaaattttgtgcaatctgcaaacagcttccagcatgggttttacctgtatgccagcatggctacacaggtagaaatcgaactctgtaggatggcaaatctgacggtccacgacagttcctgcaggaccaaaaagaaacggaatacaacgatatatccaatcatcaaatgcctgaagaagtagcagatgtatgttctcagtagcaaccaacaagaaactgaccaggaaggatgtttccgctcttgtcagtcatgtctcgcctcccatgaacctctgggaaaagccttgtgtgatgccttttctgaactactacaaatgtgacaggtggtagatatccctcctccaaagatgcacaagccttgcaatgtaaaaggattaaattcagaaaaaacaatgaaattggcttgtccagaatagataacacagacagatgtatcatgatgcgaagctcacctttctgatggcatccatttcatgaagaagcacatggctgaactgaccttcacttacaccatctctgcagaggagaatgaccactcaacaaatttcatttaactggacacaccactgaacagaacagaatttccaggacatacctatagaagattatcctctcaggccttctgccagtcttcttgcggaatgcgataagcaactccctgtaaacaagagcatggtcagttcccagttgaacctacaataatatacaattgcaataccacattgaccacaaatttacctgatcatcccaccatttacaaccttcactggatctttaccaacactaaagagatcttctattatctcctgtctatgtggttgagcagagaccagacctcggtatttggtgatttcaggccaatccatagatgccacaacctacatgaacacaaagaaaatataccagtaaagtttgtatatgcaaagcaataaactttgggaagaaaaatatagttcatctattgcatcaagttattcacaggatagcccatgatcttgtattgtaggacaacatcaaacagaccaagtaatgaattgaagaaccattagctaggagggtactaaccgcagcaatagatgatgcagagtcctctccaggtggagggtgtgtgacatcagcgccaaagatgattgttgggacttctgacacaaatggtatgccattgcggataaaggctcgctcaagaacagtgttgcgccctccgacctggttatggcacagaattgtcatacttctgggggagaatactaaaagcacacaagatatagtccacagaattggtatagttctagggaaaaaaatacaagcccagcagaattacagaccttgacattgattttgagtgcaacattttccaaatattgcttgttcggcctgctggcatgccttggcaaacaacattgagatacaatgccaaggtcagtctcacagacccttttaattttccctgtaaaaaccatgcatatacgacatttaataaataaatcagggaatggaaaagttacccaaccaacaatatacataccataagaaccactaacttcaggcagaattacaattaaaagctgcaggcctccctttccctctctggctagcagttctgatgttctcctgtgaacatccctcagagcattctctatattgttaggatttgttgaccggacatccacgactggtcttggattgaaagactacagggtcaagtcaaagttaattgcagcacatataattattaaactgctttaatagcattgtaactatgccagagttaccattccagtggcattgcacatctgaatcaggtcaccacagaacctttgtacctcctcaggacgcattcgtgaaaaactcagacatgtccagttatccacagttcctccattgatcattttctgaaaaaattaacaagtattagtgtcttcctttaaacacatcagcaagtaaattatgttggctcagtagtttgtatctttacaggttctgcaattatgtttcagtacaaggttgtcaatttcagatactctccaacaaaaaataatgctaatggtcaattcataaagaagttaagcaagtgtacctagaattcactttcaaacaaaggcaatacaaaattaacctgagagagaaattgagttgtaataataaagcaaggcatcaccttgttaatcatgttccactgtccaacactgggtgcacaagttttctcccttccagaatcatgatacttcaactgaaaagcgcaaagattaaggttgttagaaattcccagcagtttaaacaatgcgaacaaaagaaatggaataaagcatagtaccatgggtggaggcagcacacgggctggaacagagactaggtcattgcagaccttgataccgaactcctgagcaaacctatcctctgtatacttgttgtggagaaccatctgatagaagatgaaatggaagtcaatacaaatacatgatattgtcttcattatctcatcaagaaaaaaatatagccttatgttctacggaaatgttattctaataaaatgtgcagaaataaaaggccattaaatgtgagcaaaaatccaaaagcataaaaagtttggctctgcatctacatggtattgtacctcatgaatgctctgttccctctgctggggcgttgacaggttgctctaagaatgttggtcacttgtttgtcattaagcttcttggagtacctctgcccttctacaatcttgcacacctgcaaacacatttgcatgaacaaactgcacacagcatgcacaattcaggtagaggtaaatggatgatgaatcaatacctccataggtaagtatacagggcgagaatcactgccagactgtaggcagggccaaaaagcgtacttcagtctgtaattgtacctatcccagaagtactgaacaacagtcttccttgtcccattatcatcaacaggaaatctaacaacatcaaaccaggcatcagtttggtgaaaaacaagttatgttcatgctataaaacagtgaacaagcatgataacaaaatgcaggtcctaaaaaagatgacaaagcactattctcaggacagtaaaattatgtgcacttcaacctttacacatcaattttgttgaacattgaaggacatttcacagcattgacagtatggatatcaaaggaacatacattgatatctaaggaataaacctttgaaaaggattaaaatgtttctatcacatgtccacaaacaattaatgtacttaccatgcccaagatccataaacaaagacatttcaaatattccatcaacaatctatattgattttctgtatcttaaagaatgtaaacaaaaagagagttatagcagaagcagaggaaagataagtacatcagctggctcataggaatgggggtaatccctgttatcttgtatcttctgatttggtcctcttggtggtttgtttcaatgcgaaccccacgtaatgctttctttatctaaacatcatgaaaaatgagttaggatcagtattgcatgattttatgaattccatcagtaggaatattaccttcacacgatcccggtctgacaaaggtcttgaggtgtcacgtatgttcaggaactcctccacaaattggatcactgtcacaggcttaaaaaaggacgttgcagatatatctgaatgaagcataccgaacagtagttagtatctgaaaagatcacttccattcagagaaaactgataaacagtaactgacagggaagtacctatattcagcgaaaggcccatctgtgttgggcgcaggctctgatagtaacctctccaacactcaagtccctcaccaatgtcaccccggtgaccaaactgggtagagaagaaggatctggacactgtgacataactgcagaaaaagtagttatcaatgcattatttgtaccctagtcagtaaataatcaagcaaaagtcaaaacaaagacaagaaagaatcatacttccaagatggtgactccctaaggacaacatcaagaacttgaatggtttcttggggcatatccctctgtcttccaagcaaaaactgctggaggtggtacaagtctgttctgccagcaatccgaattgtgatcttgtactccctctccgccctgcagaagacaagaaagaaaaaataatatgagactgcaaaacacataattcataagaatttaaatctctagtttgcatcatacaaacctttctttatccttcttttcgggatcaattagcttaaccacaaactcctccgattcaaaagggagtgaaccagcagtatagagactctttcttccatcataggcaggcaatttgccaccaagagatgtcttcccgtgcaacttgatgagctcattgagtacttccctatttgttgctcttgattttgactcaggattgattgaaacctgtaacataatccaaaaagaagatcaacggcctttctattggacatgaggggcagattttttttttataaaaaggaagatcttagagcaacttaacaagaactctacagtaaacatcacgtaacaagtagtttagatcagagcagttaaccatcactaatacaccaaactactcaatgtgtatttcgtctagacctaaatgagtaattcagcaccaagttatgagtagtacacacattatccgagccgattgattagggaaatgaatgcaggccgaacaaaaaaacagaatgccccaaagtaacgaaatctaaatcagctagggaccaacagaaatcaaacaacaaagaaggtggtaaagattgatcctctccattgaggtcacgatagaggtagaactacacttgcaatactacgggtacgacacttacatggggcgggcatccatggcggacgctagagcctggagggaatcgccggcgaagcgttcgaggaatggggagagaagcatggggagagttgaagaatagctgtactacgggtcgaacatgaagaatagctatactacgagttctttaaagcccaccaaagcccataggaacagggccaagaatatcggtacagctcaggaatcagaaaccaaacatcaaagcccaaaaacaaaataagaaatggaactactactaaaagccccaaagcaaaacaaaacatatgaaacgagtttgcaagaattccacctgaaaaaacgttattgttttttgaacgaataaaaaaaaagctaggcgtacaagatcatgaatgagaacgacatcctgaagacaacgataaaattttcatatattttgccaaaaaaaagagcagaaaacacaaaaaccaaaagccacatgtatcatgagtttttaaacgtggatccaccactctacttctgcaagcgacaggcttccggccgctggagagttgctgcaagaagatcagagaaaggacagcggtcactagtccgctgctacaagaaaacaagaatcgatctgaccactttggatgcaaaagttcacgcgaaggcttcgcatacagggagaacaagtttaacatgtcccttgcaagaaaatagcaagcgaacgtatccgcttacacaaaaatggcagtctccaaaagacaacaaaagaaacagtcaaaaccagaggtagaaccgaccgggcagggcacagagaggtttcgtcgtcttccaactcacacaaaaaaaagcaaacttgtaaagtagaacaaaacgatgcaaaacctttgcttgcagagggaaaaacccgaccagctcccacgagggagagatcagaactacccttgtacgaaatcagcaaccccaaacacagcaaccgttctgaagaaaacgggatgcgcgcgcatgtacgccagtgcgtttagcagatgagatgcatgtcacgaaaacgaacgcaacgaaacgcttcgaattggtgagctgcgtgtgctgcggccatgagatttctgtcgacatcggccagatctctagcaccaaactagcagcgagcaccgaaggtgtaaatggccaaacaaacggaggggatcaaaaaatcggagaagaaactttatgcaagaaacgaaacgcgacgctccgaccaacacccacgaactggatgataaactttaaacgaaagcagcagagaaacgaacttgcaatcgaaagaacgaaacagaaggatcaagaagcaaaactgaaccgagcaacctacccttgtacgaaacgtaaaacgttcccaactaaacaacgacatgcatgtacgccggtgcgttgagcacgtgagacgcgtactacatatgtacatgcatatcaccaaattaaacaaacagaacgaaaggcttcgaacgggtgagctgcgtgtgctgcggccctctcgacatcggccagatctctagcaccaaactagcagcgagcaccgaagtggagaaggccaaataaacggagaagaaactttatgccagaaaggagacgcgactctccgaccaaacacccacaaactaggatgagatcggaagccctcgctccatgcaaaactgcaaacgaaggcagcagagaaacgaacttgccatcgacacaacaaaaaaaaatcatccagaagcaagcaaaatccatgcatacacacaacatgcaaggtaaatttaacagatctgaccatcacacgtacaggagtacagtagtagacagcatgcatggagtatgcgtagatctaggggtgggaagggaagggaaagagggtcaggggtgagctcacatcgtagtggaagaggttgttgtcggcgacattgacgaggaagtggttcgcgcggatcatcaccttcttcccggccgctccgaaccccggccgcgcagggtgggcgagccccttcttcgacaccggtgccagatccttgtccgactccaccgacgcctcgccagccggcgcggccgcggccgacgccaccgccgcgggtggcgccagcgcggtctccgacacgaacagcttctgctcgaactccttggccagagccgtagcggacggcgccgtggaggacgacgagggagccggcgcggccgccgccggctggtacggagccggagccgacgagtgcgacggcggaggcgcccggatggtgacgggcgtgctgcgcgcgtagccaccgatcaccggaacccccggggagggcgcacggtacacgcccccgggctggtacgcgccctggtggtgcgccgccggcatcggcgcgccgtagacgacggccggcggccccggccgcgggtactgcggctgaggaggccccggccgcggcgtcatccccggcggcggccacacgaagcccgaggcgggacggtacggcggggctccacccccaccaccaccgccaccacggccagggacgtcgccgcggccggagtagggcggccgctgctcgccgccgcggccacctcggcctccgccgcggtaggccatggcagagagagaggtggaggaaggcaacgagatggaggtgagggtttgggaaggggtggggagtgggtgagtgatgttgcggccttgcgggaatggaaggggagggggattttataggcggagggtgatcgacgaggagaaaccctagctagacgcggtgggagggagaagggggtggtgatcttaccgcgcggtgactgtatgcttgtccgtacggaagagtgattaattaggcggccggttaatcaaacttgctacccaagacaaattatgtgtcattatagaaagtgaatttatgtccggtttttttttgtgttttttgaaggaaaattatatgtcattaagttcatcgatcggggtgaactaattaatctgagtttgttttgttattaatttgggtgttaagatattgtatagaaccaagctatgaacgtgaagttatacatatgtatagtcaagtgtacgagtgtagcaattcataatgtttaaagttaaactgcaaatggcaaaaaaggccgtacgtctagtgtagtatcccatttgacaccatccttccgttttgttttctcgtaattaatattgaagttatatatgtttggtgtggtttttgtgatatacattgtccaaaatttgacaaattaaatactatacagatcaataatgcataaaaaaaactagctagaagtgcatgcgtaccagctggaaggatcagactgaaattacttttttgaaaacctaccgattgaaattactgttgcctagtattctcattttcccagcgatcgagtctcgaattgctgccacgtaatgcctctatcttggaccattttgatcgctatgggtagaaaaggtttgatttaaaatcaagtcgtgttctaattaccttcatgaagggatggtcaagacgaagcgtataggcaacattgatttttactgcagttagaaatatttgagaattgagatgtgaatatacatgtgcaaggcaaagcacgtggacgcatgcagtgagtgatgagatgagtccacacctccaagacaagtcacaacccgatcacaccggacggaaagaagaagattctggaggaacgaatgacccatgcatgcatctgtagccagtctctctctcatgcgccttggaattatctctcgtacggcttgggcccacctgtcattctcacactgtattgtacccaaggtgaaaatatcttcactcctaattaatggctaggtagttttaatcatgggtaagataaataatctatatactattaagctagctactctgtactcctgagagaggaactcgatcaatcatgatcgagtagaactttacactggaaaaacgatactatatggtgtgatcgtctatcggcgattcgatcggcatacgtgtcacgtttgaaaaactggatcactgctcgcccctctctctctcgctctgcaaagagatcgtatcagatcgtcttggctgcgagagccacccagcgatcgagccagaggcggtcgatggctgtagcagccgttcttccggtgaaagctgaggctatgggaacatgcagatgcgtccaagcggtcggcccagctcatccatgcatgtatacgttgcggcgcagactgcatgcagtagtcgaaaagcaaaaggaaaaaggtagagcaaaattttttgatcgtctccaaacccgggttaaaagtgtgtgtggactgtgtgattttaactgcagttaacattatctccaagcccgggttaaaattatgttctgtattctgtagtggctgctgacatgcggctcggtttttctgatcactaatataacctgcgagtaggaacattgcatgcagcaaattttactgtctctatcccggtccgttttttatcatagcgcagaacaaaatagaagaagagctgcgcagtgcatgcgtggtggactggtggtaaaaacgacgaggtgtgtacagtacacgatgcgctccttttcccatgccgcttttggcatcctcgcgccctcctcccctgtgcaaatctctgctgccgctgctgccgcaacctcgcaatatcgcattcgactacgaccaaaccgcggaggcgaggagcgtgtaggggaggggttggtggtggactggtggtcaagcgaagcacgcagcggttcgagccgcaaacggcaaagcatctctggcgctgcgatgcgctgcaccgtggggggaggggacagcggctgcaggtatcagagacaggagcagcgtacaccgcggccaaaagcaaaagggtgggtgatcgtgctggcctaagttggcaatactggcaagctgtgaggctgtgaccatgcatacaatgggtaacccaaacccatgcttctctgtttgcgagacgatcagacgagacaccgcgagtgggtgtgtgtgactgcctaccatggaattgcatgagactgaggccttagttctcaaaataaaaacttttcacccatcatattaaggtggtgtttggttggagggactaaagtggggctaaagtttagcccctctctacaaaacgagagggacttatgtttttgagagaggggctagagagaggggctaaagtttatcccctctctcccaaacacccctaagaccctgtttagatgggactaaaacttttaagtccctataatatcgaatgtttagacactaattataaatattaaacatagattattaataaaacccattcataatcttggactaattcgcgagacaaatctattgagcctaattaatccatgattagcctatgtgatgctacattaaacattctctaattgtggattaattaggcttaaaaaatttatctcgcaaattagctttcatttatataattagttttgtaagtagtctatatttaatactctaaattagtgtctaaatacagggactaaagttaagtccctgtatccaaacaccacctaaatgtttggacacatctatgaggtattaaatgtgaaaaaaaaataattacacatttacgtataaatttcgagacaaatcttttaagcctaatcgcgccatgatttgataatatggtgctatagtaaacattaataaatggtggattaattaggcttaataaattcatctcgtaattttctggcggaatctgtaatttattttattattagactatatttaatacttcaaatatgtgtccttatatccgatgtgacaatcaaacctaaaatttttccccaaccaaaacaaggcctaactatgttaacgttgcttattgtaaatattactagtattgtatatttgtatactctagtactccactacgaggactcatctctgcgtgcagtttgaagcaatttgaactcaggccctctttatttcacaccccaaaattttacatcatgtaacatcgaacgtttaaacacctgcatgaagtattaaacataggttaaaaaataactaattacatggataaagactaatttgcgagatagatcttttaagcctaatatctccataatttgacaatgtggtgtcacagtaaacatttgctaatgatggattaattagacttaaatttgtctcgtgtgttactgacggattatgtaattactttttttattagtgtctaaacactccatgtaacactctatgtaatattcaatgtgacacgctaaaactttacccctctaaatctaaacacccccaagtttgaactggagttggaaaaacaaccgcggtaaaagatgtgcccgtgtgtggtaaattaaacatgcagcactagtggagtggggctactacacgtctacacccttggtggactggcagagtgggcccacgcaccggggcagaatgttggatgagaggagagagatgcttcttgttggcttcgcagccaagaaagaagctcctgtatgcctggctatagctacctggaacatgcacggcgcgctgcgccgcctgcgcacgcagcaggcttcgcggccatgcattcgtccaagcggtcgtcccacctcatgcatgctgcacgtatacgttgcatcgcagactgcatgcactcgaaaagcaaaagaaaaaggtagtagtagagtactagcgaaagcgagtgggcgggtggcatacgtacgtgtgcactccaatacttaaccatgcacgtagacgtagggggtgcggattaaactgcagttattctgtagtagtagctgttctttttttttttctgatcggtaattaacctgcgtgtaacaacagttctattaattagaccatgaacaataatgtacatgcagcaacttttacgctccctattatattacgttccgtttttacacgtatacgggtaaaacgacgaggtccacacgaggcgctcctttcccatgccgcttttggcaccacagttctcctctgtctgtgcaaatatctctgccaccctgcaggctgcagctgctgcctcccactccaatggtccaacctcgcattcgatttggagtacgaccaaaccgcggaggagggaaagcgagaccgaaaacgctaatcagcgcgccattgatcgcgcgccctccccccgtgcggcgcagccacgtggcgcacgccgagagactcgtgagcgcggttttcttttttttttttcggttttttcgcttttctttaggttttcttttggttaattcccggttttatccattttccattcggtttttcagtatatatacttatcgtttggtttttaatctatatatgtatatacaaagtttatatatgtgtgtattcgtacttatagccaaacccttctacaatgtagagcaggaaggagttaaaagaatcagttgggcataagcaccagatacaacataattagaaaaggggcccataaatctctataagtcagacaattatgttccaggttttggacaagttgaacgaaagaggaccataaagctacagccgattccaagcaaaaaaacatggtacaacgcatcaacactaatagcaagcaagccagcatagatgagaaagatatgcatgggagatcacatgtactcctaagtcatagtaagattaaattcctgtttctgaagttactgctgcaatacataagctaggaacaaaataagcagccagattaaattcctatttctgaagcacatccagatctacagacaaccatatatagcagcagcagccatagaaaacgtagaagcagctcgcaaaacaaagcacgacgatgcagatttcgatccctgatactgtaagtataagcagcatgactagatgaggtctgctccagcaccacaagacgtctgcctccaatccttccattccagtgctgtcaaacagaaatattaattatagtatagcttagaaggatggcaacatcaatggcaaaaccaacagtattaatactaccaaataatgtttaactcagggtaatttaaatggcaagccgctaagaagtatagctgtgattaacacaaaccaataagtgcagaatgaaattgcaaacgaagttaattaattaattgcatgcagaagaagtttagcggtttgagttacctgacgaagatgtcaggttcttgacaacctcctcttgattgcagtcgagcactcctccaaatcatcacgatccctcttgggtggaactggattctgaatgtgtttgggaaattctacacccaaaggctgtgttgggcaggaggagagcctggtggaggacatgatgttcttggtgtgcatgttgaggctgaccatgtacaccccttcttcagcagcattgagcatgaaacagatgacaccgttttcctccatgctcaggacggggctagtcggcttgaccttaggcaacccggccttcttgaagccctccagctcccacaggcttgccacacggagttccccatccttgtgccactgcgtggtggccagggtcagagtccaagtcgtcatcatagcttcatcagggggcaccatgtcaatagaagcgaacttgatggagtccttaacgcagttcattgtccggcataaccgcagctgattcttcatggggtcaagatggcactcaggcggcagcgggatgtagcggaacggcacatcgtagccaccggtgagcacgtcgtggcagctgcagtagaggacaccttgcgcgaggttggcccagaaagcctgacctccggacgagaacaccatatgggccttgaagcgattcggcgtctctggagggaagagcgggttcttgaattgccacggcgtggtgacagcggagaaggaggatggcggtggaggtctcgaggatggcggcggcggacacaggcagaggacatcctggaagaagcgcctggtggtttcccggtcggaccgcatgtcccttcccaggagggcaatggtgtagtcgccgccggcgccggcacgaagagggagaggctggaacgtggcagagggatcgcagcggttgggcaggcaagggatcatggagagtgacttgccgatggcgtcgtagactaggtagcggtgggtgcgattgcggaggcaggaggtgaagacgatgaggtcgtcggcgacggactggacggaggtgtgcaggttgagggcccgtttaggcaagtccaagagctgcaagacggaggagccatcgtcgaggatctcctctggtcgggcggcgacttgcacggggggttcgctgaggcggatggacagcttggagagatccggcggctcggcgatctgcactaggagtgacaagccatacaccacctcgtcgccgacgtggtcgttgcgcaggtaggtcttccgatctctacactccatgatcgcccactccgattcttccttgacggcttccttgtccagatgaaccacgcggtccagcacgacataggaaggtgcagaccccatggtagccatcagctgtggatggaggtgtatgaaggcgaaggggatctgcgagtattagggtttctctgggtagaccagtcggacgaggggaaaggttcgatctcaactcgacttacagccacagccgggaagggaacgcgatatggtcaggggcaggcagacatagcgcatatcgaatcgatccgaccgttagatgcatggcgacgcggatcgtggcttcatcgaacggctggtgtctagccccaacaaacacaacgggtgaccaacacctggactaggtgcaccatgccgcactccataattgagtcttctgggcctgcttcaaagcccctaggctcggtggccccggtgccaatataacctggcccgcctttaggataaataagttcacttcagatccctcaggttgtcaacaagtctgaaatctgtagctcaaccaaaataccaaatataatgcatccctcaacttaaaaaaaaaactgcaaataagataaaaacagttttgatgacggtttcatccaacgtggatggtttgatttggttcttatcccatgtgatgttgatgtggcattattagaacgaagattgacaaatttaattaaaaattaaagggacaattacttatttgagcctagtttatagcctaactaccaaattaaccctactcttttaggtttgctcatttaacccaaattgaccgtcttaaatttttttcatgaaaaatattatttttcatgatgttaaccattctattttcaaacttcacaacaagcacttctatgggggattcattaagaccttcacagttcatccagtataaggataacaagcacttctattggtgggggtgggggggggggttcccaacaatcacagtatgaccctattctgtgtaaaaggttggttcaagcacttcagagttcaataagcactactctgaaggttaacaagcttttatgttcaaacttcaaaaaggttaccagctgtgatcctgtgaaggcctcaaaggtaagcattttcattttgtataataggaaaaatagagggagaagtttacagctagaattccctcacaagggtgaattcttctttacaacgaaaaaatagttgcatgttcattacatcatttagcattcagtgattttttgagggatcgaaggacaccccacatgacagttgataaaaagaacagaactaaaccagtgataatggcatacttcaaaccaagattcataagcaaatttaccaacagtcctgctaagacaacgcccacgaaatttgctgaaaaacctgaccagaatggcatgccaagaaccgatgaaattattgccccagtccatgctccagttccaggaaatggtacagccacaaacagcatcaaaccaagccattgaaattcctcaacaggtgcagccttctgccgcgcccgctcaaagagaagatccataatccgagttgcagatgcgcttctttgagagagaaatgctgcaagttttttcaggtagaggataatgaatggcacaggcaccatgttcctggataataacataatggcatcagatcctgaattgtttttgtggggatattctgtatatttacgatgaggcattttccaagagatataaccaaattgtttattagtactactgttataacttataactagcagtttctgttctaggtgtgtcagtgtcactgagaaataacttcatgtgtcgtcgactcatcacaaattaacaaccctatcatatcacaatacaaaggaatactcagtcaaatattaaatttagttgctgccatttcactgctttgctctcttatgctgacaatgcttcaaattactgaccttcccatgtaggaggtccaaatttaaacggtaaacaagcgtgcatcatatttttatcccaaatgttcattcatagattgatatttacacataatctgtcacgttgatcgaatcagcactgatcagttactatatgcagtttctttctttatgtatagtaactgatcagttatgcataaagaagaaatggcagaaaggtattgttgctggaattgctgctgtccagaacaaatcagaaccaatcaggaactatgcataaagaaagaaattgcaaaaggttcttgctgctggaattgtgatccagaactgatcagtcactatacatatagtaaaatctaactaaaacatgtgctgttgtttaattgctagagcctagaagtagcatcagtgactaaaatcagcatggaattgcaggtttgcagttatcatttccaggttatcctacattgtgagtttattccatcattagtttcagtatacatattccattacccaggacctaggtaaatcaggctagcatatttattcataccatattattattttacagtagacccttactttgtttattcatcaaactgtgattttgatttgtggactgtgtgaacaaagcccaaaatttagatggttctgcaaattagcaccagaacattttgtaccactgtatattagcactacattttctaagagacataaccaaattgtttattactactattgtcattattagcagtttctgttccaggttagtctttgtcataactagcagtttccaaaatgtttattagtattattgtcaacccatcacaagttcacaatcctatcaattatcacaatgcaaggactactcagtcagatattaactttagttgctgccattcaactgcttttctcatgtaggagtgcaaagttgtactgtaaacaagtgagcatcatctctattctcaacaattcattcatagattaataatcacacataatccgtcacaatgattaaatcagtactaatcagttactatacatatagtaaagaaagaaattacaacatggttcttgtcgctggaatggttatccagaacaaatcagaactgatcagttaaaacctgactaaaacttgtgctgttggctaattgctagaagtagtactctgaattaaacacttaagtaaaatcggcatggaatcgcaaactcgcagtcatcattttcaggtatcctacattgtgagctcattacatcactagtttgttgacctgtaaaaatgtgataatgatttgccggacgtgtgaacagaagcccaaattttagatggttccaatacaaattagctccataacattttgtagcaatgaatattatcactatgttcaatcccagtgtcacaggcaattcagcgaacacctcatgggcaaagctcgccaaaaggaaaaaggtaagcaagagagacaaacccgagaacggataggacggtgaggcggatggggtcgaggcgcatccagtacccaaccggaatggccccgcgcagctcgatcaccggtagcgtagcgagcgtgaacacgacggcctcgtccgcccacccgagcctccgcagcgacgccgccacacgcagcccgaagccggacgccttgatcgagtcctccgccgccaccgccgcaccgccgcagcagagcacggcgcaccccagcgcgcccagagccagccgcctcgcgagcgcgccccagtctggcgccgtcgcagccgtcgcatcccgctccgtctgtccccacccatcggcgccaccagacaccgccccgtccccgcgatggcgcgagattcgccggtaaccggaggagacgccgcagcgctcaggcggagagcgagcctgggatttgtcgctccgcgagctgcacctgcaactgccagaagaggcggcggcggcggaggcctccatctccacgacgcgagcgcgagcggaggaggggaggaggaggacgaggcggcgagaaccgacgccgccgccatggccatctggatcgaggaggaggaggaggaggcctctcgcggatcggattgagcctgccactttggactcgatttgattttgacggttgttacgaggcaacgattcgtggtgatgcgggaggaggagaccccgaggctacctgcggctgctcgctcgcgccatgggagggaagaggaaacgggtggcgatttgttacactgagaggtggggccggaaaggtgtgggcccaccgcatccggatgtaatagctttttttttttttttttgctggttttggtggtgtgttgatccagtcgttatcaggttgagcgaatcaaaatcaacagaaggaatgcagcaggtaaaccgtcaaaattaacgactaaatgaaagaattttcgatggtgatggccactgctcgctacagacaatcagagattcaattatcagttcttgaacgggcaaaaaaaaaaacaaatattgcttctattgcggaaatatcaataaagaattgaatatgatcagatgatgactcaagagcaacaggcaattacatttccattcccaagtatcacaagtttattgtcttaaacgcgtttactcccacttcacatcgaattttgcagcatttttaagaggacaaccacagggtctctcactcctagcaccgagagaaaccagagcctggtactaaatgaggaatgcaggcataagtttgggatttaggatgaggaggatgaaatgaacatgttgactttcctctccagttcatccttcttagcaccaaccacgcgactaacctccttcccgcccttgattaacacaaaggtcggcatggcctccactttccattgcctcgccacttcctgcaaaattcaggttcaccaccattaacaaaacatcatgttcttgttatacaagaataaaagaagacgaaacactagcggtgtgtgctcgaattgccagacaggcttgcaaatggaattcttaagaaccttttgctacaaaccaaacaaagtacaataattggtctgcagttacatactttataactttataaatcataatcgggacgtacacatttgatgcatccaagtagtgcgccacatagacccatcattcccgcccagctatttattagtgcattcaaacttgcacaataattttgttgtggagtttgagataaatatgagaggatccaatactcaatgatgcaagaatttgtttatgcagactggctaactgaaacttgatcaataatttgctctaaattctactagttgaactatgtaaaatgcacaattatttgtggtggtggatgaacctccacctctgatgaagtgataattcgtcctggtatgctggaaccaaacaaatattctgttaggtatgaatacaacgatacttccatgattctaggctgtaactgaacaaattcttcttatcctgaacaagtccccataaatcatgaatatttatgatgcttgttatggtatcatcttggagtactctacaattccccataaatcatgaatatttatgcttgttatgtcatcatctcagtccatcctacatcttcccaaaagatatacaatgcgctctaaacggatttggtctttgctttataaaccataattgagccatctattcttgatttgatcttgcttaggtgaattcttagaacattatcaagtcgaatcactcaaaccaaagacaagttcatccagacccataaagctagatactgtttacagtacatataaagcatcctaggacaatgcaagacagcaaagaatgtcatcacattgaactccatagtccatatctggttctagacttctagtggccaagcaactatattgcttaaatactacggcaagaaccaaattcatgtgaaatcaaacatctcactcaatacaagtgcgcatgccagccgtatgcaaccagcacgatttctcagaaattatgcaaaatttctatgattttgaaccagctttgaactaaggcgagagtcaactacaagtactgtactaattagtagagtagatagtaacataataaccaatataactcaaattctttcccccttctaactctgcagaatctgtcgatttggcaccgaggtcaagcaaaacaaaagaagaagaaaaaaaaaagcaagacatgccagggtcgtagcaaccgtaccgaaagttcgtcgacatcgatcttgaagaagacggcgtcggcgaagcgtccggccatgtccttgaaggccggctcgatgaagcggcagggcccgcaccaggtggcggagaagtcgatcacgatctgccgcgcgagcagtagacagccaacacacgctcagatccaaaccagcactcgaggtcgaggtcgatcagattgggggggaaacagcgagagcggagctcaccagcttgttggggttgctcttgtgggcgccccactgctcgtcccaggtggccgtggagtggacggccaccacgcgcgagtcgccgccgtcgtcggcggcgggcggcggcgtgaacatcgtcgagaagaaggagcccatctcggtcgcgtgcttggtttggttctctctctctctctctctcttttctcgccttgctcctcttcgcttcgcgtgagcgcaagcaacaactcttcttgttggtttttgacttgtgatgagggaggagagacgactctttgtagtcttgtggagtcacctactcctcttagccacagaaaatctcacgcccaattttactatcaacggtccagattaatcttgcaaaactaggccacgtgtcagtaacgaaggatgaaaatgatatgaaaatttccgacaatcatttttgtaaaaaataaaaagtaaaaaagtaatagtttttagcatttctatttagtcatttataaaatttagttttctgttttctatttgcatattgaaatcgacaataaatagttaatttataaaataaaaaatagaccgttttcatcctatcgcgtgcctttttaggtttcgttcaatcttgaccgtccacgtgtccaaacaaagcggacaacgatgaccaaccactgactcagacaaggggtggattgtggtgtgccagcatctgaactctgcagatgtgtaaagccaagttgattccagacttgcacgggtatatgcttcgaggacacaaggaaatggagacccaaaaaggctaaagaacccaatggtttcttgccaaggtgcatcctcttgctgtagtagcatagatgatagaaccaccacacttttttacatttccaaccccactggtcggcagccatctacaatttacatgacaggaaagaatgaataaatactacggagaagcttttgttgctgcaggctgaggctgcagaccaaatgtgctagcttagctactggacatgaaggattcatgcttcatgaaccgagcagaagagagactacttgacactacatgttacacatttacaatctaggcacacggagcgagatgagcttccatggtggtatcacatcctacttgaaaaggagtagagcagcacaacgagcccaccctgtgagcgctgctcactcaatgatctccactagttaccagtgacaatgtggcattgagcttctcataaggggttgctgaacaaaaccagttaggatctagtgctccggcttcggggtgcgtgtgacgaattgcgttacagcatcctggtttacatgaaaaatgaacctcatatcctttatctgcagtaaacatcgacagatcagtaaggtgagcgtgagtatacttgatgatgaaaactaatgacattttcagtgaaacatctttcaaacaagccaacgtgaactaccaatatgtactaacctttccaacaattaattattgaaactcagcttatgaatctatgaatcatcattatatctctgaagattattatgagtgctacaccaaatgctaaaataaatgtaaaaggagctaaaggtgagtacttacgctgaaaggcccaataagattaactgtttaacatcagtattttggcatgtctgacgaataaggccaagataaaaatggcaaagggaacatttttaacttattccattatatatttgaaatgtatgtgattatctcaagtaaaattttattttgattcctgagcattagccatttcagtctggtctttatatataacaagcataacactaggcacgtctcatgatacatcgtggatcgagtataccaccacatgccagtcagccagtaagcggtgcaagctgtggtacagtggtaccctaaacaaatcatacatgttcaaattattctaagcactagtactaaaattgtgtagcacatcaaagttaagtatggaatggcaatccttcttgctatctggcataataagaatatgaacagttcaataaccgccctttcataataacaattttcactaatggactccaggatctggtaacacttaacaacaaagcatagtcaagattttcttaaatatctattttccatagtaattacatggataatgaaggatttcaaccatgtttatcagtacaactcattccaagttctaggaacagccatacgtcatatatatcacactgaaagttcaaagaatataaatgcacatatgcaaatttttataacatatgaacacactactatcaaaagacaggaccagaacaattactacagggatcatttcttaatcatgaggttacaaattaattgtgtaaacaatgaggtttgggtagtttactgcttttggttcaatcagtgataaatgaaggaaacaggaaataccagtacctcaattaacgaatctgaacttaagatgatgcgtttgcagcttggtacttccttgctattaacaaaaattgaacatttcccaatgtttttgatatgaaaagaaccagcttcatccatcttgataaccgcctaattttcatagcacacatggatttatataaacacaaaggcccaaagaaaaagagaaaaagaagcagatgtggtaaaacataatcccaggataagtttttttagggtactgcacgagcaaacaatgggggttaggatgtaatcagataagcctactattaattacatgaaaacagttgctagtttaagcagaacgacataatccgatcaagcactagaaaagttatgctgcctagttgtatgttgtttaggaccatttccatgattacagacctgtagttaacataaatgactggaaaatgtattttaaattagtcataacaactcactaacctaaggctcagaattagtgataaatcctacctttcatcatggatcgacgctatgtaattttcttgcttgtacaaaaaccatataaatgtcccatattttaatgtaccgtgtgggcctccctcactgttttacagtaaaaaaacaactcactaaccaaaacattaaagacaccagtttctaactgaaaacacaaaatcatgacattcatgattaatatatatctggaactgccccataaaaaaaagccctagatgaacataaatcatccaccactagatatttgaaccccaaatatatccaatttgataaagttgacttcacaattcgagcaaacattatggccagcatgagaacaacattaatacatgatcaatgctttttttactgtcatcaaggctgcatagacctagtaggctggaaattggagtaggaacaaccataggcactaacaatacattcaccttagaacacaccacagcaaagagcatccaatcaaagcgcgcatgaggaaaataagaaaatataaatttaacctcctccaattgtacatgacatatatgtccttgccttttgtaactcaagtagtcaagtcaactactattgggcattagatgcttttaataagttgtagtttaagtctcataatgtaaactggaggatacgagcaaatacctgtctacgagatattttgtttg

SEQ ID NO: 59286 - DNA, 1750 bp, Oryza sativa
ccaggggtcctttaaaaaaaaaaatcaagccacatttttattttattttattctgggtcaaaatggactttttaagcaattgcatcaatctgtattagaaagtattaagagcattccccaggtatcacacagtgccaaaaacttcttgtgatagaagttgcaaggggttgccatgatgacccctattgtttgagtttccctaatataatggcaactagtttcagcaaaatatgaaatggtcaaacaatcagttttgatcttaactagaaactagtacctttaacatagcatacgaactacaaatattcaatggatgtttagcaaccatgacatttgaagacccagttgcatttcttacttcttcgccgctccattggtacttcagtgaactgcgaggaaggagatgagtattgagtagagaaaaagactatttgacaggtcaaccgttgtatcacgagaaaggttctgacctacaaagatcatataaagcaaactcagagctatcaagtccagacaactgccttctatcatgcaaagaaatgtcaagctggtgacacaaaaacacaatatatgcaatgtcaatttaattataattggatgtgatttcagctttgaaaaggcctaagaaatattttaaggcattattccaccttcattgttgacaagaacttgtagatggcactctgctcccaaaaaagaaagagaagtgtcagcgctttaacaaaaggtacccaagttcttcaaatcagacaaatctacttcataacttaagatggactaaatgtgacactatcaatctagagcatgatgagtagaaagtattgacatgtttacatttcagttctggtaaccaaaaactttaagtaattagtttaccctagatatttaagaaatctaaacatgccaagaaacaactaatacatacatcaggtgtgctgttgaaatcaccagcaagcacgataggaattccaccccatttttcagcaagagcatttgccttctccagtagcatgcggatctgaacggacagataattggaaacgaaaactgcttagcaaacaattagtcgagtaaaaagtataatatgttgaatagacatagataaagttgaggtatagtttcaatggtgcatcttaattgcagtaaaaatatagtgcgttgaatatacatagataaggttgaggtatagtacatatggtgcatcctatttacatcagcatatatgagcattatgcagtacatcagtgattaacatgaaaaaggtccagtttttgtccctcagtactttacaccctaaccttcagtaatttctaaaagatgtcattcaacaaataaaaaaccatgcacatcacatcctggtgatagttttgaaggaggtttatatggatcctacatggtgtgtgcccgtgtgctagtgaggtaatgtggcttcataatttagaaaaggaaattagttggaccattttccagaggacgagtggataccatgcgtcaaaataaaatgatggtgcagaaaccacataatcctatgcacaaaacccaaataaaaaaaaagaaacataaacagctttggatgcaatttgctccagttttaacatttaagggaaaaactaaaagttattgaaaaacatggtgaaaacaactaaattaggctccagtaatagttgaaggaccaaaagtggacatttacaatgaatattttgtgcaggcgattttaggacatgatagagaactggacgaatgatatacg

SEQ ID NO: 59287 - DNA, 5836 bp, Oryza sativa
  unsure (1)..(5836): unsure at all n locations
attgcagtaaaatatagtgtttgaatatacatagataaggttggggtatagtacatatggtgcatcctatttcatcagcatatatgagcattatgcagtacatcagtgattaacatgaaaaaggtccagtttttgtccctcagtactttacaccctaacttcaagtaatttctaaaagatgtcattcaacaaataaaaaaccatgcacatcacatcctggtgatagttttgaaggaggtttatatggatcctacatggtgtgtgcccgtgtgctagtgaggtaatgtggcttcataatttagaaaaggaaattagttggaccattttccagaggacgagtggataccatgcgtcaaaataaaatgatggtgcagaaaccacataatcctatgcacaaaacccaaataaaaaaaaagaaacataaacagctttggatgcaatttgctccagttttaacatttaagggaaaaactaaaagttattgaaaaacatggtgaaaacaactaaattaggctccagtaatagttgaaggaccaaaagtggacattttacaatgaatattttgtgcaggcgattttaggacatgatagagaactggacgaatgatatacgggaaatggatgatgctgaagttaactgatatatatacctggcccagttttacatctcccctctttggattaaaaaggacatgaatattcccaactactaacttttgtgctctattaagctgaaacgaaaacaggtaaggaaaaagacaataattagtgcacccaatgtattagcattaaaacagtagttacttaattgtaatgcaaggacatctgaaaacaaataccagattaaacagatggtgctaatttggaaattattttggacacaatatttggtctggaaactaattttaatgcataatatgagctaatactaaaatactatgttaaacttagacaagtgtaggtccttctaataaagataaggctcgtagatagtgtccggaattggggatgggaagaaaccgacagagaagtatctaagtcatcccttctctctagtttcctttagttttacccagcaacagggctcaggacaatattaaataggaaagcaccatttctggaacacatgcagtgattatacactaggtgctgccaggatgtaagtgatatactctccttattttatcctttgaacaaactgctttattgtaaaccaaagtacctcaaaaacaaatatttgagcaacattattacgtaggttgtattcactaaaatcaatactgtcttcctcaagcagatgtaacctacatttggaaataaagaaagaatatgaaaatgcgacttggtttaaaccaatgaaggtaacaaaggataaaatccattcaccatacccttttgacttccaaaaggtagcacatccatctttagcatcaccagttcggccctaaggatgtcaccagacttgcttcagcatgatgtacatgaaggttgaaaggtggcattctgacaaaaatgttataccttaaatctactttgataacccctgttctccatttctgtagcaatgtctcggaatctatccacctcctaatttcggaatcacaaaatgttataggagtacggtcgcacaagtggtataaacatcatgcagattgagttctgacctgtagacacactaggtcaggatcccagtgtctaatttcacgaataataagcctcctccgcgaatcccacctcattgcatcccaagggacatccaaataaaggtcaggatggtaatgtgcattgttatccgccaagatgttgtatgacatgattgtgcacgcatctgacaaaagctttattactcttagtattacactaacaaagccagaatggcatcatcccagagtaatacagctccatcaacccaaacagatgcaagtcaaacaaaaaggacgaacaaaaatcacaactttaggggtgaaattggcactggttggggcgaagcttcatacttgcactagctgggtcaactgatttctcactatttactctagcaaaactagcaaagagaaaaaaaaaagaagcaaaagtgcaatcttcactcagacattggcacaaacagatggtgagcaaaggcaacaaaatttcaccaacgatacatccagcataatacctccgtcggaggtcgaggcttcctccgcaaggacccacctccgggagggcaccccgtactgctgcgcgcggtgccgctgataaacgcgaccaggcgagcccgcggcagggctctgccagcggcggcggtggtcgcgcggcgcgccgtttccggaggacgagcaacgcaccagcgagcccgaggccgggggagagcgcgcgcgcttcctgtgggggtgcatggccggcgtcggcggcgtgagccgcgatcgcggggcggcggacgccatcgccgccggcgagatgtggcggtggggagacagggaaggaggacttcgggttttcccttcctttttttttctctctctctgatgaactctgttattcgggtttctcccatctagggtgtatcgaaaaatctggaccgtgcatccgctgatggacgatacaaatgcactgcgagatgtgtcgcaaatttgcaattcgtttgaaaagataaagtaatttttttttgtttttttggtgttgaaatcaagaaatttgttctgtcatgtactcctccatttgatattttcattttttttccttttttctttacaaattaaacataatttactaatattattgagaaaaaattggttatatagcatcgaaagttcacgtttttggttttatatgtatttatatcaagggaggtataaactgtataaataacccaatcacatttaggaaagagaaaaataaagagaaaaggccaacatgcaatatgacatgactagcattggtcattaggcttgtattcagtgaactatttgagctactgtcttcctaggaacatcagggtttatgtttcgagggaagaatatcaggatttggtgcatccataaagtaaaaccacatatattgtaatttgttttaaaagaattttaggttttaagagtttggggggggtttataaaatacaactaaaaagattatgatttgtttaaaggaactctaggcctgttcactttgatgccattttcaaccttaccaaattttgccaaattttggtaaagttaccaaaaaaaagtagctacatttagtttgctaccaaattttggcaattatataagaaatcctgccaaaattttggcaagttactaaaattttggcaactttgccaaaatttggtaaggttttttttggcatcaaagtgaacaggccctatgttttaaaagaaaaaaaatgttccgacaaactctatatataaacttataccatcgatttacctacatatttatctataatattattaaaaaaaaattaaaatacaacggtatcaataataggaaccggtgttctcttaaaaaaaatttcaagtgtatgcaactacaaacaccatcatttagtttatttaaggaataagtcaaacagcatatttacaaataaaaaataatttgtgaataaaacttttttatatacgtatacttagcgatctaaaaacaaaaactgaaaaataaactacgatgaaaaaaactcaaaatcaactccaaatttaagattgaaaaaataaattttaacttataagtataaacataagcgaaaagatgaggatgtacacttttattcaataacttaaagaacgcggacataagccaccattaaagaatacatttacagtttcacacacttgacaaaggcctacggtatatccatgaaattagggaaaaaagaactcctgtagcaaatcacacgtaagttgcttcccagttaccatcgcccgtaacttcatttcagatgcacttacacggttacaccccaacaatacgcatactgcataacatcttccgattcccagcagaacatcaagattagaactattgcaaaccaaaagcaacttgaggatatcagtcgcggttattcatatttacaatgttctgatcagtccacgaccaaacagtttgcatattggaaaagaaaagaaaacatacacgatgacaagcatacagtaactaacaagccaggaaaagcacgcatctccattacatgtttgaagaaactaacgacatctgaaagaagctgggattgaaccaagaacaacaaactacggagttttatgcgacgatagaaagttaaacggcagtggctgaagcaacggttttgaccatgctttccccaagggctggaccaaagccgttatccaagacaggattggcagaggcaggagatttttgtagagtatcttcatatgcagcatcatgaacaccaagagcagcacgaccagatggatcaaggtttttggaccaggctgcgtcccattcaacagctttagcagtgctgcacgcgacgctaggacctccaggtactgtcaacctagcagcattctgcataaaaccgaaagttaattagctagggcatagctcagcatagtatgagaacagcaaaagttgatagtatcttccatgccttgggaaagaatttctcgaatattgtcctataatagtacgcttcttttgtaactggagtgttttctgggtaaacaaagctagcgttcatcatcatggaatctgatacctgaaaatgaacagaaaaatatgtgaattccagcttaggtcagaagaaatcaaacaaactgtaggctaaaaaatgaaaaccgctaagttgtcaatagttttaaaacagagaagacagtatacatgttcatttgcatgatccttcaatccatcaatccaactgtacccaacaccatcactgaattgctccttttgcctgtatagaatgtgctgtgcaagacgaataaattataagtttaagcacatatggaagtttatgtacattataggtcaaatacgactcaaaaagtttaactttttgcaaccttaggtaaatagggcttctcctcatcatcaaatgcattccggagaacccatttctcaatacggccaagatcacgttttatctaaaatttacaggataataagtgttagaaagtgacagtactggttacaatataagaaaaataactgcaataaaagttgatgtccggtgtacataccattttccattcaggatcaatgtccatagctacattgatgaagtttttgtcaaggaacggaacacgggcctcaacaccccatgcagaagttgatttgttcgctctcaagcaatcatataaatgaagggcttttatctaaaggtcaagaaaaataattcttgtaagtagaccagctactgtaatgtgcataaacaccaaccaaatactagttaagtagttaaactaaaagtgcaatagtatactactgaaaatgcttcaagaatacatttagctgccttgggcagaagaagattaatcatgaaaatattctccttaattaccttccgacatgtttcctcatggaattccttcttgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttcctncagtgcatcaatgccttcctggtttcattttttttttacaatatngaatcagagcttcaaaagaatttttttctcactttgccaaaaaaacagagaacagatcagaacctgcactgtgaagtggagttcgtgatgaacaa

SEQ ID NO: 59288 - DNA, 70423 bp, Oryza sativa
  unsure (1)..(70423): unsure at all n locations
gaggaactgcgcgatgggcaccatgaactgctgcaggtcgggtcggaacacgccgtgcgacggagggaacgagttggtgatcacgtccatcttcaccgccgtcgacaccttgatgctgttcgagaggccggcggacacgagcgcgttgtacaagttctgcatggccgggaggatggtccccatgtcgccggggccgagctcgttgccgacggcgatgtaccggatgaagacgctcggccagtaggcctggacgttgttccggacccagtcggcggcggcggaggggttgttggcgaggttggccaccgcgcccttgtcgccgacgtcgacgatgacggcgatgccgctgccgcggagcgcggcgagggcttcctggtccgggtagtagatgcgcatcgcgctgatgcctttcgacttgtacagctgcacgacctcgctccgcgacgggaggttgttgccgacaacgccatagcagacaccgtgggcacctgcatgattaaaaatctaaaattaatcgatgaagaaaaaatacagagagattgaattgcttgagaggaattaattgcttgttgattagcgaacacaattactagttgattagcaatagattaacgcagcatgcaagataagaggatcaaaagaaaaatgaaaactgaattaatgtacctcccatttgctcaaattactcagttgtcggagatgctcaaatctgaatatgtatgcttcaatgctcgcttgtgatcgtcgctagggaaagaatgggcctccttatatactgtgagatggtgcggcttttcgtatcagatgatctataaacaaccaggtggcacttcgaacggttagtacttagtagttagataggtttaattatatttatctctcgaaaagttgtaattgtatttgccgaggatttgcgcgcaaacctcacagttcagattaagcttgctcattactatttcttgcacatttgtttggataataactaaactatttcttacacatgtggcttgcagtattaggttaattaatctaacggttgattctccgttcatcattaagcttgacgaatgatagtgttgtggcctcatcgtggccacgtaagttcaaacacaatgtcaagccgcctcgttttgttttaagataagatgagctggccgtcatgactcgtacctatactgatgatcaggtcaaatatacatgcatgtgcgttctttgctactgacgactgacgagtagtgacgagaggcatgctcggttttgcttgcccgcgacaagttcttcgcgtggctatctgaagatcaccaacagcgacaccgtgaatgcatttctctgagtattcaatattagatatatttccaatattaatattaaccatcgacatcaacgaataagtagagggaactaatattattttagtgtagctagcttgcggtgtggttggtctctccctcttgctttcccacagtcttcgatgataatctgacatataaatatgaatgcatataaattgcgtgtcaagatgagcattagagaacactgtctaggggaatgtcgtcttgtcaaatctctatgttgaaacaattccgcatatgcaagttttatgccaagctggcaagctagatggcttgctgtgtttatatatctgagctggttaacttgatctgcagtatccgtgacccaacttaattgtcgaagaaacgggtggtcagacaaaattaagcttacaaggctgggcattcatggcatggggtgcaacgtgtttagttttgattggatcacgacgagcttgtggttatcttcttattgggacctcatagcctgagaaatatttcactgaacttgccttatattccgctgaataggagcacatggctgagttttggtacctcctaacctatgtaccaagagttactaaattaaaaaatagtacctcctcaagaaatataaaattgctcatataacaaacacattggcaattaagcctctatggaatatggtaatattcccccatgatatgctatgccattgatcatcaactcaatagtctaattgattgattatactcttaaaaaaaccagttgattgatcaagcaaaacgaagatgtccattccaagtgggatctgcattcttcttcttcttgacaattggcattttgtataagccgttttacctttttttttaagaacaatagccggcttacctagatgccattttacagattttttttatttttatttattaaaatattttaaaaataattttttatttacaaaactaatcgcccatcactctttgatagggcaacttttaaaaatcacccctccaaaggacaatttatccaacatggcagacagccgttggccatcgcctaatggccaaccaccgaggacgccgaaattttgcaggcggcccctttgacgctagggctgtcaacgagccgagctcaagcgagcttgcctgcctaggttcgagctcgagccgagctcgagccgagcctataaaatgttcgagctttcaaacaggctcggttcgagctcaatcaagctcgagctcgactaccaagctcgatttttaattagaacagtgtattttcaaaggataatttttttaaaactatttaatttatggtttatcatattagtagaagaggaaaagaataaaataaatatttgattccaatataagacatacaaataacatatttggtctactaatttattaaatagcaacaaaaaatcataaattactaggctcgttagaagctcgagcttggctcgcaaagctcgtgagctttgggacaggctcgggctcggctcgtttggaggtcgagcccgagctcgaatcgagcctaggatgagtcgagctcgagcagctcgcgagcctcgagcttttttgatagctctatttgccgccctcacagagggcggtttttggctctaggggggcgcctgcaaaagggctaggagggtggccagacttttttgcagatggcccccttgccgccctcacagaaggcgattttacactacgcaggggaccgcctgcttaaagggcggcaggagtttgccactccccttctgctccccctcactctccctcattttcttttttttttggattttgagtgaatataatgaaaaatcagagagggagaaggagttttatatcccgcaggggcataaaatcgccctcacagaggactgcaagggagccgcctacagaatgacaggccgtcctcgctgcccttttgcaggcggtaaggggactgcctgcaaaaatgctaggctgccctcgccgcccttttgcacgtggcccccgcatagtgaaaaaacgccctcccagagggcggcaaaggggccacctgcaaaatgcccctccctcggtggccggccatcaggtgaggggcaatggacgtctgccacgtcggataaatcgctctctgggagggtgatttttaaaaatcgatctccatcaagatagcgatggggcgactagttttctaaatttttcaaataattttttaaatattttaataaataaaattaaaaaaaatcccattttacgtgggcagcatagtactgatggccttgttttgggctaatccattcggcccatggatttgttatgaatgactttgttccgttcccataaacaggaagagttcatgacggattagtccaaagcaaggccctcagtgctgctatgctgcttatgtccctatgactgatgaacaatgtccgatatggtgtaattcgatctcgatatacagcttcagaatgcacaataatctcgtcatgatccaatcaaagcttaaacaccttgtacccatgaatgatctgccttctagcttttatctgaccaccggtctctgacgattaagccatggattctagatcaaagttaaccagctacttggagaaacatagcaggcaatcttggcataaaacttgcatacatggaattgttccaacatagagatttgacaaggcattcccctagatacttacacagtgttctagtgcgcatattgacacgcaatatataacataaatatgcatttccttctgaacttcagattgtcatcgacgactgcgggaaagcacgagggagaccggccggccaccacaagctagctacagactaaatcaattaatttcatctgcacttactcgttgatgtcgatggctaatattaattcgaaatatctaatatatgaagtactccacttgacaagatcagagaaatgcatgcacgatgtcgctgttcttgtcactgtcagatagccacgaagaacttgtcgcgggcaagcaaacaagcatggctctcgtcagtcgtcactactccctatatttcgtattataaagagtcaagtaccataaataaattaaaaactacatattcaatatttaacatgatgtacggtaaaaatacatatttaaaacttaatttatcgcagaacgataaatttaaagtataataatatcacaaaactatgatttagtaacagatttatcataaaattatagatttagtgtcaatttaatcataaaacttggatatttataatcaaacataacattgatgtcaaatatttaaatcataacattagtgttaattatttaaaccataaatatgtagtatttttttgcgaggataaatatgtagtattgtgataattttattgttaaatatgtagttatacgatacatcaccttaaatctgtaattttatgataatttagtcaaagtatatgtagttttgtaaaatttattctattataaatcgtttgattttttttctcaatcaaaattatttagatttgtccaaatttatagaaaaaattagcaacatttataacaccaaattagtttcattgaatttaccatcgaatatattttgataatatatttgttttgcattgaaaacattactatttattttttttgtaagctttagtttgactaagaaaaaaaattcaagtgagatatagtataaaacgaaaggagtagccagcacggtatatacttgatctggtacgagtcattatggccagctcatatattatcttaaaacaaaacgaggcggcttgacattgtgtttgaacttacgtgcccaagatgaggccacagcactatctactcgatccaaacacaagaagttccatgcatgttaatcgatcagtcgtcattcgtcaagcttaatgatgacaggaaaatcaactatatattgggttatccaaacaaaatgtgcaagaaaccttactggttaaccgattgaagtgtctcattgacaagaggaagaagtcacgccatcttgcagtatataaggggggacattctttcctagctacgatcacgagctagcgagcgcgagcatcgaggcgccattcataattccatctccagatactgatcaagcagatcagagctcgagttatcatagctatttgatcaaatgggaggtatattgagagcttatatttccgtttccttttctctttcatgctgagctgatctattgctaatcaattaactaaccctctcatatgcaattcgatctctctctctctttctctctctcttgctattttatttccttacacatcaattaaatcgtctgatttggtatcaacatgcactcctatgtttttgcaggtgtccacggtgtttgctatggcatgaacggcgacaacctcccgtcgcagagcgaggtcgtgcagctgtacaagtccaatggcatcggtgctatgcgcatctacagcccggatcagaaggccctcgacgcgctccgcggcagcggcatcgccgtcatcatcgacgtcggcggcatcggcgcggtggccaacctcgccaacaacccctccgccgccgccgactgggtgcgtgacaacgtccaggcctactggccgaacgtcatcatccggtacatcgccgtcggcaacgagctcggccccggcgacatggggaccatcctcccggccatgcagaacgtgtacgacgcgctcgtgtccgccggcctctcgaacagcatcaaggtgtcgacggcggtgaggatggacgcgatcaccgactcgttccctccgtcgcacggcgtgttccgcccggacctgcagcagttcatggtgcccatcgcgcagttcctcgccaacaccatgtcgccgctgctcgccaacgtgtacccctactttgcctacagggacaacccgcgcgacatcccgctcaactacgccacgttccagccgggcaccacggtgagggacaacgacagcggcctcacctacaccaacctcttcagcgccatggtggacgccgtgtacgccgcgctggagaaggccggcgagcccggcgtccgcgtcgtcgtgtcggagagcgggtggccgtcggcgggagggttcgcggcgaacgtggagaacgcgaggaatcacaaccagggcgtgatcgacaacgtcaagaacgggacgccgaagcggcccgggcagctggagacgtacgtgttcgccatgttcaacgagaaccagaagcccggggatgagaccgagaggcattttgggctcttctaccctgacaagacgccggtctacccgattacgtttcctccgaactagcggctgaccatgccagtgcaaataaggatttccagagacgaataatccatgattaaataatgttggttgaacgttaatgcatgtactctgtatggccctttttttttgtgacaatgctacatgaataaaaaattccaattttattttatttttttaaaaaaattcaggatctttttatcggttgatgacagcagcctgctgtgactatatatcggtaccatcttgtgccaaacagatggcacctataaacagatagacacaaacatttccagcttttcagttcctgaagagaggacacaaatgcagatcatgaacgcagaatactgctccaccagctcggattaattatggccactcaagctactcccgcttgctgctactaattcccttcgttaccgggtggatgatggccgagtacgagatcaccgatccccggtgctaccgccgcacaccgacgacggcgaggaggacgacttctgggtcctctgccctctgccaccaagatcttccagccaaagcagcacggcggcgcaagcccgccgccgcggatggccggccaggctgcgtgatccggacgacggtggaggcgaccagagttcgattcggacgcacgtgagatcacgaggtttgcctcgcttttgtattcgactccggttatacttttgctttggaattgtgttcctttgctttcttcctcctccagcatctgctcatactatacattccgtgtgatggaacactgcgaatcaaatgggacatttgagatgttgttgtactggtagcctgatgaattcattgtctctttctgacaagccgcatatggagtctgttaggtgtttcaagtcgcggtttggtttcctctcactttctctgcttcaatctccagattccagcgggcagcggcctcgcagaaacagatatcaactcgattaatacaaaaatgattcggtcgtagttatttcgcacgcggaggaaatggaatcttttagaagaaaaattgcagaacggagtaatttcactcagatcaattccacgttttcctaatcggtgtcggtgctctactactactaggatgaaaacgggaatacggcaaaggatatttatcaaatacgaaaacggaacgaatacgatttggaacgaatacggtaacggatacttatcggaatataaaaagcccttaaattgaacttttcaaattaagaaagagatgtagctcaatatttttttctaaaataacaaaccgatatttatttttttttaccaataataataataataactagttgtaccctttactttcttggagaaaaagaactatattcatctataactataattataagtagtatgacatggtctaataaaaatttaaaaagtaatcatgcaaacaaatctaaattactggaactaaaaatatttctatttaattaagcacatcaatactagtataaacctaaacattaaagagtagagaagaatgaaactaatcagttgtatatgagaaatactcccttttcgattctaagaaaaaaaaatttgaattcatttcttgaaaatttccgtcggattacggtttccaacgaatagcagccttatcatgtttgtttctgtttccgagaaaaaaattcagaattcggaattcgtttccgtttccaaatgtttcgaaaaaattctgaccgacacttcccgtttccaaaaacacgtccggaattcggaaactttccggactgttttcatccctatctactactgctcgagctcaaccagcatttccagcttgttctaaaacataacacagatagataataatgggcctatagatagcgtgacgaggaggggataacttgcggcccggctaaaagagatggggattaaaccaattgggccgaaagatatgtccaatttggccgacaagctggaatgctgttcgagcttgagctggagcagtaatagagcaccgacagcgattagctatcgcatcaagcagaaacaggatgatctgtaagaaattactccgttctgcattttttttaaaaaaattccattccttccgtgctcgataattactgttttaatcacgtgatttcggattcaccaaccgcgacttgaaactgaaacaccaaaaaaaactccatatgcggcttggcagaaagaggccatgaattcaatcacgctatcagtacaacaacaacatcttaaacgtcccatttgattcgcagtgttcatcacacggaatgtatgggcagatgctagaggaggaataaagcaaaggaacacaattccaaagcaaaagtataaccgaagtcgaatcccaacgcgaggcaaacctcgtgatctccgccgtcggccggatcacgcagcccggacatccgcggcggcggcggcggcgggcttgcgccgccgtgctggcttggctggagagatcttggcggcttggggcctcgagctcttcctgacatggcagagaacccagaagtcgtcctcctcgccgtcgtcggcgcggcggtagcaccgcgggtcggtgatctcgtactcggccatcatccacccggtgctccgctgctgccccatctcgccgcgcacgtagaagcagtagttgatcctgcaccaccgcaccaccacgccgaggtcggtcacggactgcccgttcttggtggagctgtgcatccacgcgccaccgccgccaccgccgccgccgcagcccgccacggtccgccgcaccgagggcttcctccgcgcgcgcgccgagaagaagaacccctcctcccgcctcccgtgccgcgccaggagctcccacggcgccgcgccgcaggggtcggcctccaccacggcgcccgccacgcgcggcgcgaacccgcgcagctgcggacggaggaagtggagcatcagctcgtcctccgtcggctcgaacccgacgccgccgccgccgtactcgtcttctcggatcagattcatctccttccccattccgagtagtagctagtctagtctccgctcgaagtcaacagcgagaagacaagatgtggagatgaacagagacgggtaggggtgtgtgtgttcctcgtgagttctttctccggaccaccagtatttatctcgccatcgaatggagcccatcgtaagtgcgatgagttcttcagtccggaatcttcatattctgtgggctgagcccagccgtgtcggctcaggcctgaccgtgcttgggccgtgccacttcgggcggcccatttgaccatctatacatctccatacttttttaggacattaaaattttcatttttaagtacaattcaaggaatttaacgctttttagataatcaaggataatgttgaggtacctcggaaagaaaacagtgagcgatgtgcaggatcagtgtaaaggacctgctatgcttgaattttgagcttttacgtttggatagatgcgtattgacactaatcagtaatcagagacacaccgtgatactgagaatcaaacacatttctaacaatatgagattatgataaccattattactgatatttccatttaatcaaaatgtgtatgaattaggtataaaagtatacagccatttacacccaaatctaaaactaataccttcatgactccttaattcatatcctccaatatatccatcagagtagatcatcaacccaaccaaggcagtgtgctaccaaacaatccaaactacgatctacaaacacaacacaaatcaagaacacattttgacctgacctgacacgattcacctcaagaacacgcagttcttgtgatctttcgtgtcattttcttgctgctgcttctgctcgttggccttccagccattgggcacccaccaaactcggatgctcttgtcgagccctccactgtacaccatgcagccattgctgaccctgcaccagctcgcctggatgcatttcacggggccctcatggcctctgatcacgcccaccctggcgagggcggcggcggcggcgccgtcgccgtcgccgctcgtctgccagcgccacagcccgatggtcttgtcggcggagcccgtgaagacaaggtcgccggcgacgcacaggcagagcacggccatgtcgtgcgccttcacgtcgcaggagaggctccagcggctgcccctgccgcctaccctgtcccacccgacgacgtgcccgtccgacccggcggcgtacacgcggcgagccccggcgtcggcgctcgccacgagggcgttccacgacacgccgtcccgggagatgaggatgccctggaggaagtgcgccgccttgcctttcccccacgccttgacgtggccgtcggcggaggcggagtagatggtgccgctgtcggcggcgacggcattgatggcgtcgtcgtgggcgtggatcgactcgaggcacttgaggtcggagatgcgccagaccttgagcgtcttgtcccaggagcccgagtagacgacgccgtcgtgcacggcgaggcaggagatgctgtcggcgtgctcgatccagaggcggcggtggttgcggcgtgtctgcacgtagctggcgtggcggaagatcttgcccaggtagtccctggtggtgggcagcgcggcgacgagcttgaacgcgttctccgaccgccgcgacacccgccagacgcggacgcggccgtcctggtgcgcggagaacaccctgccccccgcggcggcgagcgccttgacggacccctccccatgcccgaacctcgcgaagcggcggagatccggctgctgccacgcgacgatgtctgcgccggtggacgcgctgagcaagaactccccgcagagcgagagggacgacaccgagccctggtggtccctcagcacggcgagcgccttgaacgagtccctcgacatcggcaacgcctcgacgacatccgacgggacggccgggtcggagaacgacgacgaggtggaggagaacgaggcgacggacgaaaaggaggagaacgatgcggaggagacgaaggcggaacgcgggagcaacggcgcggacatagcagcgcggtctgttggatcccgcaatggcattgccatggccgcgtgcggggatgctttcttgaggcgagcggacgcggaggtggtggcgagaatagcagaggctgcgaggtgttcgtccgggacagagaggccgaggcgggtggtttgaggcgacgacgacgactcgaccgagctagcgcgnncngnnnnnntnttnnnccccccccccccccccccccccccctctttcgagaaaacgaaaaagttaatggcaggtggggcccatgaggcaggggcggttcaacggctactaggcgcgggctgctttgtcactacggttttacgttttctattcgtcaaaacggaaacagatttcgtttgtttattacggttaggtgagtaggtctgatcgtttcgagcgtttgccttcatttcgcacaagtttgctgatttcagtgtttttcttgctgtaaactacacggtgataattttgaatctgccatcttttctccaattcaatatattaagcggtgaatccatggaaaaatttgcgggactttacattatcaaaacaaaattaacgccgaccaactgattgcacatgctaccatgatggaaaatacgcatcatataatcagaaccatacaagcacaataggcagtaaagcaagaaattagaggtcacatgagcgcactaagcataacactttctgtttcttctccccttattcggacacttgtccatgtttaaacaggcttaatgatgttgatgcagtatccagcaatccagcatcatgaagcactctgaacagtaacaacctgctacaacaatgggattaatgaatcagatgcgcattataaaaaccaagacagaatcagacacgcgaattatcggtgagacgttgacagtctgaaactccgaaagaaaaaaaaaaggctggtgattcgggttgttctagaagcatttgacagggagcccaaaatgtttcagagctcattactgacgaacattttcaactcgtgtgtctgattgcattagaggttgaaccatttttctctcgttttttcttgtatatgatgcacttgaagcacaaggcaagtccatggtttaggtagagcaagctcttgtgtactgccatcgttttagttctctatggctggaggtgccttcaaggctagttcttgtgtactgaacaactactgctgaatatatatacagtctactaatactaacactactattaatccaccgaccaaagtcagcagacagcgttccatagtgctatattcatatactacagagtactccatctgtattttaatgtatgacgtcgttgactttttaataaacgtttgacctttcgtcttattcaaaaaatttatgtaattatcatttattttactgtgacttgatttatcatcaaatgttctttaagcatagcataagtatttttgtatttgcataaaaaattgaataagatgaatggtcaaacgttggttaaaaaatcaacggcgtcatacattaaaatacgaagggagtgttagatttaattgggtaattgatccatttaaatcaattaaaccaaataaattccaaggctcattatgctaggaattcatgtgaattcattcttttatgggatatcaatgggatgaagagttttgagaattaatctatttgattaaggaattggtaacttatatcaattagttctaattgatggatggttgatggttgtgtagtggaggatggttcatggctagttgatgacaattagttgctctattcctcttcctattccatgactcttactcttcatcttccattcctcttataaaatgagaatggatttgatctcccgcgagaagaggaagacacactttcatccattttccaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcattttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattatattcaccactatcactggatcaaattccattgtaaatatcatgtttattatcttgttattttagattaaaatatgccgaattatgaccaaattttcaacagggagtatatgttaagcttctgaagcttctggcttcttctaatacatgcagtggaattagtactggtttattcgtagcttggcttgaagagaagatgcatcatgcatgtaatgtaagatgtgtaagctggcaagtttcttgcaaatctgttcacgtcttagctcagtagttcctttcgttgggacttggttttgaacagaagaaacactcatgccatggtgtaaaatagccaatggtgtttcataaaaagacatgtgcaattacagaagttttatagaaaagtagccaattacttagtgcgttgacagtacggacgggcagtcagagagcacccaatgggggtctgctgctatgaatttctgatactccgacgcacgggatcaatgaagaaaaggagaacgcacaacgccgctgctattgcggtaggtctaattcaaaaagttttcaaacatttttatatgtttccaagcaaaagttgcagtacggtagtagtatttgttcttgaggatatgtggctcacgctcaaagcaactgccgccctttggtcggagagagagcatgcaccttttgatcaaaaaggttggtcatatgttccatgacatgagtatacactaatcaatcttcataggagtaatttatttttgcttccaatgagagactagttgatcttccaatggagtagctacaaatcttatttttcttttttttcttatgttcagctcgagtagttgagaaaaataattcttatagtgctcacctatagagcctgtatcacaacgaggtacagaaaagctctgaaagtctgaattgctatgctttaagcaggcattgcggccataattcttccaaatttcgatgggcctaaccaactacctctatgttctctcgtatagtgtgtgataatgcgtatgactagtgcttgtttattttattttttttcacacgactgaaactctgaaactaaacaggccaagtcgccaagagatggagcagaaccgtaggagtacagagtacagacactaccattaaaaagtcaaaacgggccttggcaacgagatagatgggctcaaagaaattgggccctcttctctagcgtaggcccaccagagaattttcagccgggccggaagcctggaattcccctgaatttgggcccagagttgaaacagacaattcacaggggtcctactgcaaatatgttactacttcgtatcatatcatttgcaagagagaggaaaagaaaaaactcttaaaacaagggaaaggagaaatccaagccaatttgcgacgaaccctaaccgcccaccaaatcctctcctccttccccaacggcgagcgtccccggcgaatccgccttgacggaggcaccccggcgagctcaccttcccggaggaatcccagctcagcctcatcgtcttcggtgaggtacgcatccctttgtcccatcacttttcacccgtcaattgcagtccccgacctggtagaggaggggagcacacagccgacgccatagcagcagcaaatctgacgtgccgtccgcctccgctctgctgcgggcgtcgattctggtgaccgtgccatgtcgcgctcgatgtgctggccttccggacggccggcgccgccatctcatcccgtagattccgaatcagcgagaaacgtgtgttactcgtgtagggaggggaacgtgaggaggacgaacccctacacctacaccttaggagttttgtgcctcctcccgatgtgaggggaataggggatcgtgtttcctgggcggagaaagctcttattgttttctgattatacacaattctgagtagtaacacgtgtctactgtgtctgtgtcccttccgcattttccgcttagtgcttacagcccagttgaacccaaatcagattttgtactgagcaaaatccttgaaccaaacatcccctggaaaaacttgctccttatcttagtgagaaatgaaacatttatcataattacattggattatttttttcttacatgtgcattttctgtatggccacgtgccattgaacatgggaagtagatctatttttctttcaccatttagtttacattgcatagcaggattttatttatgcagacatagtatttatgttgcatcctggatagtaaagtaatactagttctacgagtatgaatatgaatttaattttcttaccaaaccatataaaccatcataccctagtgtgcttacttgacttcatgcgcaagaaacttataagtgtggattctcttcatatatctgtagggaaatatcttggtgattcttgggaaccttcagaaagaccacttaatagttttccttggcccagaaaggcttgaggcttgagagctgaaaagttctgctggagctagtgctataatggccacaaaacttgtggtaagtggacaatctttctctttttaggattctataaacgaatgtgtcctttcatagtttaatcattcatgaagaatgatgacatgagatttatttacttaggttcttggaatcccatgggatgtggacactgaaggattaagagagtacatgggcaagtttggacccctagatgattgcgtcgtcatgaaggtttgtagcaatttcatattcagaataagatattagatgccatattctttgtgtttattacatgccattaagatttgaggagaatatgtttcttgtctttttaaagttatttgggaaaccacagcctcacatgttgtactgttggtaatctattcctttcaataatgagtttgccttggaacagatatggctatgtgcttgtatttcgctttcagtatctgatttctatttagtcttcctttttctggggttgtccgccaaaattgagtcctgaatttctggatgcacatcttaaataacttcttcagtactgtattcatcaatttattagcctgatttggtaatttgtgtactgactgaccactatctttcttgtacgttaaaattataggagcgttcgtctggtcgatctcgtgggtttggttatgtaacgttctcatcagctgatgatgccaaggtagtaatcctgttctcccagatttgctgacttgatattacattgcatgactagtgttgtattttaaatcttttgttagagtttatatatcaactgtgaaatatcaaccttcgaattttttaagaggtgcttagtaaagtggtttactaattaatgtggtataataaagtggtttagtaatatcttgtttactaattaatgtggtataataacatggtttagtaataccctatcttctaacatatttggtactgctgcaatttattcgttctgaatcattctgcaacatttttttcagaatgttcttgagtgtgagcatgttctcggaaaccgaactctagaagtgaagatagccactcctaaggtaaataaaatacaaacatatattatatatgctagcagtatgttgtacagttgattcacatcaagctgtagttgactatggtgtatcttgtcattgaataggaagaaatgaaatcacagggatcaaaaaaggctactagaatatttgttgctcgaattccgcagtccgtggatgagtccatgtttcgtaggtaagctatagcttcagtccttttgttcagcactcagttcacttatcagttgaatatccgagcttgcataaagactctaatcagaacattttattgataggcattttgaagcctatggagaaatcactgatctttacatgccaaaggtgagcaaatttggaattatttttaaattgctaaaaatatttatgtattctctgtgatatcacaattaagtaccaatacaagtagatacactctttctatatagttacctagatttgcttatcactagtttaactagatttccttccgataaggacaaatatctaaactaatcctaatgctaggattgtctggactcctgtggccttcgctaattaggcatgcatcttataagagactggatatagaaggtgctgattgaatttaagttagcacaggcgaagcatttaaaatagcattcttcttgtttgtcacaatcagcattaagctcataagtggattttttttggtacgagtatttgttttggtgctacaattgattattgaaattatatggtaatgaatggagctacaatgctaaatatgataagattttactgaaatgagtcttccaccctcctgttttgtgtgtaggaacatggttcaaagggtcatcgtggaattgggttcatcacttttcagagtgcaggtacgtttgcagaaatcctccatcatttattcaggcgttcattttaatttgttgttggggaagaataattttagcatagatgagtcttcatttatataaaatggcatcttgacctgaaacctttacttcatgtctgtgttctttagggatgattgcttttttccccagtttgatctttaagcttgatatgcattttgtaattaccttattcaatgcaactgtaatgttacagaatctgtggacagtatcatgcaagattcacatgaactggatggcacaacagtagttgttgaccgcgccactcctaaggtacctttgctccaaagcacttgccattggtggctgcatccaatagtatcttatctttgagtaggctctgtagtaggacattctatttactgaagtagttatgtacttgttaccacctgaaatccatctgaaccaggatgaagaagtcagatatcctccaagcaggggggcatctcagggtggctatggtgcatataatgcatacatttcagcagctaccagatatgcagctttgggtgcacctactctgtatgaccatccagggtcagcttatggaagtaagtcttctgctacgaagatcacaggtttgacacaaagcaactttgttaactggttaaatgttttctatttgacttacattgactaggaggaggatactatggatcctcccaaggaatgggcaacaaaaagatatttgttggcaggcttccacaagaggcaaacacggaggacctaaggcattactttggcaaatttggccgaattgtggatgcatatatcccaaaggtaaggttaagactttctcattgtttgtaactgtactatgttaatctcaaccttttctaattgtattgaaggaccctaaaagaagtggacatcgaggttttggttttgtcacctttgctgatgagggtgtggcagatcgggtagctcgcagaagtcatgaaattctaggacatgaggtaaggctgttggtgtctccttgtctctgcttcccatgcctccaaagccaaagtgacaatgtcaaccttagcttttctttggggaaaagaaaaacactaatcataccattccaatgtttcaggttgcaatagacactgctgcaccacttgagggtgactctggtggtggttacatggaacccatggatctttatggggcttatggttcaatgcgaacttatggcaggttctgcagtggtatcgactatgatgtaagtgcacaaatacattattatgcttatgatgcacagtaggcttatatataagttaattggtccgagtacatttgtgataacagagctgtaggcttaatgttggttcgttgtgattgtcaccaattatctgttgaatctcatgcaaatcatctaacaaaaacttgttgatgtcccagtacggttatggtcacagcggaagtagcagtagcagatcaagggctgattggcgataccgaccttactgagcctgctgtcttgttactgttaatgatgttttagtttacctccaagggaactgtggaaacggagaaaagaacaactccataaagaatgccaggttgtactatgttaatcttaagcgggacgggacatacgtggaatctgtatttcagttcatcctgtaaatttttctttgccattagaacgcattaatgcggtttctgtgccaggatgccatgagatcgaggcagcagtgtagttatcattattgtggaagtaccatatgtaataacaatctttcttctacacatgtaaacggtggttctggtttttgagcctctcgtgcctgatcctgctttcttgtctgaatccatctactactgtattggtttacaattgctattgtgagtacagttctctatctttgtgtttcccacttctacttcctctgatggccaccgtcgccgtgttcttcccgctgccggtggcgaaggaagccttctacaacacgccggtcggccggtggccgtacgtcggcttcttgcggttgcgcgtaaggatttgtccatgagccacgtgatatactctctgtgtgtgtgtttgctttcttgggctgtatcgactatcattgtctgacatttctatggcccggtcactgttccatgcagaaaaacttaccagcagactgcggtgaattgcaagaccaatgggatgactgcggtgaattgcaagaccaatgggatggcttcgataaatgtcgatagcaatataaatcataaagtcaaaaatggcaaagtgtttgtgctgcagccgtgcatgatttccactccctcccttgactagttgtacgccaaacagagactttgcttcttctaggaagcttatattctgtactgagcaacgccagtacgccaccgatcatacaagtagtaaatcgcagagatactatatactccgtactactgtagcaactagcaagtagtaagcagagatcgacagcgatgtctcgctccgtcggagtgacaatggacgccgccggcgccgatgcagaccaagcccggctgcaccagctgggctaccggcaggagctcaagcgtggcctctcgtatgtgattcttctttcgttttttatgtttcttttcccatgcatttcatattgcgatcattttaaatttcaccgtagcttgtgagtgtaaacttaccatattgaatcctttgttagcctggtttccaacttcgccttctccttctccatcatctccgtgctgaccggcgtcacgacgacgtacggcacggggctgcgctacggcgggccggtgtccatgacgttgggatggctggtggtggcggcgttcaacggctgcgtcgccctgtccatggccgagatctgctcggcgtacccgacttccggcgggctatactactggagcgccaagcttgccggaaaggaatgggctcccctagcttcctgggtcactggctggtgtgctcttcgctaacatgttaatttatctctcatggtttaatcgttatcatgttttaaattttggaatttaataatatttccttattatgttttacaggttcaatattatgggacaggtatgaatatgtttctcacgggttcacaccaagtctaaatcatatatctctactattttaaaagcgaaattgttctacttacatgctctcatccgaatatgcataacgttttacaggttcaatattgtgggacaagtatgaatatgtttctcactggtccacactaagtctaaatcgtatatctctactattttaaaagcgaaattattctactttcatgctctcatccgaatatgcataacgcgtctgttcacgaaaagtaaccaccatccctccctaattatatggtgctggcccattaacgtataggcggctcatatccctaattatatgggtctaattcattataacatacatgcatataactagtaaaaagaagagttaattttacactctcgaactgttttcagaaagtgcagaaatcttttgagggaaaaaagtgcagaaatctgacactccaattgctcgttaactgatcctccagtgggcttgcacgacgagcgtggatttctcgctggcgcagcttctccaggtgatcatcttgcttgccacgggaggcgccaacggcggcggctacatggcgtccaagtacgtcgtgttggccatctactctgccatcctcatcctgcacggcctcatcaacagccttcccatacgatggctctcctggtttggccaacttggagctttctggaacgttgcaggtgctgttcgtcccggccatttttcagatattcagtgttgaatcccatatatacatcatctcattcttcggtttgtctgtttgaacaaacaattccaggtgccttttcgctgacgatcttgattccagcggttgccaaggagagggtgagccctgagttcatctttacccatttcaacgcagaaaacggcgcgggcatccacgacaaggcatacattctcgcagcggggttgctgatgagccagtactcccttatcggctacgatacatctgcacacatcgtaattctgaactttctgatagctgaacaatccttagtttctcgttgcatacatacaattcatccactaatcttctcctcgcatataaatattcagatagaagagaccaagaacgcggattggagtgggccaattgggatcatcacgtccgttgcactgtcaaccatgttcggatggatctacctgattgccctgacatcgatcatgaccgacataccttacctcctgaaccccagcaacgacgccggcgggtacgccatcgcgcaggccctgtacaccagcttccaccggaggtacggcaccggcgccggagcgctcgcctgcctgggtgtcatcgccgtcgccatcttcctctgcggatccgcgtgcatcaccagcaactcgaggatggggtacgcgttctcgagggacggcgcgatgccgctgtcgcgcgtgtggcaccgcgtggacagccgcgaggtgcccctcaacgtcgtctggctctccgtcgccgtggccttcgtcatggctctcacggtgagttgcacacgcgttgctgctgctgctgctgcaaatttctcgtgcgcgcgtacgtacgtgctggtctcatatagtgtacgtttttttggcacagtcgctggggagtcaggtggctttccaggcgatggtgtcgatcgcgacgctgggtttgttgatcgcgtgcgcgctgccggtgtttttccgcgtgacgacggcgcggagatcgttcgtgcgcgggccgttccacctcggcaagtacggggtcatcgtcggctgggtgggtgtggtgtgggtggccaccgtcacggtgctcttctcgctgccggtggcgtacccggtggccaaggagacgttcaactacacgccggtggccgtcggtggcgtgctgctgctcagcctcgtcgcgtgggtgcttcacgctcgcttctggttccaagggcctgtcaccaacgttgacacgtacaacgtaccctgaatttgtatccctggattagctagcgagcacaggtggatcagtaacttaaattttgtgcaattttctcttgagagggaaaaaagatgtgcatcttgttggttgtaatggggacaaagaccaaaataagcccaacgaagggtgctgcacatgtggctcctccatcgaacccaccaaaaagagcaattttatattctttgagaagatacatgaggtaccactttttttaattgtaaatttggtacattttagtacctaggtactacgaggtactaaattttacactaaaattttagtacctcatgatacctagtcaaatactgtaaaattgctccaccaaaaaaagttggccgtctatttggcccatcaccaaattgggtctctaccaatagtaggcaggatagcagatatggtttttgagaagagtagcttactgtgtcatcgattgtcatcttttatagatgtggtattgatagttaggaaaactagcgagaacatcacgcattgcagcgaaacctatctatgataaaacagaaaacaatggataaaaatatgtatttgatcggttgtatatatatatatatatatatatatatatatatatatatatatatatatatatatatatgtatgtatgtatgtatgtatgtatgtgtgtgtgtacataacttcaactttaggtgtttgctccattagagccaagtcgttagaaagaaaggtagttgccattcgtaagccataacacccatccgttagtaagtaagatagttgacatttatcactcttatgctaataaatttatacccactatgaaaaatataaaaattaaattatagttagtactcaacaattaactgaacaatcatagatgagtgaagaattatcatgatgaaaaaacccgttatgtaaacacttcccgaactgctaaacaatgtatttatgaaaatataaaaaaagttactttcaaaattcatattagtcatttttttttaaatttaagtagttaataatcaattaattatacgctaatggtttagcttgttttgtgtatctttccaatcctctctttttctctcctagaatcaaacacaccccagataacttcttgatcccataaggccataactactatcttcatactaattcaatctaatgataaaatattgttgatgatgtggctctatgtatatgttactttgtaggaattaatattttaataggtataaactatataggaaaaagatagatgcgtgcttgatgaattgaatagacttgtcgccgacataactcggtagttttttttttttgggaaaattcactgcggggcaagttttttgagttacatattaagagagcggaggaagagaagagggtctttcaggctgaaattacaaaacgatcatcaagtttaatttgctcagcctaaagggacgcatcttctatacattgcacatgactcggtagttattggagagatcaacgaaccaagagaacatgggcatcacaggttggcaaaagccagtgcttaatcagacaatcagtggcaattactaaggcatcatgtagtacagtagtagtatagaaattatgttgaacttttctcaatgatcaacaatttgcgcgtgctctaaggtacgtaggaatatgcatatccatgtatatattatatattccaagatagtatggtaaactgattattaaagtatgcgcgtatccacatggattattcctaaccgatcgtatggtcaactgatcattatatagtatgcacgtccacctggactatttccaacggaccatgtattcatatcaactgataattacggccctatgcatatccacatgggtcctgtttggatccggaatcttactatttatgagtattaaacgtagattaatgataaaatccattccataatccctaggctattttgcgagacgaatctaacgaggtatattaatccacgatttgctacagtgatgctacaataatcatccactaatcatagattaatatacctcgttactcgttagattcgtctcgcaaaatagactaggggttatggaatgggttctgtcagtaatatatgtttaatattcctaaatagcaagatttcggagggctatttaatagcccggaggatccaaacaaggccatggattattattgttcccagctgatcgacatatatatcggtttccataatctataaggtagtagtgtttaaattaggtagtgtctgttatgtatattgtctcttaattaacttgaggatgccccacacgttgctgcgggacttggttaatatcaatttgttagataggaggtacaatctcaagaagaaaggaagaaacaaatgactttcttagagaaattctttttagcaaccctgtccaaaatttgtagataatttaagtagcgcattcaaagcataagctacaaagaagcaaaatggtctgacgtaagttaacaaattgtaatgttaactgaatgggcattcggccatgaagctcttttatacggattgatgggtcggatacatgtagatgagtgtggagatgggttaatgtgttcatgtgggctacatttggcactaaggaggcgaagagactcacccggtgcttgatgggttgggctctatgttgcgttccatccaacgtctaagaagcaatctaatgcattcatccaatggttcataattgatgatgacgtggaagcatgaggtttgagcttttggcattaactttatgaaagaagggacgagtagcttaatctataaggatgactcatattccttgtgagcgatattcgcgatatgtctttaaatttggacggtagtgttacttagatccgtgatcttgtaaattacatatttagattcataatcatggtttaatataccagagcagataaaaacgcgtttcaagtgcccacttggttgaccaaggtagttgaaacattacattcaagacctctaaaaaccattgtggaaaaacaattacatatagccactgcaccctatagtacacacctaaaatgtccattcacctcccctcctccctacgcatagtcgatagggacggtggcgattagggcaacactgatgagtgatgattgtcaatgagccgaggcgctttgggcggagcagcaccattgttgacatgaaggcgagcgatggaccttaactttcagggcagcggcacacgatatgcaatccttttgccaaggtggctttcagagatgggcgaatgcaaactttcagctagcatggacaactacgttggcgccaagaccagtcacacatgcttaatttgggtgcaccgtgcacctactctctatgaccatcaagggtactattactatccgagatctatatgacccgatcgtttgtttgtttaatgcagtgcagagaaatgcaaggccaacaagaaatttcttcatgtggatggcatcatcttcattattcttaagagtaaattgtactttgcactatgtaaattgcatcgtgtttcacttgtttttacatggactcaattgctatgtggcaccgctcctgcggtaggaatcactgacatgtaggcccttgagcaagtggcaccatcgacatgtcaaaagtaatattgcagggggttgcttatactttcactttacaccaagttattttaaaataaatttcacttaacatcgggatgcatcatcaagcctataaaatttcataaaatcaaagaaaaacatgttgtgaaatatggtctaaatttaagaagctcagtatgttttactcatattttacaatcctcgtgttcaataataatgtaatatgatgcaaacctagtaaaatgaaaccagctatattactgccgtctcccggttcaaagggcaaagggcaatttactctgttttaatgcacggagaaatgcaagaccaaagaaagggatggctacgataaacgtcgatagcaatcaatcatgcaagtaataaaaaatggcgaagcatgcgaaagcgaagacgccggagtgctgcatccgagcatgatttccagtccctcccttgactcgctgtacaccaaagactttcttcatctaggaagcttatatatattcaattactgagcagcgcaaccgcggagatatcatagagaaaagtagtgagcagacaccgacggcgatgtctcgctccggcgtggtggccatggacgccgccggcgccgatgcagaccaagcccggctgcaccagctgggctacaggcaagagctcaagcgtggcctctcgtatgtgcttcttcttcccttcttttaccacacttcattgcgatcatttttcaccaaattaagcttgtgagtgttaatttggcatatattgcaatcctttgttagccttgtttccaacttcgccttctccttctccatcatctccgtgctgacgggcgtcacgacgacgtacggcacggggctgcgctacggcgggccagtgtccatgacgctgggttggctggtggtgtccgccttcaacggctgcgtcgccctgtccatggccgagatctgctccgcctacccgacctccggtggcctctactactggagcgccaagctggccggcaaggaatgggctcccttggcttcttgggtcactggctggtgtgttcttcgcgtcctagcttaatttatctctcatgctttaatttaatcgttaacatgttttaaatatggaatccgcttaatccttttgtcttctgttttacaggttcaatattgtcggacaggtacgtgcattcaaactccatgagttatgtagaagtttataaaaaaatatagtagtattttcagtacaaaacaaatctattataaaatatattaaatggtacatttagtgagattaatttgatttgtagacgttgctaaaattcttataaatttaaaagtttaacttagaaaatagacaaaacgattaataatatgaaatggaggaagtaattaatgagccatgatttttgaaagtgctttcaaatatgaatataattttattcctttttttttctcaatatacctttggactaattgttgttcaaacttcacgatttcttaaaaataaataaaaaaagtacattttgcactctcgaattgtttccagaaagcgcagaaatctctgacgctccaatcgctcgttaactgctcctccactcatcccagtgggcttgcacgacgagcgtggatttctcgctggcgcagcttctccaggtgatcatcttgcttgccacaggaggcgccaacggcggcggctacatggcgtccaagtacgtcgtgttggccatctactctgtcatcctcatcctgcacggtctcatcaacagccttcccatacactggctctcctggtttggtcaacttggagctttctggaatgttgcaggtacagtcgactcaacgtcccgaccgtttcttcagatattcagtctgaacatttacatcatcagatcatctgatcgtgatttgatctttgttctgtttgtctgtatcaacacacgatccaggtgtgtttgcgctgacgatcttgatcccatcggttgccaaggaaagggcgagcccagagttcatctttacccatttcaacacagaaaacggcatgggcatccaccagaaggcctacattctagctgtggggttgctgatgagccagtactctgtaatcggctacgatacatctgcacacatggtaataaatctgattgttgaatgtcctgaacaatcctactttctcttcgtatgcattcaactgatcgacgaatcactgaatctttttgtctgcacattcagatagaggagacgaagaacgcggattggagtgggccgatggggatcatcacgtccgtaggcctatcaaccatgttcgggtggatctacctgattgccctgacatcgatcatgaccgacataccttacctcctgaaccccagcaacgacgccggcgggtacgccatcgcgcaggccctgtacaccagcttccaccggaggtacggcaccggcgccggagcgctcgcctgcctgggtgtcatcgccgtcgccatcttcctctgcggatccgcgtgcatcaccagcaactcgaggatggggtacgcgttctcgagggacggcgcgatgccgctgtcgcgcgtgtggcaccgcgtggacagccgcgaggtgcccctcaacgtcgtctggctctccgtcgccgtggccttcgtcatggctctcacggtgaattctaagtccattgctgctgctgctgctgtaaatttctcgagctgctctgatttggttgttttctcatggcagtcgctggggagccaggtggcgttccaggcgatggtgtcggtcaccacgctggggctgtacatcgcgtacgcgctgccggtgtttttccgcgtgacgacggctcggaagtcgtttgttccggggcagtttcacctcgggcgatatgggctcatggtcggctggatggccgtggtctgggtggccaccgtcacggtgctcttctcgctgccggtggcgtacccggtggccaaggagacgttcaactacacgccggtggccgtcggtggcgtgctgctgctcagcctcgtcgcgtgggtgttccatgcccgcttctggttccaagggcctgtcaccaacgttgacgcgtaaaacgtaccctgaatttttgtaaatttgaacgcgcgtaccctgatttgataaatttcaatttgaagcgtatttgggtttgaccacgaattggatccgtaccgatccgttaaactcaaaatttgtgttccttttggaccgatataagcccaacgaaaggggctgtgtaggtggctttcctaccaagcccaggtaaaaagtgggcttgcatttggcccgttacggaatatgagcggtcaacatgggccggattggtttaacagcttgactttgggccaccgtgaaatgagtcgctaatcctaggataaagtacactgaaggtccctcaacttgtcgtcgagttacagaaacgtcctctgacaagatatatcacatccctcaacttaacaaaaccgtttacttcggtggttggttttatgtgacgtgacggttgagtcagcagacccacgtgtcagatgccacctcatcacttctctcttatttcgcctcttctttctctcgctgtgctcatctggccaggcggcagggtggccgacgggtggggactggggaggaggcccccgcgggggcggggaggcagaggtccggcggccggcgtccttcttcttcgcttctttccgctaggcggagtcgccagcggcggctttctccaccgcgcgcagccgggagggaggtgagaggaggaggtccggcggccggcgtcgcgccctccgcccgcatcctcgttgccgccgctgtggcggccttcttcttctcctctttccgctgagcagagtcgccggcgacggcttcctccatcgcgcgccgctcgacggggggatgccgatggcggcggggccgcgtctcgccatgtagcagccgtcgatgatcctcgcgccgttgaggagcatggcgaccaggagccggcggcgaacggagtcgaccaggctgcggcggcgaacggaggcaaccaggctgtggcggcaaacggccagccgccgaggtcgcccgctgcagcgctggtgaagttaggatgatgccttccagttttgctctgatatgagggaacaatgatgcctggaaaataccagctactgacaagcacaagggaaagaagaatatgaagcatgtaaaatgaacatatctgcagccaaaccatttcaagttttcaaccaggctattttgttaatgctttgcaccattgctctgcccgtcaggatatccaattatccattattcacaggcccaaaggagtagggtcagtttctaaacctcgcctaaatagagcagagaaaaactacttattgttacaaggcataccttcaaaacaacagctcccccagtggagtgaccaagaagaaaacagaggacccctggattctcaagcacaattttaccaagaagtacatcttgtttgaagataataatatatttcataagtaactgaatgaaggaataattgcaagactgcttgcttatattcagacttactgtatcttctacaacataatctagtgaaggcacatcaccatgtagaccatcgctgccaccatggcctgacattgtatatgagttagagttagcctgttaatgttcaaaataaaagcagaaccaaacagatgttgttgataaaaaaacaatgcaaactgcatggataaaatcaatgaaattgcctactgtattttgttagtaagtgtgcactgcagagtcaatttgtgctatgagtgaacagaatgtggtaacattacaatcatgagctattctgaataaaatttcatgcttttgtccataacaaacggtaatactttgttattttgattgcaagcaggccgccgaggtggcctgctgcagcggcgtctgcacgacctcatcgccacggacgccttccaccgcgaccaccaggcaccagcgccattgctcccgccaccccatgccgctcttcttctaccgtctcgaccactgggcctaccccgaccgcgtcgcgtccacctccgcggcgtcgacatcgccgcccgcgagtcccacccggtcattcgcttcgcccacgccgacgccaacctccgccgtctgccgcacgcccggtcatctgctgcacgcccgcgccccgtctgctccgccggccggccgctccccgcaccgtcgcctggtcctccggcaggcccgtgctgcgggtgcatctgccgcagccgctccgcccgccgcccgcccactccgcccgccgcgcgctgctcctccccccgccgcccgcccgcagctcctcccgtcgcccgccgccgcccgctccgcccgcagctcctcccgtcgcccgccgccgccatcactgcagccgcgtcgcccgcgtcgccatcaaattggagagaagtgagagatgaggaagggagagaagagggggagagagatgacctggcattatgacatgtgggactcacgtgggttccacgctgactcaacagccacgtcagataaaatcggggtcaaaaccaccggaggatctatagtgaacggttattagttgagggacgtccgatatctggttttgtggttgggggacgattttataactcgatgacaagttgagggaccttcggtgtactttttccctaatcctatcatgggattcgcttgagccgtcggatgtaaactgcgtggtccagatcgatgcggatgcacctgtcttacgatgtttgcgacggggacccacgataggaaaaggtacacccaaggtccctcaacttgtcatcgagttacaaaatcatcccccaacggtaaaaccagatatccagtgtccctcaacttataaaatcgtttaatttaagtcattcggtgattttaaccccggttttatccgacgtggcggctaagtcagcgtgagccccacatatcagtatgccatgtcatcccctcctctatctaacttcctcctctctctctctctctcacacacatttctcctctgtgctggctgccgacgggtcggaggaggtcgctgggcgaagacgggcggcggcagggggagaccggtggcacacggccggccgagggtcgcctgccgctgtcatcgccgcggccgttggacgccgacgccgacgtggaagcggtccctgagctcactgtcgtggaccccgacggtggtgaggtgagcaaggatgtgcggggtggtgggggcagccgtgtatgcagaggcaacagagacggcgggcggcggtcgacgtcgaccatctggaggcggaggcgcgccggtgccgctcttggatctcggccactacgcgggagtagatgaggttgggagcggaggaggcccgcgggcaccgagcggtgtgtcgtcggcgcgtcgccgccctcaccgacgacgtggagagcgccattccagagagagacagatgtgggtgatggccaacgacgcggcgctccaaaaagttgctcgtaaggtcgaagcagccggggcggctgccctggatcgaggcgctgcagatccatcgtcggcggaacgaacgagcagcagtagagggagcagtcaatcagtcatcacttccctcccttgagtattaagagtggttctcactcgattcacttgcacactctttcactccactgctccagtccagtgtgttcacatgctctgccccaacgcaattcaagcaagcagatgagatcgatgatgcgtctcatgatttgctgcctcctagtctctgcgggggccgggggaattgcaggcgagggcaacttggacgtggcgctcctcctgcagtgcgtgaagccagcgctgcggagggaaggcgggaacacgcagctggccacctggaccgcctccaccccgctctgcctgtggcgcggcctccgttggtccaccgccgccacgctatctccaccgaatcctaggaggccgctgcacaacccttgtcgccgtccttgctgccgcatcctaggcgcctcggcttgaggatgcccttccccttcatcatgctacagagccggtggccggcagaggagaagagcgacggtggcgctcggtggcgtagacaccagagtccgccgctgccgccgccctccccttctcccacgtcaccggcgacctcctcccgaccctgcgagagcagaaaagtgagggggaggggggggggggggagatactgaattatataccacttttagatgtggaaactaactggatccatatgttatagacatatgtggacccatatgtcattgagatagacgtgacaaatagttaattgacaaatctaaaagtggcaaatagttaaatacccgggggggaggggaggaagggaaaggagaggaaagagatgatgacgtggcaccctgatatgtgggtcctacgctgactcagccgtcacgttggataaaaccagggttaaaaaccactgaagaacccaaaacgaacggttttgtaagttgagagacgttgtatatctggttttgtggtttggggatgtttttgtaacccgatgacaagttgagggaccttgggtgtactttttccccaagatattcttgtggtgtttattgggcctaataggccgaggactcatcaatttcatgggcttttcctcggagtttttcctccgcgcccgccacacaggtgtgaacaaacagatcgatcagagacagcgagggatccggtatacatcgaagagctgaagaccaattaatgcacaagctgaaacaatccaaaaatatcaaagcaatttgcattattgtccggaaatgaaaggcgacggttaaattttgctactatcctacccaatcaaataatatccccatccacatcttgattcttccatcgtagagaagctactgcctaaaccagacactagtaccatgcactgagcctgtaaagtttttgcaaatctactgcaaaggaagcacgatacagatggcgctctctcgctccgtcgaggtggccgtgcccgccgatccggccggcgatggcgatcgagataaaattcggctgcggcagctcggctacaagcaagagctgaagcgcggcctctcgtaaggagcagcttatcttatgaatttaccatgcgaagcctcgcaaactactactgttcattggcatctttggttaattgtttttggccttcgtgagctagtgttctctccaacttcgccttctccttctccatcatctccgtgatggccggtgtgacgacgacgtacagcacggggctccgctacggcgggccggtgtccatgacgctcgggtggctcgtcgtgtccgccttcaacggctgcatggccctgtccatggccgagatctgctccgcctacccgacctccggtggcctctactactggagtgccaagctcgccggcaacgactgggctccctttgcttcttggatcactggctggtgagtacgtgtatgtattgtgaattgtccgtctctcatgaacttctcgttccaagaaatgaggaaagccttgcaaaaatttcatactccagcatcttttaggcttcgtttaaaataggatatttttataggattttcgcggaaattgatcgatcgtatataaaaatcttgtaaaactcgcacattccaaaagagacctttattttctcaaaaagaaaaaaagagagaaagacctttatctcttgttctgtttttcattccttgtgttctgctttgcaggtttaacatcacgggacaggtaggtacattcggatttctgggcccgggcttctcgctaattgatgggcctttttattgggccatgagtacagaaaggaataagttcactttgggtccctttatttgttgcccagtccgattttcgtcccttaatcacaaaaccgggtacgacggatcccctaacttacgaaaccgtttaaattccctcggcagtatttgactctggttttggctgaggtggcaccgacgtggcttcttttgactagatttttgtccaacgtgttattgacgtggcgctgatggggcaattagatcccaaaaaaataataaaacttatggggcccacatgtcagttgcacacacaaattaataaaaaaggtgggcccatgtggacccacacgtcatcctcacaacctcttctctctgtcccctctctctccctcttgtctctctcccgctcatgggcggcggagcgacgaggaggccggctggaacggcgcacggcggccgagcgacgaggaggctggctggagcgggcgacggcgtggcggcgctgggggggcgggggtggacggagcgggtgccccggcgcatggcgtagaacacctcctgctcgaacgccgggtcgccgtcggcgaggaggcggtggacgagcaccagcatcttgagcgtgacgcccaggcagcgtgacagcgacgcgacgcaggcgcgggagtggagcgtgagcgcaatcacctcccggacgtggtgctcatcggcggggaagccatggacggtgtgggagaggtcacgcttgacctcttgacacatggatactctcgtttaattatctcgttattacaaacatggttaattacaacttccaaataaagatcaaagcagacatattatgttaaacttgtgcctgcaaaagctgttttattcagttaggatagtactttccttttatgcacgttatgtgttttagccttttaggctagctaatattattacttgtagtactagaacacatgcaggaaatcttagccgattgcatgctactgagctactcgatcgctcatggattgactgagacgccagagctacaccttggtgtccgccttgccgctggtcgtcgagtcatcggcgctgccgccgtcggcgaccttgttgttcctcccctcggccatctccacgtcgtcgtcgccggcctgcttgccgcgattgccgcggcggcggcgaggaggaagacgaagatgctggcggcagcagcggcggcgaggaggaagacgaagatgccggcggtggcggcgcgctgggggtggtgtcggtgtgggggatgcgtcgccccgcctcgcctccttccccctgcgcacatgaagaagagaggacgatgaatatgagagagaagggagggggaagaagggaggagtagctgacatgtgggccaccattttaaaattattatttttagctgacatgcgggtcccatgttttttattattttttcgagatataattgccacgtaagcgccacgtcaatgccacgtgggacgaatatctagtcaaacaagccacgtagtcgccacatcagccaaaatcaccttcaaaaccgctgagggacctcgtctacacggtttttgtaagttgggggatgggtcatacccggttttgcggtcaagaacgaaaatcggactgagtgacaaatagagggactcaatgtgaacttattccgtacagaaaagcctaacagtgggctgacgctatatggatctcttgatgacatagtgggccgctaccacgagcgtggacttcgcgttggcgcagttggtccaggtgatcgtcttgctcagcaccggtggagccaacggcggtggctacatggcctccaactacgtcgtgctcgccatctacggcgccatgctcgtcatccacggcgctatcaacagcctcccgatccagtgcctctcttggttcggccagcttggagctttttggaatgcggcaggtaatgaaattatttttttttcctcctcttgcaatcgatctccttattaagtcaccatcgattccatcatcactctattgttcttcgtttgctaggtgtctttgtgctggtggccttgatcccggctgtcgccacggaaagggcgagcgttgagttcattttcactcacttcaacacagaaaacggcatggggatacgcgacaaggcttacattttactcatcgggttgttgatgagccagtacgcgatggccggctacgacacatctgctcatatggtacgttgcgatttcgcccctagacacagtagtccatatctaaactgcaaatactactgacactctgacagtatatcattctatgcatcagacagaggaaacgaagaatgcagattggagtggcccgatcgggatcgtaacctcggttgctctctcgaccgtgttcgggtggatctacatagtgtcactcacgtcggcggtgacggacattccctacctgttgagccccgacaacgacgccggcggcaacgcggttgctcaagctttctacaccactttccaccggagatacggcagcggcctgggagggatcctctgcttgggagtcgtcgctgtcgccgtcttcctctgcggcctcgcctgcatcactagcaactcgaggtcagatcgatcgatcagctgacgtgttcaggaatttagcttagcttaattagctacgtacatgttgataatttcctaggttaattagccactgcatgcaggatggcgtatgcgttctccagggacggagcaatgccgttctcgaaagtctggcaccgagtgaacaagcaagaggtgcctataaacgccgtatggctctctgtggtggtggcgttcatcatggctctgacagtgagttaattcgtaccactgctgattaattttcatgcttgattctcagttcagaataaccagaattatgctttatttttatgacagtcgctgggaagccaggtggcattccaagcaatggtgtccatcgcgacgatagggctctgcatctcctacgcgctgccgatcttcttccgggtgacgacggcgaggggatccttcgttccggggccgtttcaccttggcaagtacgggatcgtcgtcggctgggccgccgtgctctgggtggccgccgtcaccgtgctcttctcgctgccggtggcgtacccggtggcggaggagacgttcaactacacgccggtggccgtcggcggcgtgctgctgctcaccgtcggcgcgtgggctctccgtgcccgcttctggttccaagggcccattactaacactaatgacggcccgctgtgacggcccataactgtatgggccgatgcatgtgtgctacggcccatggagttctacggctgacaaggaagcccacgtacatgtagccttgttgggcggcccagtaagaggccgttctttattttgattcgtattcccatgtccttggatggaaattcaacggtctacgattcggctgattatgttagaaaaagacaggcatgaggtacagaactatactaaaaaagcagcatgcgtgcaataattcaagcatagtttaaacatgaaccaaaagtcctaaggtatacagttttttttttggaacgcataaggtatacagcgatatattgcatcttatccttcagttagtcaacggtagttggcaatactacaggaaaatcgtgacataagcgtatcaatcaatcatcagtggtatacaaaatttccaaccatttcgttgattatgaattatatataagagagaggtacgtacttggacatttcttttttgggaagttgactagtacagcgagcatgtaaactatactctgcaggattagtgagctatggaggtgatagcgtcaaaaatagctagcctcccaggaaacagcctacaggagatagagaactgatccacggccatgtctcgctccgtccaattagcgatggccgccggcgatcaggccgccgacgacccggacagcctccggcttctccagctcggctacaagcaggagctcaagcgtggcctctcgtatgcacacaacaagtttcagtttattcagacttagcatgcattcaccgtgctaattagttcattcttttcaaaactaagaccatcttgatcgattcatctggatatatatacacacaggaccctgtcgaatttcgccttctcgttcgccaacatctcggtgctgacgggcgtcacggcgacctacaacacggggctgcgctacggcgggccggtgtcgatgacgctggggtggctggtggtggcgctgttcaacggctgcgtcgccctgtccatggccgagatttgctcggcgtacccgacctccggtggcctctactactggagcgccaagctggccggcaaggaatgggcgtccctggcttcttgggtcactggctggtacgtgagacatgtatgagctagtctgcatcaatttcccctgtctttatgcactggaactaatccaaaatggttaggtgcaattgttttcttgatatccttgaaaaaaaattgttgtcttgagatggtgccttcttgaagattatgtttgatcattactattttgaatatttgttgctgtggattatgcatgtatgctgttgttcaacttaatttgcgagcctgaatttgttattgtgttgtgtgttcgacaggttcaatatcgttggacaggtatactaccattgtctggtggatctagatactgtttttagctccagcttataacttcatttttcgagaaaaaaatttgcattgttgccctgtccttgtcttcaactgttgtggcagtgggcagctattgcgagcgtagacttctcgctggcgcagctgctacaggtgatcatcttgcttagcacgggaggagccaatggcggcggctacatggcttcaaagtatgtcgtgttggtgatttgcgccgtcatcctaatccttcatggcgtcatcaacagcctccctatccagtggctatctctgtttggccaaatcggggccatctggaatgctgcaggtgcatggtacacatggaggcaataatcaccagtccttatgaattgtggttcttggcatctgaagtctgaatattgaaccctgaacgaaatttatctgtctgaacaatcaacaatgataggtgtctttgttctggtgatcctgatcccggcagtagcaaaggacaggccaagtgttgagttcgtgtttacccatctcaacacggacaacggcatggggatccatagcaaggcttacatcctagccgtgggattgctgatgagccagtactccgtgctcggctacgatacatccgctcacatggtaaacgagtcctctactcctgtcaggctgcagatatctgaatgagcataactgaatatggatagaacacagtgtcacagtgacgagctgatgatgcgtgtatgcaggttgaggagacaaagaatgcagatcggagcgggccaattgggatcatcacgtcggttgtttgcgcgacggtgttcgggtggatctacctgttggctctgacgactgccgtgacggacatcccgtacctgctcagccccggcaacgacgccggcggctacgccatcgcgcaagctctgtacaccgccttccaccggaggttcggcagcggcgctggcgggatcgcctgcctgggagctgtcgccgtcgccatcttcctctgcggcatcgcgtgcgtcaccagcaactcaaggtgacgggctcacatcgcgtcgatcgatctgatgattccacagctagctgttcatcgaatcatcgtgtcgagttggtgatttacatgtcgggtttctgtaggatggcgtatgctttctccagggatggcgcgatgccgttgtcgcgcgtgtggtacagggtgaacaagcacgaggtgcctctcaacgtcgtctggctcgccgtcgccgtggccttcttcatggctctcacggtgaattattatattccgagttgcacgcgttgctgcttctgttcctcctgcgtgcgctgctctgacacggtgcgctaattttgttgtttttttggcagtcgctggggagccaggtggcgttccaggcgttgggctcgatcgcgacgctggggatgtacatcgcgtacgcgctgcctgtgtttttccgcgtgacgacggcgcggagatcgttcgtgccagggccgttcaacctcggaaagtacggggttctcgtcggctgggtgggtgtggtgtgggtggccaccgtcacggtgctcttctcgctgccggtggcgtacccggtcgccaataaggagacgttcaactacactccggtggccgtcggcggcgtgttgctgctcagcgtcggcgcgtgggtgctccatgctcggttctggttccaagggcccattaccaacactagtgacggcccgatttgacggcctagaaaagtatgggcccgctgatgtgtagccttgcttggaggcccataagtgggcccaataagaggtcgttctttagggcttagtatttgttagagtctcaactcttaaatttaccattctgggtctaaagtatatctctaattcattttgtgagaatgttccaccagcttcactcacattttagatgaaattaaaacgttttggctgactctagctcttgccaaacataaccttcattggattcacatttttattggatgcaaatttgaaaacttcaacggtctaagatccggctgattttattagaaaaggacaggcgtggggacaaaaactgtactgaaaaaaaagcatgcatgcacccattcaagcatagtttaacatgaaccgtgattagaagtagtactaacgtgacgtatatatatcctatattttctgagtcaacattggcgtgtaatacgaaaggaaatcgtgacatgggcagatcagtgaatcagtggtacaaaatttccaaccattttgttgactcgcgaatcatacatgacagatacttggactattctctttcggaaacttgactagttacactgagctgtctgagcatgtaaactgcagcatagcgcgactagtgagcaacagaggtgaaagcttcttcccaaggtagaggatctagagatccaggccatgtctcgctccgtccaattggcggtggccgccggcgatcaagtcgatccggacagtctccggcttcaccagctcggctacaagcaggagctcaagcgtggcctctcgtatagacgcatatgcttgcttgtgtttaatttgttcagactagttcttgattagcaattaagcatgcattttggatcttccagtcacaagactcttttcacaactaatctgcgtacagggcactgtccaactttgccttctccttcgccaacatctccgtgatgatgggggtgacgacgacgtacaacaccgggctgcggtacggcgggccggtgtccatgacgttgggatggttggtggtggcggtgttcaactgctgcgtcgccctgtccatggccgagatctgctcggcgtacccgacttccggcgggctatactactggagcgccaagctggccggcaaacaatgggcttccttggcttcctgggtcactggctggtacgtgctaatgcaaaattgtcagatgcaattcttgccttgagatggtgcctacttgaattctgtcttttttttgtgttcgacaggttcaacgttgtgggacaggtacacttgccattgtcaacttggataatcttggggattgttttttttcagttgcagactataattgcatcgtcgttggccttgtacttgtcttcaattgttgtggcagtgggcagctattgcaagcgtagatttctcgttggcgcagctgctacaagtgatcatcttgcttagcacaggaggaggcaatggcggcggttacatggcttccaagtacaccgtgctggcgatttatgccttcatcctaatcttgcatggcatcatcaacagcctccctatcgagtggctatctctgtttggccatgtcggagccatctggaatgctgcaggtacacaatgaagtgagttctatcggttctaggcatctgaattctgaaccctgaatttatctgtctgaaacaatcaacaggtatctttgtgctgacgatcttgattccagcagtagcaaaggacaggccaaatattgagttcgtgtttacccatctcaacacggaaaacggcatggggatccatgacaaggcttacatcctagccgtgggcttgctgatgagccagtactctgttatcggctacgatacatctgctcacatggtaagttaatcctgctgtccctcaggttgcagatatctgaatgagcattgacagacggtagtgtggcagtgattaactgacgatgcatgcaggttgaggagacaaagaatgcagaccggagcggcccaattgggatcatcacctcggttcttttcgcgacggtgtttggttggatttacctgttggctctgacatctgtcgtgacggacatcccgtacctgctcagccccagcaacgacgccggcggctacgccatcgcgcaggctctgtacaccgccttccaccggagatacggcagcggagttggagggatcgtctgcttgggagccgtcgccgtcgccgtcttcctctgcggcatcgcgtgcgtcaccagcaattcgaggtgcgtgacagagctagcatcacgtcgccctgaatccctgatgatcgattgaattgctcaaagtgctatatacatactcgttgtttgtgcaggatggcgtacgccttctccagagacggggcgatgccgttgtcgcgcgtgtggtaccgggtgaacaagcacgaggtgcccctcaacgtcgtctggctcggcgtcgccgtggcgttcgtcatggctctcacggtgagttgcatttgcattcgcattgctgctccggtgattcacggtgagtgcgcgtgatgacgacgccttctctgccttttgccggtgcagtcgctggggagccaggtggcgttccaggcgatgggttcgatcgcgacgctggggatgtacatcgcgtacgcgctgcccgtgttcttccgcgtgacgacggctcggagatcgttcgtgccagggccgttccacctcgggcgatacggggtcgtcgtcggctgggcgggtgtggtgtgggtggccaccgtcacggtgctcttctcgctgccggtggcgtacccggtggccaacaaggagacattcaactacactccggtggccgtcggcggcgtgttattgctcagtgttggtgcgtgggtgctacgtgcccgcttctggttccaagggcccatcacgaatgttgacacgcattgttgacaagtatggtatcgtgttgttagtcagcgagtcagtggaaatatggaaccacacttttatattgtgtaatctatacgtgcaattgtagtcgttcagcagttatccaccattccggttttctttttttatcctttttattttgaaaaaaatgttttttttaaaaaaaacttttttgaacggttgaagagcgcagcaacgtgcgatgcgaggggcctgtctagggaaatttcagtagctgtagcttctgctataatcttcagctgccagaaactccatcaaacaatttagattttcacatatattttgaaaagttgtagttgtagaatctagaaaataaactcgaaatcagaaactgggtttgccagcttctctagattatcactaactgcttataagaagcttaggactctatcgtttctcttattgacggaataagcgaaatgacatatttgcaaacagaaaataatttgtaaataaaacttttatataagtgttcttagcaatataaacaaagtctgaaaaataaactttgatgaaaaaccccaaaatctatctattatattattaagatagctcgaaaagaaggcactacgttcgctgtggaggctagaaattcccatattaatcgaagaaaaagaaaaggagagtccaagtaaaaatacaatctaaaaaataactgaaattcggaattaaaaataagcaatattaaaagaggtgtccatataagaacccaatacgagattaataaaaccattgattacaattctaaattttaacggtctagatttgtaggagaaaagataagtccatagatctgtattgtgtacgttacatactaggagtctttgtcctttctgtttctttagcggtgtacacagtacacgtataatctaattcaattacaaacctacacgggcaagatttgtgctgccaaatatacaaaagcttgcactgctgcacatatatattctgtagatttcaagcagcaaagattgggcttgaacccaatggtagcgggagccaatcatagtaaaaagacatgatatttagatagacattagaataaatagatcaatacttgtagccggcaatgcatcaaacaccaaaagtttctttgatgtttatgaaagtacaaatgatatcgacatattgtaattagtgtatatttttcacaggagatggattaatgacagtcagattaaacggttagattatagtggattcacaatttaacgttcataatttaacgattgagatataacacgtatataggaatataggaattagagttgtagtgctaatacaggagtacaaagcggccctgctctgctcgacggataaattgagatccaatttcaaaactgttataggtttgattctaggtgggaaaaaaaagcaacaggaactaggtaggcagaaagccatatatatacgtgtgctcatgtaagtattattttttcagtctataatcacttcaaaactacttagaacatactttgaaatatttgttgccaataaaaaatgaagcgactgtctctttatctatttgatcctttttaatcaccaaatatacacccaacaattcagatgatttataaataactaaattcgaaagaaaataataaagactatgaaaagaaaaaagcatctataacacaacatgtgattaattaaaattaaaaaaaataaattacgaaattataaaaataaaaacaaaagtttaagaaagaatacaatttatgaataacaaaagttcaaaataaaaataaagaaatattaaaagaacaaccgtaccacaacaatggtaaatgacaacaaagaggaagggataacgggtgagccataaatgaataaggtgtagcggttgatgggatatttaaaaaacaataaaacaaaatcaaatgacgattaggttctattttaaaaatctcaacgacgattaaaagaaacaacagcgggcaagccgtcaaggagcgcaatcgtgacgtttgacggaacttctaaaaagtaaaaaaaaaaacaccaacgataatcataacatcatatttgactttttaaattccaatgacaattaagacgagacatcgggtggattgtagagcagtacaatggtgacatttcatgtaacttctaaaaatataaatatgcaactgacaagaaaatgaactacaaaaactataagatctaaatatgaaagttccaaataggatgaataaaagttgtgacatgtcggacaatcaaataaatgagcggcaaaaaagtaaggggtggcgacttattgactttcgaaaactaacccgatgataataagattcaatcttttaagatcggctagatggctatttaacaaaattaaataaaaccatgtttaaaaatagataattttggatgggtgttagccgtgcaacaaataaaggggtgacaaaggagtaaggatagcaacggatgtgaattttaaaaactatgaaattagaaacacatggatgataatgttcgatccttgaaagttctaagacagcgagatgaatattttaataaattttaagtagaatcgtgtgtaaaaatagataattttgtgggtactagccgcgcaattgcgcgggccacctagctagttagctctaaatctaagttcgaaaatttaaagttttacttactgaggacatatccggtgaaaatgagttaaatgttgaaaactcgtgaaaatcatacctaaaagtttcgtaaatttatgaaaaaaataatagagataagtgtagatataaaatacattctcaccaaatttcaactccaaacccaagttcgtttatgagaaaaaaaaagacaaatttcaggtgaacagtgtcctgttactattcacctgaaatttgtcttttttgttactcctaaacgaagttaagtttgaacttgagatttggtgagaatgtatttcatatctacacctatccctagtattttttttatgaatttacaaaacttttaggcatgattttcacgagtttttaatacttagctcatttttaccggatagtccccttacttatgataagcataaatataagccaagatgagactgttaagctctgcaaaacagggcccgtggactgggcgagcacggtgttttcctgttgggccgagccgtcatagagtaatgggccaccgttgcgaggcgacccaatagtgtagcgctgttcggcccagtttttattgccgccctcttctttcccctcgtccggagggcgcggcgggcggcggctatacgcgagtacgcgacggcgggttcttcccctcccgcttgcaacggcttcgcgtgtggcggcgcgttcgaatcctccaccaccggcggcgcctgctcccggcgcggcggcgcccccgcccccttcgcttgcgactgccccgccgcccagccgtgtgcgcttccctgcccagcctccatgcgagctctcgtagcctcctccgctctcctccggagatctgccgcccgtgccaacctctccggcgcgggcttctgtaatggcgcgcctcccgtgtcctctcctctccgccgctttcccctccaggtacgccctcgaatacttccccatctctaaggccctctttccagcttgagatagatttagaagagggggtatccaagtgtggtgttgattgattttgcgttttagactgaatttgtgggaatttgaaactcaggggattaaaaagagcgagggtattagcgtttcacttaggcggctccaggtttttgcccgtaagtaccgatgtgagtcagtgagtgggttgtgagtgtgtgaggagaaaatgagctctgcgcagtgtagtatggttctgccttttgtgttctgtcaagtgttccaacaaacgttggatttcattttttttcttccattctgacaataatacggaacacagatatgttcagctcaagttgttaatgaaaaaacacttataatgtatgtgatgtttggttcacagcttgccgctcttaaaacattaagatctggaacgctttatttttcttgaatttatgatatatgtgtcaaatatttgaactacgaagtaatgcagtccatctttacttccctgtgatttgctagaattggataaacgacagattttgttggttcttatcaaaaagttgttcgatgtcaacctcaggtatgctcaatgtttgtccacttattatcaatactcacagtttctgccgtacaaacatttcatttcttttttccttctaatgatatgattcttttcagttgatgtgcaattagactatgagactgatcccccactcgatggtgtaaaagttctcgagaaagagtcgacactaagtgtcgctgtctctcaactcgcaagtgattttgatagagaatctaatttatgtttggagcggttctcccgcacaaggcgcacacctgtgatctccactggttctcttaagcttgatattgctcttggcattggtggattaccaaaggtcatgatgtgctttcatattgtccagatctagaattctagatatttagtattccaatgatatcattactctttatcactatatcattccatatgatattaccttggtcctaaatcatatatttctgatataacacataaggatcaaagttcaaataagtcttctgcatggtgttattgttcagttagggtgtgtttagttcctgaaaaaagttggaagtttgaagaaagttgggagtttggaaaaaaagttggaagtttatgtgtgtaggaaagtttttgatgtggtatgatgtgatggaaagttgggaataggggggaaactaaacacggccttagttcactattttgttgcaatgggaactctaaaagtcaaatgtgtcatgtggggcttttcatcttttgatgtctaatttcccttttgtgttaatccaatgaaatctccatgatgtgttgaactagttaaattagtgccaaaagccctcttctttagttgtgaaaatactatttgttgatggcagtattttccttcttgctggacaacaaaaaattgcattttgtctatggtatttctgattaggaaatatatttataggtagaactgatgcccatatcttgcttagctttacttctgtcaaatgtgtccatatcatccatccttttttttttcttgatagcatatatgtttagagttaaaactgcaggcttaccttgattgatatgatcagtgagtgtagtggcatactgttttgaacactgcttttagttgtgctgtttgaaaattattgtagatatttaacagggtagaatggttgaattatttggaaaagaggcctctgggaagacaacactcgcccttcatgttgtcaaggaagcgcaaaagaaaggaggtctgtatttgtttatggtccttgctgttctttttggagtatacccttcttctaaattttacattatatgattggagttgtgactgggactatttgcaggctgctgtgcttatattgatgcagaaaatgcttttaacccttctgttgccgaagccattggtgtaaacgttgaaaagctcctgatagcccaacctgactctgctgaaaattctttgagcatagtgaacactcttgttggtggatcaattgatgttgttgttgtcgatagtgtatgtttcttccgcaatgtcagtttggattagttttttctcttctatttgattccttattggcttattaaaattttatgcattccctactatgacaggcctaatacttggataagtagttactaaatttgaaaattggactgctattcacttctgatgctctttagcactgtcatactgtcaggacatccatttttctaatatgtatttgatatcttgtgctttgctacatatttgtttaccttgcttttactggacttctgacaggttgcagcacttattcccagatgtgaacttgaaggtgaaatatatatgaattctgaagatgtgcagtcccgcttgatgactcgggcacttcgaaaaattcagcacacactaagtcgctctgaaacgctgattatttttgttaatcaggtttgggatgattgctttttttgcactaaccaggatggcatacttcaatatcgtttagtgttgatgctgcctaacttatttagagcttctgattgctaatgtttgcaggttagaacaaagttgagctcaaatcagactcctggaatcttcaaggaggtagcttgtggcggcaatgcattaggattctatgctgcagtcagaatgaggacttcaagaagggaattacgctacaatgaggcccaggtattgtacataacttttcatgcttctcatttcccttctccggttccctccttagaatactagcactagacaagagcgcgcattattctaggtaaagtgtacagcatttgtaaatatgcaattaagaaaattctgccatttcaggctactggcatcggtatatcagtgcagataatcaagaacaaattagctccagcaactctgaaggaagctggcattgacatcagatttgggaaggggatctgctacgaatcagagatcctggagctggcttcttcccttggggttattatgaaggatgattctgggtattggatcaatggtgagttccttccaaacaaggcagaagctgagaaattcctacgtgaaaatgctgctgtggcggatgaaatctgcggtaccatgaggagacaattctttgaaaggtgacaaactgaaggacttattctggttatcttgtatactagcaagcaggtgcgaaactcagaaggaaattacagtgtacagttggggcatcattgaagagtctaaaaatatcatttattacttgaagtgcagttaagggatcgacaaccaattagagaggctaatcttttgttagccttgtaatctcatcccaccatcaggcaaatagctcactactgttatgacatgaggtatggatgactgcccctatgagctttgtttgttcagtaagatcacagctgttgtatcatatatttacaggatatttttctgcaatgcaatttgttttcctcagcctgttgtaatttgacaaattttaagcacatcgagggccattccctcaaacaacgatacttcagtacaacatcgagggtcattccctcaactttaaactttcatgagcctcactgtactgagtactctatgccgtgatgtgccgggtagtcttggagttccaaattagcgtgtgtacgtgtgtggtcaagaaggattcagaggttggcattggtagattttttttttgaacaaagcattggaagattttagccagaaccgtccaacaagtagcggcttattttgacttgagctcttaagtctgcagaggtgtatctactctgcactcacccgtgtgcgacggggttggctaacccaggaggaaaggaaaaaaaaacacggagcttgtttatgtggtgacgaatgaacagtaaatgaacgtatgtcaatcccatttgtattgatcttgtccagtcttcgcctggaaattccgagcagcgtgactataaaagcaagcttgcagcgttgcattttcttacatccagatcgagttcaagtgcaacagatcaaactagtagcagcagaagatgtctatgcaaggcgttgttcctgtgcttgcagcggctttggccattgcagccttcgcctcctttccttcaggtacacatattgctaagcttcgttatatgtaggtcgtaagtactaagtttttttttaaagataatgtaaatgtattcctgcttgtgttttataaagttatagcttcccttaaaaaagaagttatagccacttattatataactggcttaaaagagagctcataaaacctaagacatgaagatgaaaaactaataatagcaacactaaagaagaaacttttattcaagtctatttgtaaatctccaactgtagttaacaaaattattcatagccgttgactctagattttggcgtgcagtatgcattagctcgtttttctcgtcacacctttgtaaatcgtaagtacttgtcctaaaattagtggacatcagtatgataatgtcaaatttacgatttaatttggatctggatgaattgagtgcttacccgaaaactagtcatctggccacatatgtcaagcctaccgtgcgatactgtgctcgttgtcactgaacccgtacgcttgtgcgtgcgtatgctgagatttggtgcagcatgcgatccatcggcgtgtgctacggcatgaacggcgacggcctcccgtcgcggagcaacgtcgtgcagctctacaagtccaacggcatcggcgccatgcgcatctactccgccgaccgcgaggccctcgacgccctgcgcggctcgggcatcgacctcgccctcgacgtcggcgaacggaacgacgtcggccagctcgcggccaacgcggactcctgggtccaggacaacgtgaaggcttactacccggacgtcaagatcaagtacatcgtcgtcggcaacgagctcaccggcaccggcgacgcggcgagcatcctcccggccatgcagaacgtccaggccgccctcgcgtccgcaggcctcgcggacagcatcaaggtgaccaccgccatcaagatggacacgctcgccgcctcatcgccgccgtccgccggcgtgttcaccaacccatccgtcatggagcccatcgtgaggttcctcaccggcaacggcgcgccgctcctggccaacgtgtacccctacttcgcgtacagggacagccaggacatcgacctcagctacgcgctcttccagccgagctcgaccacggtgagcgaccccaacggcggcgggctgagctacacgaacctcttcgacgccatggtcgacgccgtccgcgccgcggtggagaaggtgagcggcggcggaagcagcgtcgtcgacgtcgtggtgtcggagagcgggtggccgtcggacggcgggaagggggccaccgtggagaacgcgcgggcgtacaaccagaatctgatcgaccacgtcgcccaaggcacgccgaagaagcccgggcagatggaggtgtacgtgttcgccttgttcaacgagaaccggaaggaaggcgacgccacggagaagaagtttgggctgttcaatccaagacaagacaccggtttacccaatcactttctgaaaaattactccaatacggaatatgtactacgtcgtacagtatatatcatgtgcttaatctggtgcttacgaatcaaaatctgttagaatttgtatgtgccagatgttgaacatgaacagtcgttgaacactcacccaccacatgtgcacatatgtacttttaaacaagctcatgtttcaattgtaacatttggttaacgaatattttggttggatttggaaaggtaggaatgcacggtaacttttggaacagactaatttgcacatggtcgatctatataatatttgtacgttacatctagataacacataaacaagttgtcgtatttagctgtctcaaataaattcgtgtaatgaataatttgattctatatactacatgtactctctccgtccctaaatataagggattttgaatgaatgtgacacttcctagtactatgaatctgaatagggagcatgtccagattcataggactatgtgtcccatccgtctaaaaatcacttatattttgggatggagggagtacgatggtataaacggtatatattaatgaccggaggaggtatttccttttcctccacatcattaaaccattgttgtactatagtatttttggataaaatgataaatggaagtaatattatctgacaaaggcaaaaagggaatgaaaaaacttaaaacaatttgattgtgtcacgctgcctttgtgacaacctgcttcttcttcttctttgaagttgggggctttcattaaacaatttgaaccatgacatgaggtccgattgaaggtgctctctcgtacaacactttttataaaaaaatatgttctttgtcgtacatttaatatgaatttagacaagtttttgtctatgttcatagctaaaaatagctctattttgagatgaaaaaaagtatgtcgaatgacgattgtgactagaaaggtctatacaagatattcgtcccaaagacttagctcaagaagcaacatctttaacagggagccgatgaagaaatttcaacgttgtcggaatactagattagggttttcacccccaaagaacatcaccacaatctgttgttcacccccaaagaacatcaccacaatctgttgttcgaacgtcgatccaattttccgaccaaaatgaggatgacccacaaactctatttcaaagtggcaactttcctggagccacatataacaagattagttcgccagccaccacataagcaaggagataaaggaaaaaatgaaaataaaataattacaccagtcaaataaagcaatagaggatttgctaatcaaattcatcatgaacattggttggattccttgagaggtcagattcatcatcccgtatttatgtcttgacatttggaattttgattttctggcactatggtttgcagcttatcgggaacctattcagtctcatctgcatgctgagtgtttatagtttatccggaacaattcacacattcatctgcttgctgagtaccagtataaatcaagctgctctgctttgaactctgtaaattacatccagaaaccaagtgaactataggtggtctaggtacagaatacgccacatttgttacatctctctaggtttgagaccacaagagatggtgaatatacgaggtttctccctggtttttgcagctgcattgctgcttcttggagtttttatctcaatccctgtaggtacgtgattcgcctgtactattgaatattgatatatgtattgttgatattaatctatctgattgaattttttaaattttttataactatttagatgacatgtagacaatgagggtatgtctcgtcaaaagtttaaaatagtttcccattgtttgaaacataagaattttgaaaaaaaaattataaggactgaactatttccgacgaaatttctgcaaaaactttgtacttgtccaaagagatcttaggtccatttgggtaggtagaaacaaattaaagatcagagcttgtactgatgctttctgtctgaatgaaatacatgtggtgcaggcgtgcaatccgttggtgtgtgctacggcatgatcggcaacgatctcccgtcgaagagcgacgtcgtgcagctctacaaatccaatggcatcacagacatgcgcatctacttgcccgacgtcgaggccatgaacgccctgcgcggcacaggcatcggcctcatcgtcggcgtcgccaacgacatcctcatcgacctcgccgccaacccggcgtccgccgcgtcctgggtcgacgcgaacgtcaagccgttcgtcccggcggtgaacatcaagtacatcgcagtcggcaacgagatctccggcgagcccacgcagaacatcctcccggtcatgcagaacatcaacgccgccctggccgcggcgagcatcaccggcgtcaaggcgtccacggcggtgaagctagacgtcgtcaccaacacgttcccgccctcggccggcgtgttcgcggcgccctacatgacggccgtggccaagctcctggcgagcaccggcgcgccgctgctcgccaacatctacccctacttcgcctacatcggcaacaagaaggacatcagcctcaactacgccacgttccaggccggcacgacggtgcccgaccccaacaccggcctggtctacaccaacctgttcgacgccatggtcgactccgtctacgccgcgctggacaaggccggcgcggcgggcgtcagcatcgtcgtgtcggagagcgggtggccgtcggccggcggggactcggccacgatcgacatcgcgcggacctacgtgcagaacctgattaagcatgcgaagaaggggacgccgaagcggcccggggtgatcgagacgtacgtgttcgccatgttcaacgagaaccagaagcccggggaagccacggagcaaaactttggagccttctaccctaacaagacagcagtctaccctatcaatttccagtgaaatcgttcatcatcagcgccagttgtcaaattcacgcgattgcttgcgctgtaatagcgtattgtattcggatgggaaactgtatttatatctcgagaggatgctctctcctttgtttaaaaaatatataaatagttataaagaaattctaaaaaaatgggatatattcatataacatacatgtatcagtacacaaaattttagacccaaactcaatttatacattaagatataaaaaatacaacttcaacatataaatagtagtgtggtggtgtgttattattcgggatattaactatttgtcattctcagttgtggcaactaacaatttaccacctggacctatatgtcatatacacatgaggtctcatatgtcattggcacatgtgtgacaaatagttaaacaacaaatctaagagtggcaaatagttaaatactctgtactattcatagctgaatttatctctttttttctcatcgtgtaggtcgaatttgaacttgctttttggtgcagtgatagatgtactgtacctacaattgttagtttttttaagatttttttatgactatttatattaaattcggaagaaaaaggtatacgagataatattctgtggagggattagaacccgtttctatattaggatacaaatgatttaatgatttcctatatataataatatttttttcttttcaggtatttcccatatctgatctcaaaaacttaattagtgccaggtcatacagattccagataattccataggtttaattcgtggtacgtccatgctgaagaaattctatgagatgcgtgtgtatagtaactgatgtggatcaggtattcaggtgagttctcaaccgatggaaaggtagtgttgtgctgctaacctgacaaaagaacaatgaacacacgtcaggaagtcactccggtacaagccaccattccattcagttagcaccccaaacctgaaattccacgtactggtcaagaatatacgtaagaattcaatgcaaaatcggatatacggttggaaaaacaaactagtgtggtattagtagtgatcttccgcgactctgtgtactgctgatgagggaagaattccatgaagcggaagaatacatgctgtgtctaagtacgccaagaaaacagaggcgagtttccacgtttcgtggaattttttagctccaacaagccgctgtttctgtggaaaaaatgggaggaagatggctagttaggctgcaaatgcaacgtagcagctagctgtaagcacgcacttgggccgtggatgtgaggaaattaatgtgcctaactggctagacactgaaacttgtatataaaggggtgtgcattggcacatagcatgcataacattcaggttcaggagcagcagttgggagtagctagctgggacaacaatggccaggagacagggagttgcttctatgcttacaattgctctgatcattggagcatttgcttctgctccaacaagtactgatcagattctctctatgtttctagcaaatagcaattctctgttttgcttgcaatgccctgagcacgtactgtaagtgtttagtggctagtcagagatttgaggggaacaaaattctgaagagcaccacaatgttctttatagaataaaccacattttatctatatgcatcttgttgtcttttcataactatggaatttccccacgtaattttacacgggtcagttgaattgaatttgatatagaactcttagttcctatttccatatatgcaatattttctacacaatacattacaattgcaatagtactttgtatacaaatattgctatatactccctccgtttcaaaatgtttgacaccgttgactttttaagtacatgtttgaccgttcgtcttattcaaaaaaaattgtgaaatatgtaaaattatatgtgtacatgaaagtttatttaacaatgaatcaaatgatatgaaaagaataaataattacttaaattttttgaataagacaaatggtcaaacacgtactaaaaagtcaacggtgtcaaacattttgaaacggaaggagtattaatctacaccgttaatttggtcctagatgatgtaattagcttagatcttattattttattaatatgataatgtataggtatacatagcgaatatggtgacttcgtttcaagttatcattatgttactatacaatatatatataatagatcatgtctggtctagataatataatagataatatatagatagatatatggaagatagataaatagatagatgaaactaaataaaatgtccggaccagatagacactatagctttgggttaattctttttgggcaaacaaagtttcacttgaaattcaactaggcatgctctgataattcgaaggtgcacgttcattgtgtactctgctatggtttattggaaaacctaactttatgctgtcggtgtccattatcctgtcgtgcatatgcagctgtgcaatccatcggcgtgtgctatggcgttctcggcaacaacctcccgtcgcggagcgaggtggtgcagctgtacaagtccaagggcatcaacggcatgcgcatctactaccccgacaaggaggcgctcaacgccctgcgcaactccggcatcgccctcatcctcgacgtcggcgaccagttgtccaacctcgccgccagctcctccaacgcggccgcgtgggtccgcgacaacgtcaggccctactacccggccgtcaacatcaagtacatcgccgtcggcaacgaggtggaaggcggcgccacgagtagcatcctcccggccatccgcaacgtcaactccgccctggcctcgtcgggcctcggcgccatcaaggcgtccaccgcggtgaagttcgacgtcatctccaactcctacccaccctccgccggcgtcttcagggacgcctacatgaaggacatcgcgcgctacctggcgagcaccggcgcgccgctgctcgccaacgtgtacccgtacttcgcctacagggggaacccgcgcgacatcagcctcaactacgccacgttccggccgggcaccacggtgagggacccaaacaacgggctcacctacaccaacctgttcgacgccatgatggacgccgtgtacgccgcgctggagaaggccggcgccgggaacgtgagggtggtggtgtcggagagcgggtggccgtcggcgggagggttcggggcgagcgtggacaatgcgagggcgtacaaccaggggctgatcgaccatgtcgggcgtggcacgcccaagaggccgggggcactggaggcgtacatattcgccatgttcaatgagaaccagaagaacggggatcccaccgagagaaactttgggctcttctaccctaacaagtcgcccgtgtatcccatccggttctaagtcagatgctgcatcggatcgacatagcagctactgaaagctcttgctcgtatgcatccttaaaattaactgtaaactaaaaataagctagcttcaagcagagcagtagaaataatcaatcagtaataaagtgtgcagcacgtatggtgtgcctgcgattctcaaattccagaattaatagtgtattatgccatgagtaaagtgaagaaaatgtttttttccctaatcgacaatgaatcagtgcatgaacaattgagcgcgacttatatgttcatgaggagactattttgatcctcgagaggatgtcacatccttatttgcattctactcaaatgattataaaaaaaataagaagatgtattaacatgtgatatatcactacacaaacatgcaagttcaaattcaacttctatatctcgcaacgaaaaaaagaagtcctctattttgcttgaaggttcatttacggcgcggtgtgataactgcaaggaccatggtatctttgaggtttatttttaaacatggtacaaacgcatacgttcacaaacagtgaagagaaggaatgcaattaaattcgagggtacaaaaatttcaaggtgtaatcatgaagaacaaaatatgagccaccaatgcaatttacagtaccactggtattctagcgaagcaagtttatgcgattgtagatatgcaattttctcaagttgggtgtactgttaaatactactaatggataagaatttccatgcagcggcagaacacaaatggatgtcccgttcttttctccaacaagagttggatgaagattaagattctcgttgcaattttcgtgcgaaaactttctatatgaaagtttctctaaaatatcatattaatctatgtttcaagtttgtaataattaaaattcaatcaatcatacgttaataccatatcgttttgcgtaaaaaaacttaatcttcatcttcaagagaaaagaacaccacaccaggaaaacataggtgagtttccatgtttcgtggaatattttagctccagcaaggcgttgtttgtgtagaaaaaatgggaggaagacgacgagttagggcaactacaagtagtaagcttgcgttggatttttatacctaggtggtagaaagagaagtatgagagagaaacgtcgtcgattaatttgtcgacggtcatgcacgggcaccaatgctcctatcgctggcttggcgccttcctatcgacgatatcgtcgactgataaagaaattagcatgaacgggcttccctgattggcttggatgaaagagaaaaggggaataggtgagagacaaaataattaagcgatgatgatataaatgctgtaggcctgtagtggataactattgtatttagagtaaatttcacaaaactatagatactatgaccaaactatcacagaactacagatttaaggagttgtattataaaactacacatttagcaccaaatttatcacaaaactacacatttaagatgaagtgtcacaaaactacacgtttagtaactaaattataataaaactacaggtttagaaccaatttaattacaaagtaataatgtttatagctccaccataacaatagtgctagggatttaaactctaaaagttgtagttttgtgataagttcaatattaaatatgcatttttgtgatacttaacctaaaatttgtagttttgtgataaatttggtgctaaatgtgtagttttgtgatacaactccttaaatctgtagttttgtgataatttggtcaaaatacctgtagttttgtgaaatttactcaatggattaatataatttttaaagcaattttcgtatagaaaatttttacaaagaacacaccgtttaatagttcaggaagtgtgcgtggggaaatcgaaacaaactcactcacaatctctgctgccgaaggctaaggttgcgggatataggaattggactgaggcaattgagtgagttcaattagacttttaccacggcatagcgatggctactatccaaattctaatgggcccaattatgatggcccaatgttagtttacgatttgtgggcctaatcggatcgttgcgtttgtccgggaatcggtttatctggaccgtaaacttcaaatccaacggttcacagaaacccgacgggatagggtcgttacaatgtccgcaagttggcgcgcagctcacctcctctcgctccttgcgcttttcgggccgccggcggcggccggagctagctacaccacgtgtgaaggttatttttactctgagaaggtagagagattctacctattgcattaatgatgggtcaaaatgatacaaacattcctaagtaggctgccaaacggtgaaaaggtagacaaatactgaaaaatagaagtgtaacgaaaaggtaagaaaagatagaaaaaaaaggaaaaggaataagtgaataacagagaaaacggagagaaatcttagagaaatcaataaaaaactggttctcttgtctcagtttagcttgttaatccagtggcggattcgcacacgatggcttgctttggacacgaaaacccccatcctaccgaaaaccacctccaaactatcaacttaactacggcgacgagagggagacggccgggcttccgccatcagacggagctggtattatttccttctcgatcgatctcgcatgtcgagctgacgaaagaaccggaagcgactaccgtcgggtgcctcgtggagaggaggtaaaatcgggtgctgacgtcagcatacgtgtaaaaacaatttaaactattttttctcttaaattatttatcatgatttaatcaaaatcatgatctgattgcacaattaaattcgttgcaattaaatcttcaaaacaaaaccacacatggatatattccaacggatttttttatcttattattgaattattttcaaattgtcgacagtgggtacccgtagaccggatatagagggtattggggtacgctggtacgaggatctacgtagtacgacatcaagcaaacagaaaacaagaattatactggtttagaccccttagcaggtaatagccctaatccaattggtatgggattatataatggaaaccacagattacagaaggaatagcggaactcgataataccgacgagatcgtagtcgagttggttcgactagatcacacggcgacttggctcctgtaggctccggcttcgtaggctgtggtggatgtgttggcggtgtgattcgatgccttacgtcctgccgaggggtcccttttatatcgcgggtcagttgatctccaagtaggactcggagatatcagacccctcacgatatggcaaatacccaatcttgtctgagtaggactccttccatctgtggattccgcttctatctcgtgatagatttctttaacgcatacaaggactatccgtatacgcgcgggtatgccatatcaatatacaacgcatatctaaggatagagggtataccttatccgtaaccctgacagtagcccccaacttctgcttaaatgaactcatgtaaccaatcgtgacttctgatgtcggaatcgttgtcgttctcatctgatcgatctcggtgtgagaaccgtagagacgaagagttatcgacaatgccgtatgaagttcaatggtcatgaatgaatttaaattgaagtctaaaaactaccacacgtaacggacccagaattttccggcggcaatctctctcctttccttggaatacgcaccgtcggtagtgcggttatttaaagggattttggggatccattttgaagtccgtttgccaaagaactctcaagtcttcaagcgcccttcgtcatctccgctcctgcagagaaaaccctagcctgcttctttcgctttactctccggcgatcctccggcagcgatggatctcgacaagtccacctccaccaccgcgtccctgaagaagttgcaagatgacggcgccttcctggtcgcgggaccatgcagagggagttaggaggtattgaacccgaacccatcttgggccgtatggttgcggtcgaagattacatttcttgcggttttcttcctccgccttccaaatttcttcttcttgtcttgaacttttatggcctttctttgcttcacctgaaccccaactccatcgcattccttagtattttctcctatctttgcgaggcctatattggggtagagcccttccttgatcttttccgtttttactatgagttgcgctggatggaatccaatagggtatccggatgtgttggattccgactttgggatcgcctgaagtcgcgttacatccccttccagtgcccctcttctcgtagcaaatggcgggcgagatggttctatcttcagatagaaaactcggatcccgtccttgttgtcccggaagaacaaccagacaaaatcccagagtggaccgccaaacctgccctgactccctcccttcagtctttcatcaacatcatcgataacctccgaactcgagggttgtcggggtatgaagtcgctgccgacttcataagtagacggatccaaccgctccaggcccccgcccatccggcctttgattactcggggccagaggacacgacccgggtctctcctcggggtattttttttcttgtatttcggattttgtcctggatatgtctgtttctcccgacttatcgagtttctgttctcgatctacaggtctggacagtgacaccatgaaccgccgcgtcggccaggtgatgatcagcgctgcctcgacggcgagcgacatcccgatccccctttgcgagaagggtccggctgaacacgaggctgcgatcaacgtgagtgtactcgatgtatcctttacatcttcctccccaggatcgcgtcgtgacttcatgttatgcaggctctccctctgacggacgtcatcgggccacttatggaccactaagcggcagcgtccttgaaggagggcgtcaccaaggaggcgtccgacattgctgctgctaccatgagtggcagcaatgttccgaagaaggggaggaaattctcctctgtactcgggacctatcggaaggcgccaagcccggtggtaagcctctcttgttctttagcatgtagtcggaatgatttagcctcacatcatcctatctcacttaggcctcggacgcgtctcctccacctcagcgaaggcagaggcttgtgacgatcggcaagaagtaagtggatattttttgaagttttttcattcacaaagtcctgattaactagcttcatgaaagagaggaaactcttcgcagggcggcacgggcgaagccggcgcaaggcgggactggttcgacttccagcacgtcccctgcagcgacttcgacagatgtcgtggtcgctactaaggaccgggaggtgacgccgagtagcctcgccgtcggccttgtgcctgctcggggcccgcctgccgatgccctcacctggggggagctccaagcagagatggagtgcatcctccaggccggtgctcgcagcgtaggctgcgagatcgaggaggccaaggcagcggcgtcgtcggcgaaccaacgcgccgacaagctagcgcgtgaactggcggaggcccgcgaggacctcctgaagatgagggggctggtggccggcaacgaaaggtagcgacaagggctcgagcaccggatgtcggagctcgagaacaacttgtcagagatccgcggctcgctacgggtatcttacaccggcctacaccagctcgccgggtagtgcggcgtcacgaccaccatcccggcgaaccctgacgagttctcgctgatgtcctcgctcgcggagctagctacggcaatggaggagatcccctccaagcatgcggctaggatcggtgaggagacgtccaacgggatctacaccagggcgtgccacgtcctcgcgtgcgtaaggccggcgcatcccgacttggacctgaggagggctctggaccaggaggccgccgatgacgcgtgcaagggcgtgatggaggaagtcggagatttgggggagtctgtcctcccccttttgaatagtaggattttattttccttgtactccttaattaacatgctgtaaaaactctcaatgggcttgaactgcttctatccatacagtcatctttccttgtcttcttagcatgtaattccgagtattttattgtcgttatagggatgttcatgttgagaatgtccagcagcgcgggcaccttgactaaacaagcttaccacatcatgcttaaattaaatgacagatagcctatccaaaacatgcaagtgttacgtatatatacgtaacagtttattcgatcaaatccaaacatgcaactggaacttacgtactccctccgtcccacaatataagggattttaagtttttccttacaacatttgaccactcgtcttatttaaatttttttggcaaatataaaaaacgaaaagttctgcttaaagtactatagataataaagtaagtcacaaataaaataaataataatttcaaaaaattttgaataagacgagtgatcaaacgttacaaacaaaaactcaaaatcccttatattataggacagagggagtactatatagtcgttgctttcctcatcgatgtccttaattgtatggagcctgtaagtgctgttctctttagaaattaatggtgtaggccggcgactgatccgggttgaagaggccgaagtgcttctcggtgtcggcgcctttcttgtcgtactcgttgaacattggcgggaactgttttaacagctcaatcgagtggacgtccacccgtttattgtatgtcatgtaaatggttatgaaaaaattaaaaaaatatgaacaagatagataaatatgtaatatatcactccacaaacatgcaagttaaaaatcaacttctacaaattctaacaaatataacaaacaagactcaaattaatatatgtatatttacagttaaatttttttatttttggtacaacttgtagaagttgaatttgaatttgcatgtttgtgaagtgatatattacatactgatctatcttgtcaatttttttaaaaatatttcgtaaccatttagttgacatgcagtaaacgggtggacgtccactcaagctattagaatccatctccgaaaatgtagatctcgattctcccggccctcttgggcgtcccctgcccgacgtgtttgatcaggttctggttgtacgtctgcgcgttgctggcgctcgccgccgtgccgccggccgacggccacccgctctccgacaccacgatcgggacgctcccggcgccggcgctctccagcgcggagtagaacgtgtcgacgatggcgtcgaactggttctggtaagccttgctgccgtccggcaccaccgtgcccggcgacgtgaagagcgcgtagttgatgtcgtcgatctgggcccgcaggttgcccacgtaggcgaagtaggggtagacgttggccatcagcggcgcgccggtgctcgccaggtacttcgcgatgggcgtcatgtacgaggtcgcttcgggggagaacatgccattggacggcgggtacccggcgagcacgcccttctgggacaccgacacggacaccttgatgttgctgaggccggcagcggagagcgcgctgttcatgttctgcatggccgggaggacgttctgcgtgttgccgctctcaacctcgttgccgacggcgatgtagcggaagttgacgcccgggtagacctggacgttctgcttgacccaattggccacggcggaggggtcggaggcgaacgcggagaggttctcgttggcgacgcccatggtgagggcgatgtttgagccggttagtgcctggaggatgtcgctcctcgggaagtagatgcgcatggagtcgatccccttcgactggtagagcttcacgacgtcgctcggcgacggcaggttgttgccgttcacgccgtagcacacgccaatggattgcaccactgttgattagtagaacgaacaatatatacgttacacgcactcctaactcttaaaaacaacttctataaacgaatggacagctatttatccaaattcatccatgaaagttgcttcttattgggaatggagggtgtaggccctaatacacgtgatatatatacttacctttaggagtgaccgcaagtactccaaggaccaatgccagtgttaaaatgaaagcaacaccatgctttgccatatctttgtttgcaggcacaagtagctatagctagttgttagaagcctggtggactttgcatgcagttgcaatgtaacaaaagcattcacccctatttatacaagttcctagcaggtctataattagcatgcatttttttttgaaaaaaaaatatattttaataaatgacgttgttgacttttgaaacaacgttggactgtttgtattattccaaaaattagtgtgaatatgctaaagtataagtcatgcttaaagtttctttaatgataaatatgtcacaacaaaaataaataatattactataagttagtaatggtgttatctattacaaaacaaagggaggaattatgtagcatgcaatttgcgaggacgtgtaaaaactttcttgcggataaacagagtaaaaatgcggatcagactaatcctttgtttcagagagaggacgtgtaaaaatatgttcatggtttggggcacaaactgaagctacacatcttcaaagatcttgaaattgatctagaggtgattcggagcgatgaaatgtacgtgtaaaactagcaaaaacacatcggagtcagtgataaaaaatattttttttgaataaacatgaaattttgaagttgtccattaaaaatggaatcggttgaactaaaaaaaatgttaagtgggcatgcataagtagggtgcagttgctttctctcgtacgtttactttccttttcagtgcacgaacttatcccaaactgaaacgattttcaattgaagagcatgcaggtatgtcattgctgtgctcaacgcctactgaactagctgttcattgcatgcactgatgcacgtggaccggggaatgcaatggtaaacttacaatattgatattaaggagttgactcaagtattaaataacatccctttcacatttaatttcggcattaacaagcaagtaatcgcagatttttatccaattggtgcagtcttatgcaacttgatagcaccacattgagtcgatccaattagcaaacgaagggcacaactgcacagcatgtatcatcagtaactaattctcgctcaaaatcggtgggcttgactggcgtcattgcatgggaaacccgttggttcccccggatttacgatttcaattaggttagctactcatcttcaaatctagaggaaaaccaaaattgaaccgaaagaaataaggtgcctatttgattttgagttcgcctggctacttgaggcttgactcttcagcaagtatggcacttttggcccaggaggatttcgcgtgaggcttgcggggttggatacttgtgggctctaagtggatgatcgctcatcttcgatccagtcccaaccaggatgaagtgagaaggctttttgtttcggccatctgggttacatggccatcgtttcggccgtgagggctttgtgtaagcaaaaagtccaatttaagtccccaatttatagttcgaatcgaattcatacctgtcgacgtttgatgtctcgactacggtatttggacagtatggggatcgtcggtgctagggtatacgcgctgaggtaaaagagatggagacgaggatttttatacaggttcaggcccctgagctatcaggtaatagccctacatcatgttggccggagccgatgttgctttttattcaccataatcacaccagtagaatatgtggggtagcctatctaactgttg

SEQ ID NO: 59289 - DNA, 6696 bp, Oryza sativa
ggtcctcccctcccccgccgaccccgtcgaccccgccgagggcttcaccccgcaagcccaccgcctgaggaggaagacgacgtactgcttcttcttgtttgatgatgcgataaaataatcttcacctctaatccttacgagtttcactgggagtgtttgtttctcgatcgatgagcgatttgatcatacgatgtttagaaatttgttcagatgttgataatggcggtgtgccactttgcggttactatatgcgctgtttgtgtcttcagaaactgttagcatgacacaacttttaaactgtgtgcttctgttctgttaagaatgaaagtttattagcagatgatggtgatctcacccaaaggttaacatcgctgacttctctattgctcattgttgttgtgttgttgcgtttggtttggtgtgctcttaaaatattgctcattagattggtcgaaaccggttatcgagcagggtgttaaaaatcacgcaaacacacgagaccgagaccgatcttaaagaaaaagggatttttgatcccgttgacgctctagtatgtttcttctcgtggttactcttgcctccgccaaaatccatttttagagaagaaattttacgatttctagaatgtctcgaggtaactaaattttaccttacaaattttgatacctcgaagtattaagtaccagaggtatcaaaatttacgctggaattaccctacaaattttagtacctcgatgttagcactaaaggtactaaatttgtattagaaaatattgtatttttcggtactttattaattgccccttattaaaagtgataaaactaacttattgggccggccggtttgcaagtagctcgagaggcccagcaagcagcagcgtccaccacactccagattcctctttgcaggacacgtctcctctgccgccgcctcgggctcgccatggccacgccggcggccgacgccacgtcctcctcgcccacgccatcgccgccgccgcaggagacaccggcgcgcaaggcggtgcgggtggtggtgaaagggcgggtgcagggggtggggttccgcgactggacggcggagacggcggagtccctcggcctcgccgggtgggtccgcaaccgccgcgacggcaccgtggaggccctcctctccggcgaccccgccaaggtcgacgagatggtctcccgccacctccccgtcggctcccccgcctccgccgtcaccgccgtcgtcccctcccccgccgaccccatccacccctccctcggcttcgagatcaacttcaccgtctgatcttcgccgccgccgccacgtcatcaggtacaatcaatcacgaataaagatcaagaaaacctgatttgtttatccatgttaggttgtgatgctaatactagtagtaccatgtatgctagtgtttcttcatcaataatagtccatctctatgttgagttgtgaattgtgaattgtgggctatgccaatatcaaatcttctctggaattggcacaccagttacatctcattggccactggaatgatctgcataatccagcttgcctgaataatctgcatcaaactagagatgttctagccttccaggttcctgtattatctcaattcgagtgatgcattcctctctggtttgttcctgatgtacatacaaatccatacatatagtgatatatacctcaaagttgatcaacctacctacttgattctagctagacctgcatctcagatacatcaatgctcttcactggcccaatgactgaaaggtgaagcctttttcttgcactttcactggctcaatgactcaaaggtgaagccttttcttgcagctcaatttggggcttggcatcatcgtccacctcacggagctgcaagggcttgaacaagtagcacctagcgcaaatggcgtagtatgccaggttgagcacctggagcagcgcgacgatccagtagaagtagtcgagcctgccgcggttgatgttgtcggggagccagttggacccgtcggcgccggcgctccatcgatgcacggcggagatgagcatcgtgctgacgtagctccccagcgagatggacagccagaacagcgccgtcgccatgctccgcatgctctctggcgactggtcgtacatgaactcgaggtgacccacggagttgaatgcctccgccatgccgtggagcgcgtactgcggcaccagccagtacgccgacagcggcgacgtccccgcgtcggtggtgcccgcggcggcagcggactccctccggtggcgctccacgaacccggccacgagggtagccgccacggagatggcgaacccaacgcccatccggtggaggtaggagattccacggtccagtcccgtgacgcggcgcgctagcgggacgagcacacggtcgtaggcaaggagcgtggtgagcatggcgagcagggtgaacacggtcatggagcctgctgggatctggaacgacgacagccccggcgcgaggcggcggtccatggtgctcgcctgctgcagggcgaaggtgtgctgctgcgagtacgccgtgatcaccaggatgcccgctgcccagatcgggcccatgcggagcagcgacttgagctcctcgacgcggtgcaccgtgctcagccgccacggcttggggatgggagacaacgacggcttgccgttggaggtgtccgtcgtcaggtcgccgtcggtgacgatggccgctcggtcaaaaaagctgtaccaccggagtcaagaaacatcacaatcagtgcaaaaataacagaaaaaaaatcaaattgatcataattgttgcacgatcagttaacacttttggacaattggatcgaagtcgaaatcattgcacaaaacacattcatatcagaagaaaccaaatggcaagagtttgcaatttgcaatggacattctagcactcaaccttaggctgtgctgctattagtgtacgttttctttttgttgaaagacctttataacaatttgttgagactacgaaagctttggaaatttgaatataattttaggttctgacagagctttacatcattctgggacttacggtttctttcactaagtactaaagggtacctcctatctgccattacaaaacttattgcatttctaaaggatttctccaagagcataaagtagcaaatctagagaggttttcagaaaacacagtacccctctaaaccctgaaatatattgtaaagtttggccttagtttgttacttgttactcctatccaaaccgtgctcaaagttgcatgacatagctagccttcggaagcaaagcagagactcgttttgagtttgaacagagttaccaagttcctcatgaaaacaattgaataaatttcacaaaacgccaggtttttttttgatattaaaaaacgccaggttttaggcacccatttccagatattactatttgttctgaataatcctaggttttatgacaaaatgtttaaagaaacctcatgtttaagcttatattgtcattttttgctaatatttttttgcacaataattgttagaaaaacataactaatttttagcttactagttatggtttatttactagttaagctcaatcatctttgttctctcatccaaaaaagtaaataaaccataactaattatctattgaccagaacatatcttgacagacatatgattgatgctgcaatcacgagtcactcgtagtcatagttatatctcttaatcaatcatggacccatgaattcccatattttctttggtccagtcaaattatcaaaagccagagaccacaagtccacaagagatagattatccagcggctgctgtcgtttcagtactgtgctgcagcagtgcagcgtggaaaaagctgttctaagtttcggcgccattggccgacatctcctcctaatctgcttatccatgtcttcttgttcatcaatggtttttggcttcgaccccccggctttgctggttgcatgatagtgagtaccaaatctctttttccctcaaactttgggtttgtttaggtcactccaaaattaaaagttcggttgaaattggaatgatgcgacggaaaagttgaaagtctgtgtgtaggaaagttttaatgtgatggaaaagttaaaagtttaaagaaaaattttagaactaaactcggcctttggtttatttaccagctacacgtctcttcagagttcagaaacaccacctcctctattatttttgagtgattgctatatagccccataatcagcgggtccacgaatcagtgacccatgccagaagagactcatcatgtctcttctggttttggaatgtggtagttagtagtagttctctaaataagagttgctaggtggtgttacttgtcaatgattttaatttccttatggactaaacgtgtttaaatattttgcaagaagagaaatgtaaattaaaacttaatatttttctatgcattagttgcctgaaaatttgttttgtctaccacgtaggcttcctactatacaaaatcgcaactttaatgtaactttactaaatcaattaatctgctctgttttatatttttattggtttatgctaatgtgttctcatgcttcatctatatattagtttttttttcatattggtggaaattcataaaagtataacattttttatattaatttatttcattatttaattgtttcacctttttttgaaagtaaaagaaaggtaaatatgtgagtctttggatgcttcgatatagtagtgcaaaataattgataggtaagagaaaaccagttaaccaggtaataaccgatcacatgtcgaaactatagttgttcaccttttgcattgtaaagagttcctttttctcaaaaaaagaagataaaaatgctataaatggagcaaagattgaattttcaccacaaaaaaaggaaatcatccaattttcaaaaattgaaatatatatatatatatacacactcaaaatttcgatggtgccggggacggcaagaccgaaaacaaccaaattcggtccgaattcagctgaaattaatcgaaaccacactcgatcagaaccggtcgcagtcagctggtacctgagttgttcggtgtggacgagcttgccgtagagcgagatgggcgcgtccatgtcgtcgttctcgtacagcgccgcggcgtcgtcggcgtccgtcggcacccgccgcttcctgacggcggcgacgaccacctgcgcgagccgcgtgaaggggctccccgacgggtggagcctccggtagagcgggtagccggcgacgaaggcgacgacggagacggccatgcagaaggtgggcacaccgaggccccagccccagccgacgttgtcctgcacgtacaccaccgccgtgacggcgaccagctgcgacgcgccgttgcagaagtagtaccagttgaagaagccccaggtgcgcgcccgctccgccgcctccgactcgtcgaactggtcggcgccgaacgccaccacgcacggcctgtacccgccggcgcccagcgcgttcagcagcagcgccgcgtacagcaccgccagctgccacggcgccgcctcgtcgcacgcgcccgcgccgccggcgccgctgcacggcggcggccggaacaccggcatcgccgccgacaccgtcaggaggagcatgccctgccacgcgaacacgaacgctccggtcagctcagcgcgccgcggcggcgtgcgtggtgcgtgcgtgcgtgcgtggatgtgtatacgtacgacttggtagatgagggaggcggcggcgatggtccagaagcggccgacgagggagtcggcgaggaaggcgccgatgagcggggtcatggcggagacgccgccgaagttggtgagggtggtggcggccttggcgagcggcatgtgcagctgcctcgtcaggtacatgagcatgttcgtcgtgaaccccagcacggccagcttctccgccacctcgttcgctgcgtgcgtgcgtgcgtgcaaaaacacgccaaatctcatgcgaatttgaaacaaaaactcacagcgtttcaaacagatcgagatttcctactcaccgaagatgaagggcatcgttctgaacccacccttcttcctcatcttgctcttcttcgcctcctcctcctccgccatggctgcctccaccgtctccattgctggtgctttgatgtgtagcgactggtcagtggtgtgtatggtggtagctatagcttggatatacacatatttatagcttgagctttcaagtttcgttcttcctatctagctagccagctctctttcacatttccgaaaagaagatcaaactgaagtggccgtccgcgtcagaatgacacgcctctaccggttaattcaaatggtaaaaaatattataaatcccaatcaagaaatttttgagcttggctttgttagtttggaagggttggaaccatttcccaactgataagcgcataattaattactccctctattccataatataaagtacgatcaaaattggtacggtctttaaaactagagtgaagtgtacaggcggtccttaaacttgtagatgtgtgtcatctagttccctaaactcttaaaatgcatatgtaagtcccagaacttgtcataatgtgtcatctaggtcccaaatcgtcacaaccccttcaggatcctatgtggcgttgatgtgg

SEQ ID NO: 59290 - DNA, 22166 bp, Oryza sativa
agtatgggcctcacgtgtgtcacaatctcgatccggccttccggcccatctatcacggtccacaccttcgccgcattcccgtttcggcccaactagtacgggcccgcacgtgcgaagaagcctaagcctatgggcgaaaaggcccacacaacgtgggcgccacttcacgacgtggtgggcagccggaacggcggttcgtccgccgccagttcgccggagcaccgccgcggtcctaccatccttccttccgtcggatccatctactacggccggagatctcaaccagccacctacctgtatggatgcttctagtagagtctctcctaccgatctgcccgcccctgcccccccacgggcaccgtcgccgtcggcgggcggcaatcagggaggcaacgcgtcggcgaatgcgagcgctactcaaggtattcacctatgcaggtggaattctggctcgaatttgatattgcgtcaagctcgcccaagtcaaaagcccctctccccaacttgcagttgttttactgcggcctccagcggtcgccgctcctgcggttttccgccatcccgggcgcgcgatgccgtgggccggcgagggcggcgacacgttgtttcgagaaatcgatgctgtatataaacgattcttcagagattggctgtggaaacaagagccatttgatcttggattgggaaggtcaggttgcaagttcagttccattaccagaatcgctgctactagttgctagaccatggagatgcgtcgccttcttgtcttgttcgctctcctctccgtcaccgccgtcgtcccggtgttcttatggcccgacaagaagggcggtgctagtgacgtcgccgtcgtcgtcgcggcgcctccgttcaatgcgtccagcgtcaccattatctcctggaaaccgaggtatagtggtgtgatagtgataccggaggaagtagtagtgcagggcggatatgatgtttttgctaagttctttgtgttggtattgtgcaggatatttttttacaagggcttcctttcagatgatgagtgcgaccaccttgtcaagttggtacgaattaaacattatcaggctatttatcgttcttaacatgctaaaatgggaagtagtggataagtttggaatgtttctgatcccaggggaaggagaagctgaagaggtccatggtggcagacaatgagtcgggaaagagtgttatgagcgaagtgcgcaccagctctggcatgttcttggacaaacaacaggtagcagaaatatgcagctttgcatacgtaacattgttagtctaaatcttctgatgtttacatttatacaagttatgtgcttctcaattgattgtaattatcataattcttcctaatgaaggaccctgttgttagcggtattgaggagagaattgcagcttggaccctgcttccgcaaggtaaacttcttcaggtgtttaatttttctttcagttatgagcgttggttaatgtcagctaacgaatctgcatttgtaacactgctttgtcagagaatgctgagaacattcagatactccgatacgagaacggacaaaaatatgatcctcattttgattattttcaagacaaagtcaatcaactgcagggcggtcaccgttatgcaacggtgctgacatatctatcaactgttgagaaaggaggtgaaaccgtcttcccaaatgctgaggtatctgggttaatctttaatgttagaggcatttgttgtcttagctattaaggctctgaattgtaattcggaatccaaatctgatgcaggggtgggaatctcaacctaaagatgattcattttcagactgtgcaaaaaagggcttggcaggtaatattccaacttaactgagaatgtgttaaacccattgaggaaatgaatctgacaatgttgattatgcagtgaaagcagtgaagggtgattctgtgctgttctttaatcttcagcctgatggcacaccagacccgcttagcctccatggaagctgcccagttatagagggcgagaaatggtctgcgccaaagtggattcatgtgcggtcttacgacaatgcatcaagcatgaagcaaagtgaagaatgttctgatttgagcgagaattgcgcggcttgggctgcatcgggtgaatgcaataacaacgcagtctacatgattggaacggaagatgcacccggtcagtgccagaagagttgcaatgcttgcagtttatagaacatttcgcatttggtagactcacccggtctagttggtttggatttgacaaatttgcagacggtgagcttagatggttttacagttcttttgtttattttgggtgaggtgtgtgttccaaactgccaatagccattagttggatacattttgttgttactgcaaatgctgaagacagtgttatgtaactcactgttgtgcagttcagagtgtcatgctggcaggcaactacctgttccccctttattttttttgttgtcttgcttcacagtggatttcagaacagaaaactgtgtcagcttgtctcgatgataaccaacttgtttggccctttccacaatatagaagccactttgtgctcagtgtcaagcttgctccttcaaagaaattccagtctcagtcctgcagtgtaaaagagagatgatttggctacagcaacaatgtttgaggcacttcttttgcaaaatattctgagatcaaccagtcgttttcgcccaaaaagcatctccaacatttcagacaaatatttgaaatgaatggacatcagtgagtatgctctaatgtcatttcaaggggaatttaaacatagattcagaatcattacagattttgagaagagaattactttgttatctctccctcagtgaaaaaggattgtgacacatcacctgaaagtagagtttatttcttcaggatgctgctcactttggacctggcttttggacctcactttgccagggcaaatctctcatgtgtcattcttcccctctcttcctcctcctagagttactcaaagatgaaaaaaaatttccccacatacatctttcttatatgtgacctgaatcatcttccaatacgaatgtacttgatggagaacagtggcagccttaaggatcagatacagatagcaatgcctccttcctactaaaacttttcttttcttttctcactgtcttttctccccctctccatccacaagaacaaacaaaccaagaaattgaaaagaaaaagggaagaaaacaacataactcaaaaagcaaagtgcagaaaagcaagcatggctccctcacttcacttgcctttgattctactctcctctcctcacctccatttaggtccttgaaaagcacagcagaatcagctaaagcaaaagaaaccccagaacaaaacaagaagcaaggatgccacaacagcgactgacacaaatccctgctgctacttgcccacattataatatgcagcagccacattgctgcatccatcgttcagctgcaacaacaccactaccacctcccccataagcagaagcaactcgtagagccacagcagcagcagcagcagcagcagcaagtgtaagtgcaggagagtgagagcaagaagaagaagaagaagaagaagaagagagtgagaaaaccaagaaggccaccggttgctgctatgagacggccggccgggtcatcatcggcggcggcgttggcaatggccatcttgttgggggttcttgtgttgatggcactggtcatggacggcggcgagaagaccggtgcgccggcgatcgccgccgggaggaggatgctggtcggagcagcagacgcagggcagatgaggactctggaggatttcaaggccgatgatcctttccaggacagcaagaggagggtgcctaatggccctgatcctattcacaacaggtactgcaaagcatgtttcattctttctttgcttattttgatttgtgtctccaacttctgttcaaaatactagtccaagttttctgtgtcactatgtcatttgcgtttgaaagcaccagaaaagaagtttgttttttttttgaaaaagaaaacaaagaacagaagtttccatattcatgtccatgcataggtttcttgaagtttggagctgctgccttgttggagacggagtaacaaaatgctgcagctcctcatcaattttaaaataaatgaaacttctattgtgttgttcttgaccagaaatatgaagcttttctgttaaggctaaactacctgcatgtttttcttcttttttggtttctttcttaccaacttgtgattaaggtgtatgtttctgagttctgactcagctgtgatgtgagcgatgtgctggtacctaacaaaacatctgtctttttcaaatttgttatcaaactacaacttcataacactccaaacaaaaatttaacaaaacaaaaaaaaaacaacttgtagagtaggctggggaaaaggaggataaggtgatttggtgcccaaattatgtctgggcataaaaggttgagaagaataaagagaatagaatatataaatatatatgccatgcatctcttttctcattgcactcacattcccctatgatgatatgcaaatattttagcaaaagcaagtagattagtcctagtctcgtaatgggcaacatatatagatacacagatcatacttgaagtgattgcattgcatgcaaatgtagtaatgcaggtaatcaaacaaagtacacctgaaagtctaacgtttttcagtgtagggtcacctgaaatgcaaacttgcatgcagtttcaaatccttcctcaaaaaaattgatcatgtttcacttcttgcattctgcaggggaaccggcaagtcaggaagatctccgggccgagcgtagcggcacgcatcccgaggcatggaaggttccgattcaaggaaggcaggcatatctgtggagcaaagagatggttgcattgcaaggaggaacaaaacaagaacaacattatgatggggtctggctgtggatgttggtgtaactagggggaggtggcctatatcttctgtaagcactgctatttaagacagttttaagcataaaaactttagctttttgcaaacaaaggctgttctagtggtggggaaggtttttttgtaaagagagcagtgagtattaagcttccctctcacaacaaaacaagcatcaaagattcttggcaaagggatgtgggcaagagctcccttcttttttggcactagtaactttagacatctaagtagtactttgtttcttttctttttttttttttttgttccaggcattcattcttttcccttgtcactgtgtatcacttacaacatcatatcataagtttgcaacagagaaaaaacaggtcaggaaaggaccagcattttttttaggctctggctcttaccttctgattagatgctgataaaatcaattgcggccaaaactgactaatttatgctgtaaaaacttcaaaactgatctggtatcttttgtcttgtttctgtctgaattactgtactttaaatccccccccccccaaaaaaaaaagaaaaacaaattctgcacactgaacatgccacaagaaaacaaagaagagaaaagagaagagggtgagggagggagaggataaagactgaagagaaaagaaagaaacggcagccaggcagacagccagagctgcaagaatgcttttttctcctccttttgtttcctccttccctctctccttccattgtccctcacctcttttaacttcttttgttgtaagttagtagctttgaaatttgaacaggcatactcgtagtagctaaagtggccttggttgagctctctaaagcaaggactgatgagaagctgtggtaaaataggtgcttgtgtgtccaaaagatgtgaacttctgaaggactaatctattcttttcttgaccagtcatcttgtgtcctggaagaactgagttatatgtactacatgcatggaccagtgtatgcttggactgctttgttcactggaagagatgcagggctaagtggggacaaagatatttcctatttatacatgaacccacacagatgctccagggtcccagcatagaccctttgtttgtattcttctcatctcaagcatagaactatactactgtactgcatactacaagctatagagttgcattgcatcaatgtaatcttcagtatcacttggtctgttttaatcccagacaaaatgagaagaaagtttagtccacattagtcaatacttaatactccctccgtcccagaatatagactacgatgtactaggtgatgtcctatctaatcttaggttgctatattctagtacggatggagtatcatttatctgatctggtgatctacaatactccatttccaaatgtagtactttatcatcaaatactattcgtttttaaattttgaccatttgtcatttttgccaaaaaaaatgtaaatatttaaaaagacttagtattattgaagtgggatacaccataaacattagcattaagctttattcatcgtaatttgaaaaaatattagtggtgaaagttgaaacggtggcggccaacggtgctaagtattattcggggaacctaagttaagcaacagtttcaacaataatatataccacttgtttggacgattcaagaagagacataagatgatacatgcatgcaagctctcacaaattcaagatgcattgagacggtgagacgtgagacctgaggcgttttattgaattttcatagagaattcgttcgttagtacaaacaggaaagttcagatgcgttgggttttcaagaaggccattgagtagagtgttcgtctacctctgaattttcaggaaactttaccaggcctggcaggtgtacccaagccaggcagaggatctcgtcgcgtgatcttctcttctggttgggctcctggacccctggttcttacaccgagctgttagccatcacagcttcttctcctcgggttctgaaaaggttttggttatctatatttataatatctctatatattgccaattggcgtactggtagaatacaacttgtagaagcctctgtgttctgaagtctgaagcagacctgtactggagcatctgaccagtttaggggaggtgagatgcacacaagacgacagttcatgtctcagcatgcaatgcaatgcatgatttgtttgtttaatggcctcttatttacatctttccagcagttcgcaagcaaattaaacttcctaagcacacccttactgaatgaacaggaggattgtaggttccctgcctgaaggtctgaaactgacggtttgcacaacgggagggtgaaaatgggatggctacccgcccatctgttaagctgtgtgtgcaatttacccttatcaaatatatatgaaaatatattttaaatccacctacaaacgtgatgaaagattggttaatcgttattttacaagctcataagtaatattacatttttttcctcgatgtatattttttaatgcctaatcgcttctctagatttgttatctatgaattagagatacaaataaatatccatttccgaatccgattccgaagaaaaaatatgagatataatacgagttatatgctatccgatactatccgtacctaattctaactttgaaggaatatgcgtatcgggatgctgggatctaaccatacttggactaatttcacctctatgcacaattacgaatttttcaagttgtttaagaatttataagaaccattaacatacttgtacgttgtaatagaccaaattcatataattgtgaataagctagaagggtgattggagataaagtattggattcgatggttactcacgtgaaccttacggacacactcatatattgcacgaactgtccaagttgaatgttctattacttgatccagcaattcagaacacgaatatgtgattattacaaaaaaaaataaaagagataaggtttttgttatgaagcgcttgatttatacagcctcgtagtaaaactgttaccaaaattttggcacacggtagacaactcgtatctagatccggctcctctgcctttagactcaaaaggtagagaggtacacagcaaaaatatgtcttgttctacagtagttcgttcgtttgttgtgaatcgaacggctaaaaatacttccaaagtcagagcagtagagctctcagatgatccaaatccctcgcataccacccccggcacgtccatagacttttgagacatatttgtacttcctaggccgagttgctgagttatgatctgctcccaaccggaagcggcccatctggcggcccaacccgctccgcattacgcatttgcactcaacgcagcgcgacgcggcgtgtcgcgcacaacacaacgacagcgcgcgcattccacctcctccacgcctgcacgaacgtactgtactccactactgctgcgtcgcactgtgcattccaccgatacggaggccacgtcgccgtccacctccgaaagctagtagtattactgttactgcgcgcgcatttacacccaccacttgctctcatttactccccttcacctgcccaccctctccctcctctcctccctctatttaacccgcaaacgacgccggccaccattgcaccacctcagctcgcgccgcggaacacgagacacagagagagtagagatcgagatcgagtgctaagctagctagagtcgacgatggcgaagtggtgcagcttcggcgtcgcgtcgtccctcctgctctgcctcgccatggcgcacgccgcggcggcggccagggccgtgcccggcggcgacggctcgacgacggcggcgtcgctcccggcggcggcggcggcgggcaccggcgcgggcgtggaggacaagaagaacctcttcgtgggcgtcggcggcatgggggacctcccgggcttcccggccgtcggcggcggctacggcgggggcttcggcaacaacggcggcgccgtcttcagcggcgtcaccggcccgctcggcggcgtcgggggcggcatgggcagcgtcggcccggtcggcgggttcggcggcgccggcggcggcaccccgttcggcgggttcggcggtggcggcgccggcggcgtcacgccatgaaccgtagtattactgagagctacgtacgatctcatgcatctacgtgcgccgcgtgcgtatatacgcacgcgtggtgcacgtgtagtagctagtgtcatcttttgcttttgagtgtcgatctcaggtgagttgcatgcatggttgggcagggaggttggagtttgtaaaagtttgggtttgtggcctgatggcaagagtcgagtttactagtagcttctagtagttgtgtgctaagttaattgtgtgttgttaagtgcacgtgatgcatgcgagatatgatgactatctttagttaatgactaaatggtattcatgtcgtgcgtgtaaatgttctctagtgggaatgtgggatggcgactcttacctgtttcatggcacagcactggaactggatgtatcccccacaaacgatgtgggctcaggctcagagcctcagacaccatatgcatgacgacgcatggcatagcaaagcaatatgccaatatctatcgagcatgtacagcctgagcaaaagcgccatgaagcagctgtgttcttccccatcttttgcaactcatctctttactttttcccgcgtgcacactttttaaattgttaaataatgttttttttaaaaaaatctatactaaagttgttttagaaaaatatgttaatccatttttaagaaaactaatacttaattaattatgtactaatataataaagattcgttttagtgcgcgtaggattagttccaaacaccacataccaaacacccgattcactcattcacagctacagtgctcatttgcacaagcatgatactatgtactagtaggccaacttaattaattacacccaatccgtaaataaagcatactctatattgctgtgttcactacagtactccggcaactagcagagtactgtacagtctacatcgagatgggagtaggagtttgtaggtaacgtggcgatctcgcgatgaaattagggtgtgttcagttccacgtcaaaattaaaagtttaaagaaaaaagttaaaagtttatgtgtgtagaaaaattttgatgtgatagaaaagttgaaagtttgaagaaaaagttagaaactaaaccagaccttaatcgcgaatccacgatgctgtttttggtacgagggggtagtggactagtggtacgtggttgctcacttgagcctgctagacctagaggagtactactcaacttcaattctgatgacagttgacagcacggccgtgctgcgtgtgctgcatctctcgttgcctccacatcatgctgcagcggatgagtggagcgatccttggaccttgggatctcgaaggcaaggtcagtagtcgcatcgcaccgtacggtcccggagatatggtactacagtacatttgtaaattattggtcgctttgactttttcttatagtgtttaaccatttatcttatttagaaaattagtataaatataaaacagataagccatacttatagaacttttaataataaagcaaatcacaaacaaaataaataataattctatgatttttttttgaataagacgaatgatcaaacgctacaaacaaaaactcaaaacgataagtattttgggacagaggtagtacattagagttgctttcgaggagatctctctagtactcctatcccacagcgccaagctagccaagtactttctccatcccaaaatgtagctgctcagtacgggatgtgacactacctagtacctgtccagattcatggtattagtagtgtcacatctcatactaggcagctccaggcatgacctcaacttgggctatggagattcgatatggctgcattgattgatcgaatcccgcctcgagatctattcctatctcatctcatactcctacgcatagacgtatcacgtaggtgaaccggtcaagggatcagggccactccactcccctcgctctcacgccgccgctgcttggagatgttggaggtggagcaagcccgagcgaagtagcgaagtggtgtgccttgacatggatcacggtctcacggacgccattggtccacccgtcggtcgagctggtggtacatgtggctgtagcgcagtggctccggataaagcttgggcgtacgccacggcggctggcaccgcaagaggcgccatttatgacttggcagcacagagcgggcagctgagccgagagtccgcagatgagagcaggcagctgagacgcagcgtacgcgggtggccttaaatttgcggcagagctgaagagcttgcgataagatgaaggtagaatcaatgcactgcactcatcaggattggccaagaccaaggttggactcggcagtgcgtgcggattggccctggcagcaacggacccatcgggatccatcaggatttctcccagtgtttgcctccgcgtgccctgcatgtgccgaggtgcagctgcagccattgatggagggaggcctagaacaagcctctgggctctgcctgttccgggacgcaccgagcaatgcgcggtgcacacgcactaatgcactgcaccagctcaacttggaatggtcttgcattcgctgcagcaacacacctcgtcggtccttatctactccttgccaactcttcatccaaaacttgggtagctatacgaatcatcacggaaaaatcagatgttactctgtttctacaaccacgacgttcaagaatcaagactgaaccatacaaaacatgctgacgaaaacagaaacgagcttttatgtttcattgaggcctctgcttccatataagatgctgaaaaatagtagaaacgtgaattttctgtttcattactaccggtaacttcttatattagcaagcagaccaggaggaacggaggcattccgggggcaattaagtgaatctaatcatcatataataataataatagaacaaggaggttaaaatccaagctatacacacatagcatccaaaaatacacgacacttcaacccacaacccactgaccgagtcaccaaccagcattcaacagacacgacagcgtaaacactcaggcgccgtaaccagccagagcacaaactagaaagaaccaaacacctctccaatttccccccctttttgccccaagcaagcagtactgtaagtgcagttgaatgagtcaatttatgcctacttgcatttgaatccatggcacacggacaggattatgataaggatgagcgcaattattatgccaagaacaatcagcttgatcttcatgttttgcagccacatctttctccttacctgtgttcctgcctgcctgaaatcttgggcctgcatatgcccagaagcaaaaagcttagatatattgttatttcagacatacagaattgcagcataatttcataaaatcttttgttacggaaattccggctcatgcttagtaaattacaacatcaagttaatctttcttagagccccaaacttagcaacattcaggttagccagaactaatacaagactgttaagatacacataaatttagcccagatggcacaaaagccaaaaacttcaatatccgacgtggaacaccactccataaactatcaataattatgcatcaatattcaagtttgttccattcctttcacaagctcaagaactctttcagaaatgatcgtaaacacctctcagtaaaaactgatactaattcatgaccaatttttagtggcaagaaataataatttgaacaaatcaccacgtttaaagtgaaaaaagtagcacctagacaccacctaataataaccaaaggcagccagtctgccatcaagttagcacctcggtgaacactggaacacctaataccttgacttgtgttttaccaatagaactatgcatccctaataccatgacttgtgtttttacacattcaacaataacaagagtaatctaccccactagttaccaccagggtgctagtgactagtcaaaaatgaagcacacacccaacgtaaatttgcatccacttaattgtgtcattttagcggtatttagaaatatttggcatctagtaaggaaaaccaactgcataagtgggtctctactctctaaaagacagtattgagtagcactaacaataaaagctccaaaagaaacttgaagtgcaataacaggtacagtgcaggctgaaggaacatgtcaggacctgtgaacgcagattctcggtcttgtcaacgagcagttcaattttctctccacgatcaagaacctgcaaagagaaagcaagatcagaagcattcttcaaaggaaatcctcaatgttctgagcataaaaactgtagaacgaatacacaaacacaaagaaaacaaataccttctcaatattttccatcataactcctttgacttctgaaacttgtgccttcactttcgcaagcttgctaatctcttcaggatgatccacacagtactgcatgtgttctttaagtttcgatctacaaatagtaaatagagaagtattagtcgaagggaccaccataactttatcgactctatccctggcaacaatacgtacccaaaatctcggttgaggctgttcgcagcagcagtagcagcttttccaccagcatatctttttgtgaaatcatccttaactctatccaagaatgcaatgggaatctgccgccctactgattcaacagctacgacacagtatgctgcagaagaagtgtggtattagaaaatcaacgtcacaggctttcaagtgataaatggttaaagtaaatcgtaaaacgggtgctctcatatgagatgttaacagaagatacaagcacgtgtgccaaattttagaaatgtggtaactgtgccaaatttgcaaagctaagatcatatgggtataaaaatcagctacttaataaattttccctgctccttattggaaagtttttcaagcactataatcattgatagttggcaacatgatacctcataactaacatattactacttttagtcatcaccaaatcgtggaatttctagcattaatcaccatggcaactccaggtcttattctgaccaaagaaattataataagacatttcagcactgaaactaaactataaattgcgtgcataatagaataacaaggtagcagccgatttcattcaacgcgctatctgcatgcataaatatgagctgaaacttgacaggagcagcatgcaaagctcacaaacagctgtctactaaaaatagcatgcatatctagagggctcgccattgactaaatactctaaggcactggcttacggctttgcgaataatcggggcagacctaaaatccaagctcttacaccatagctctcctatgcatacagtcagtccagggactaaaaaaccggataaaggtgaaaaaaacaatggataatcatatccacttcgatacggcggaactattgaaaggtcctaatcccaaccaacatctgcatctaatctaaccaacaagtgcgatgaccaaacttctcgcacgaactccacagcgcatcacgatctcaaccaacatcccgatcgccgatgctaaccaaaacgaaaacgacctaaccgcgtctccaacaaatcagcgagatctacacccaccatcccaaatcgagcacgcgcggtatcagatccacgcagatcagatgcactccgcggggaatcgatcgggaggaagcaaaaaggatcggacgggggatgggcgagaggggaagggaactcactgaagccgtcctccacgaggtagttgaacgtgtggccgtcgcagttgtaggtgaacttgttgttgctcgccgggagcttcatgaggcactgggaggcgatggtggtgaagttgccggtgaactccgtgtactcggccaggatgaccgtgccgcgggccacgaacgcgtagatcagcgactgctgccccatgtcctcctccctctctctctcccctcgccctccgcctgtgctcgccgccggtgacgtgctcctcgccgccggtgaagttggcgaaccctagggctagatctcggcgaggtaggagaggggagaagaagggggaaaggtcggtttcgctttgggtagtgggaggggaaatgatgggggtggaaatgggaaaagaaatcaaatttggttggtggaattttcaaaaaaggccctttgtttcctttctagttaagtataggcccctggccgccacctgttttctttgctgttaagcgattgatattagctggcattttggactattgtttttcaactttcaagttgattatatgacctctacgtctggtattatttttctctttgttgtgatggaaatcatcggtaggttacaccgttatagctgccttgtaattaatcaaactaattgatgggcaccctaatgacaattttgaaaaggacagatacagtatttcatttttagccacttgttcgttatttatgactgatgctcacatccacaaaattttcttttgctatggtcaatgctctagaaaatagtatatgtgttgtgaagctgtgatatgtctttgtagctataatgggaaacagagttataaaaacataattggaacataggaaagttatccgggttgataacagcaaaatattaattgcaaatatatgtattatattaaaaccttatgatgtagcacgtgtgtaaagtttaaaaaaacattgttctatatatattgtcacacttttttttaaaagttttcatgcatcctcgctcctctttttttgcttgccctgttctctatctctggtgaatcatcaatcgtagtagttgccacttttttttagcatgcgtataaacagattcctctaaactttcaatatcatccatcgatcctcaaattctggaaatagatagaatacaaaatatgtgcattgaaccacggtaattgttggctaacgccgtgtttagttccaaaatatttcttcaaactttcaacttttccatcacatcaaaacttttctacacacataaacttttaacttttccgtcgcatctttccaattgcaaccaaacttttaattttaacttgaactaaacacaacctaaataaggtggtgcaggtgcagctcttaccctcctacattgaaccaccagctctctatatttgctaagttgcacaagtttcaagcaaaaggaagatttgacaaagaagacatggatgacaccgatctggtttgcccgtttctgtttagtagtgttggttgatcaagttagtttggtgttttatttatttgcttagacttagctgagttgacgttttgttcttagcgtttctgtgtgcagtactattttgtgttcacaagctgagatccccaatatttgaaggactagattatgttagacatgtagtaaagcttgatgtatgttttttttatctaaaaaacgatattcttaacggtgaattgcaccacttctatacagtgatgtttttaattcgaaaaaaagaaagccactacacatatgaaactgttgtcttactaccgtccgaccgcgttatggtgagtagcgttcataagcgcgtgtcaaaatttatcacgacgcaagccatttactcttgagatgattattactccctccattccgtgatttagggcgcaactatatttttttccacgtaccagaatatagggcggcacctcctcaaatcctattcatgtgcacggatgcatgtaggctttgaagactttaactcttggttgtcctatgcatggccgcatgcgagcattgaaacatgtcgggacaatgttgtgattggtgctgcatgcatgcgaagcaaagctacgtgttgggacgagcaaactctaattgatttaacggataattacaccactctttggtctatgcgtacaagacagttacgctctaatgctctatatttaggaatggagggagtatatctctgaccatacattatagtagcagattatatcattttgaagaaaaatattaatgcactagcaaaaatagaaaagtctcaaccggagttgttcccctcaccaaaccggtcggtcggaccgaatctccgatccaaccgcacggtcacacggccacagctcccattccgaatctccgatccgcacggggtagaggtaagactagacgaccgcgtccgccaatcaccgcgtggccaaatcccgagcacccccctcttctcttctccccactgtttttaattctccacggctcccttccactccatccactcttctctaaagcgctctctccctctcgtcaccgctactactagtgtacagtgccactgcgagctctcctctccgcccccgatctggtcgcctcgctcgcctcaaaccctagagctccatccaccggcgagccctcttgggcggaggtgcttcattgctgctgctgctgccatggaccccgcccccacgctcgccgccgagctctggcgaacgccgtacctcggtggcggtggtggtggaggaggaggagggcgtgggttggaggcggcggcgtccggggtcacggagcagagcaatgggagccgcgggggtggcggaggaggaggcgcagggcggaggaggcagcgggaggcccccgcgctcgaggacgactcgtccaggatcgtctccacttccggaggaggaggcggcggtcaggatttggtaggtttttttatgctccgcattggtcgtgatccgtgtggcattgggtgagtttgggggtaattttggtgtgtcagccttcggtggtgggaatctggaggtttaccagggaaaatggcggctttagactgaagtaaatttgcttgtgcgatctggccgtgtctactattggcgtggtgctgttcatgctttcttatagctctagctgggttccccgttgatgcttgtttttgatttggtaatgtacagtggaacgagccaatctgtagttctggctgcagatagacagtcactgctatgataccagtatgtaagaaaaggaattctcagcataatttagtctcgaaagttccgtaaattgaaaagaacacagaatgtgcacacaaagtgcagtaaggaaaagctagcactgtcaatagtttcgaattctataattagcaaatacctttggtaattgagagttgagaagacactttgtcaatgctgaatgcagttaggcgtaggaacatggggtgtgtcctcctcacgtggaaggcttcaccagatgaggtttcaagccttttgatcgatatagtttcctctggattgcttgtggaattacttctacatcgtagtataatatagaacacaatttattgttcacagctgggctgagctcagttgagagtgtcatgctctgttacacaggaaaacatggaacaagcttatgtgcaatcgttcatccatgtgactttcatattatagaatttctcattcaaccataagtagtgtttgacctttagtatttataaaacctggagtattagattgtcggttttctattgttaacataatggtttcactatatccaagttgattctgggtgctgtttttgacaaggactacttctatagtgtttgcacctttgtaatgttctcaacttttgtcaaaagaaagaacattataagacattcatattatagtactagttgttagcacccagtagtgctgtagtttgcatctatagtgaatttcctatcatgacattttgatttttgttgcttggtaatgcttgttatgtttgattcactggagtgttggtagcatatgaactcaactctcaagctaacatactactatactagtttatttttcccacaaaaatctaaaaaattttacctctagaagaaatggaactagttttttttgaactacccatcgatgtgaatatggcatagagcttgatatttttcttctatacataactgtagccaacactcaacactcgacattatgttactgctggaatcttcttggagctgtttatatttgatcaagctattggccaacacccgtcttaactatccttgtcgaatgccaagtgcttagtaactctggtgcaatgcaacagcttttgggtctttgactaaattgcaacagttgctgctatctgttcacgctggttaaaagctgttgttagacagactattaaattctatttattatctccattctccagtactaactactgagtcaacaacctgttggtccacacaatgttttggctggagacaaggatcctgagtggttccatggtccaccgtataattgaggcattctgcagcaccatcagatctataaccctagaaattgcatgagctcaaatacaagatgcaatcagcatttctttgcttgcatttagtagccaaaggtgcctgtaatttgaatttgaacatgcacacttaatattagtggaggtcatcattgtcaggcattctagttctttgattctattggtgcatttctatgatttttgcctcatatattcaccaattattgatcatgttgataacttgagtggttgttttaacttttgaggtcagaaggcaatatacagtgccttttcccctttaacctttaaagagaaaaaaaaaagcatggatcatgttttgatatgcacggattatgtggaatttttatgagcagactgattcagaagcaaagcgtttcaaggcaagtaaatcaagtggagataatagcagtttaagaacagaggctgaaactgattcaagaaatgctagcaagtctggtgatcaaaatccgccaccaccagaaccaccaaagcaagactacatccatgtgagggcaagaaggggtcaagctactgacagccatagccttgccgaaagggtcagttagtgtacttgtttttgttaccgttcttgtcaatcacagtcccattacaggagtggaaaatctggttacaaatcgaacctctgaagatctttcttttttttggggggcaaacggtcaatttcatgtttatactatgatatgaccactgaaaattctgttcatttttggcaggcacgtcgtgagaaaataagtgagcggatgaaaattctccaggatcttgtccctggatgcaacaaggtctcaacatattttcctcattttgtcccataagttggggtttaaatattatatttttgtaacatgacctctaaaacatccccagttctgtttctgtaattgattttcattggaaaacttttgcttgcttggccaggttattgggaaagcatcagtacttgatgagataattaattatatccaggctttgcaacggcaagttgaggtatgctgtttcaccattggcgctttatgaaatttctttaccctccatatctcagctaatcgctctataatttgctgttatctgcagtttttgtccatgaagcttgaggctgttaatgctcatgtgaataatggaatcgaagcatttccacccaaagatgtaagtcaagtagtaaaattaacagtttaaatagcatgatcattattacaataaaaggtctcaagatatatttgaaagattctgtggcatactatgcgctactggcactttatcttagctccaatctttgactttgaacactgtgttaatatgttgtttttttcaacaagtcccatactctacaggcaagccagctatatgctactaccatatgttttagtttttgaaggcgttatccattgctcccttctgaaaattattaccattttattgaagctatactcctgaatttcaaaaacgtttaggcagggcaaggcatttaatatctgcagaggatacacatcattgaaacattttcctgatttttactctttatctaaccatggcatttgtctgtttgtttagttcaatgtgtttatgtatttactaagtactagtagctctgtggagctttatgtaaacttccaaatttggtttttagtattaaaattgtttattttcttttgggtcttttggttgcagtttggtgctcaggtatacaacacggctcctggattgacgtttgatccacaaacaccaagagaatacgcccagggatcaacaccatcggaatggctccacatgcagattggtggcacctatgaaagagtgacatgaacagaacaaagtcaggatggtggcccaaaataaagcataccatgagttcagtcagaaaccacggctttagattatttttcgaaactctcgtgctccaaattcgatttcattcatagcatggagctcatgtatttagagactgcgagcacagtatttttacatctgtaccgggatacaattctcatcagattcatgtattccacggaatttcggcaggtcacgctcattcgtagcatgaaagaaaagtaataaccatcaataattctcttgctataaatcctaaagcccttcatttttttttgccatcgtatgcttatctttctgaatcttaccagtagtttgttggtaatttgattactcacatttgctacttcgatcttcgatttgtgtttgtactcccaagtcaaagccatcaatctggcaaattttcacaggatagttccaacaatttgcacaaaattcatctgaactcgttctaagcgaaagaacagggtggatgaatctggagcaaaactgcacaaccagaactgaacctcccgaaaaccccgcaaaccgcacgccacgaatttaccatcctacccctgtatcgcagatgcgtctccgttccgtttcgcagtctgttttgcccccacgcgaaatctccttgttgcccttttcccccttctctcttctcccctctcctcctcctctctctctctctctctctactcctttcctctcctctctccttgccctcctcgcccccaatggttgccgcggccacggcgccacctgcccattccgcggcgagcccttgacccacccctgatctcgcggcggcggccgatccggcacccggcgacgtgtcccggcggcgatggcggccgcaacggcggcgatggcggccgcaacgccgccgcgggggcggcagcagcgacggggggaggagggggagggggatgatgc

SEQ ID NO: 59291 - DNA, 15768 bp, Oryza sativa
  unsure (1)..(15768): unsure at all n locations
tttaacttgccattggtgtctttgcaacagggatagtacttgtttgatgtgatccaaatgggactcaagatcaggactatagattaatatatcatcaaagaacactagagcaaacttcctgagcacagattgcaatgtggcattcattgctccttgaaatgtagcaggagccccagtgagaccaaaggacattaccttatactcatagtgtccagtgtgggtttggaatgctgttttatactcttcacctgccttcatcctgatttggtgataaccagctctcaagtcaagcttggagaaccattttgctcctgataactcatccaatagttcatcaatgactggcattgggtatgtgctcttgactgtaatggcatttagttgtcggtagtcaatcactaacctccaagttccatccttctttcgtactagcaaggctggcgaagagaaggcactctgactgtgctgtattacccctgactgtagcatttcggccacttgggcttcaatctcatccttcaatgcagggttgtatctataaggcctcagattcactggcttagcatcaggaattagaggaatgctgtggtcacaggctcttttgggaggtaagccctttggttcttcaaagacagatgaaaattcctgaatgatttgctgtactgatgccggaattggatcagtggtagtctgtaaaactgaagctaattgcactaagcaaagtattgagccacatttagccattccttccaactggtcagaggtaataggacaacaggttgttgtatgtggagtaatgccaaataatctcacaattttaccagatagttcaacatccatccatttgttaacccagtctacttgcatggggctgaatctttctaaccaatccatacccaaaatcacatcataacttcccaattgcaatagtttgaaagtgtttttaaaattgtgtccttgcatccaccagctgcaatcaacgatttcatgtgtacaactcatggttcccccatctgcaaccttaacagtgaccggcttaggcaaaggagagattcctggcaacttctttcccacacctagatcaataaaagaatgtgaacttcctgaatctattagcataagcagttcagctccctgcacccatccccttaacctgactgatctattggattcagttccccataaggcttgctgagaaatagccattagcatactagggtccccttcatctgtccctgttgtgtcactgactggttcaggctcatgctagtgtaatgcttcaatcaattcctgcacaatatgtaattgaacagaagttgcacatttatgatctctgccccacctttccccacaaacaaaacagagtcccttggatctacgataagctttcaatgaagccaatctgtcatccttggccttggatgcatcgattgcccttttatcttctgtcataaccacagtaggagtcctaggactatgattcactggactgaattgattagttctaggaacctgcctgatgctagaagaagattcagttcttttgctgctcacagtcttgataccctccaatatttcctcttgtaacaaagctatagaacaagctgagtctaaatcttggggcctttgcaacattactgctcccctgatctcatcccttaacccttcaatgaacttttggacaaagtatacaggagttaaggcactgtcataagccataagttggtgcattatgctgtcaaatttttccacatattctgagactgaactggattgttgtgcatgaaaccactgacggattagagcttcctgtctatcacgggtaaatctagcacacaccaattcacagagagtctgccaggtaatccccacaatttgttgcctaattgactgcaaccagaacgatgcattgcccccaaaattgagcgtagctaccttaacccagtgtataggatgaataccatatatgtcaaaatactgctcacaattgctcttccacatctggggattctctccctcaaatctagggcaggacatagggggcagatttgtgctcaaatcaacatactcagtggaagaattcggggaagttacagcatggtcaccatcagaattagcaggggaaaagagattcgggtcgcgcttaccagcaagccactgtgtaccatcgctggtctgagcagtcttggatagagtgtgctctatgtgctccaccttgacgctgagatctcccaccgcgcttcccaactcttcaaccttcttctctaccaccggcaatctagtctcgatcgtcttcctcagctccgcgaaatctccacgaacacgttcttctgcttccaccctcttcttctcattctccgctatggtcttcaagagcagatccagtttgttgtcttgagccatggttcctcaagcttccttcaacactaggatattctgctcagatctctctcacccacgctccgaactcgattaaccaggagaaggcaagttgccttttcgcgggattcaattccgaagaatagatcccaatccttccctggaattttacaaccaagccaagagaattttggggcgaaagggctctgataccagaaattgtcagcgtcaccagatggactcaacacaactaaggaaaatgaaaaggaaaagtggaagaactcgaacaactcaggaagaacagagatgtgtttaggcaatcttttactaggataatcttgctccaacccaacagggttgagccgccgccgccattcgccaccagattgccaaaagtcccttacaatttagaaacctcagttcttatactctctctcgctaccaactcccttccttcccctctcacaagacagatgccagctcatgccagcgatacaggttacatggcccattccggcccaacatatttacgattaggcctaatgactctggccggcctcaagtcttcttctcctccttcctgctcaccatccggcacaggcttcatcttcagcttggcgcttgcactcggctcctcctcgcctgacgccttgacactcacatcgcaaagctaattaggttattgatcaaacgaatgtatcagccaaaaaaatagagaaaaacattcactcctgaattcacgctagaatttcaaaatcaccgtccatgatccatgtgaatttctagcacgttgcacaagctgaattcaaaacaatttggtcctgtttgctgcatatgcaagggttattctgatttcatctgtatgactgtatggggcttcttttagatagtgaaaagaattccggcatttgctttaaagatgctatagccacttattacataattcacagcttataaaaaccaagaaatgactagacaataactaatgataccaacacaagacatttattcaagtctgtttgtaaatcttcattcgaagttggcaaatatctacatgatcgttgtctctaggttccggcacacagtatgtactgtcctcattacacctttatatttgtgctcagaactgaagccagtatgttacctgaatagtatctgcatataagatttcattggggatttgtcaaagaccatatcatttatgcatacaagatacacacagtggtgctcgggagggttatgatgggttagagctgagggagaaggatcccgaggtagtggcgaaggataggctcggggagctgatgcagatggggctgcatgagtataatcagcggcggcatgcagagaatttggaggagaaaaggagaaaggaggagaggtgagattgagataaaggaggaggacgacgatgaggaagcagcgcggttggatagtgctaagaatagggaagagggaagagagaagttttacaaggtgttgtttagtgatgaattagggatggaaatttcggttcacaattttggaaatttgaaccgaaatttcgggaatttcgtcccccatccggcaagcaattattttaagtgaaattttcagttttttttttcaaatatttgtgaatttgatcataatttcttcaaatttagtaaatatgtgctaaaatttcgtttgaaatatccgaaatttcggaatttcattgcccaccaaaattaccttactttttgaaagggaaaaccctagtgatgataaccgctgataagtttgtgtggagttttgtttgtgatccatttcatcttattgaatttattcatttgaagagtattcaacacttttgcacttcataatcaatcaaattgattactgatggatgtgatgggagttgcattgctacaaaggcattaggcatctgtctgcatgggaagatggtcctattgagttcatgacctgcaaatgttcaaggatatttgattcaataactgcttggatgccaccagatagtttggtattggcagattataaccatcaaacctttatgcggatacttctagcataatgactacatgaaattctagtgtgaaaggattgctgcaaagacttgacaaaagaaattagtgatgtaatgcatatgatcaaaataaattctatgagttctacaggtgagatgctgatgcagagttggggtttagtcaccatggcatggagaaaggaattcagaacccatatgaactgttgagaagatgcaattgcaggtctcaaagtaagcacatcaagactgttgatctttcaaccttttgtggtgtttgttatgtttagcagacatcttccgattgagaattggaacatcacagagggtggactaaagtcagagattaactacaaagcaatttacaatgcaacctgtggtgcccaattcacaatcacagaatatgtgttgcctgctgatcttggaacataaatggaactccaaataggatgtgtttcggtacaactagtaaggtttatgaatcttcaagcgaagtatttgacatttggttggggaaaatctatgttaatcccccaaaataaatgaaatgaaatcttttaattctgatatccagtttattttgtattttatgtatacatatttagtagtagctagtactaatcgcatcccctgacgataatggacgcatgctaaagcaaagctcgaaattcatggagtaatgaaatgtatatgaaatttaacagtctgagaaccaaatatctagcaaaggtcatgaatgtgccttttttttcccttgttgaatggcatggcaactttgggaattttgggaaatgatgatagaaagccactgaaaagaaagtgccaatcttcactaacataaaattctttattttccttttttgtagaacttgggaaacattggtaaatgaatattaatagaaagcaattgaagaaaaagtgctcatagttgcacaaagcaaatgttggagctatacatgtcctaaaatcacattctttgctttcgtggtggtttcatgccttgtacacacccaaccatcttgttgctaccttcccatcctgtaaaaatataatgatcaagatcatgattagtcatgaacatctgtctttgtgaacatccacttcttttttcttccctgtttttgtgttctttcagtaagaattgggagggagcaagaagacctttggacatgttgaagccgcgtttttcgagctccttgtattcttggcatagcgcacaactatcgcagaagaagtggacgcagcagtccaagcagggcgactgttgcaagttgtactgtgcccgcattgaggatcgtttggtacaagcatacagccattggcagcctattgtcgccagcaaaacatacaaggtcccgtgcatgcagcacgctggaaacagggagagtcagcatacaagattgatggttttctgtgcttgaaccaaagcgcgaagtgataagttaatatgcctacatgttgagcctttgtccacaatctcagcaatgcgaccgaacgtaatgcaggggcaccagcaagtcaagcagcctgtgtagttacaaaagaaatgaaatcatacatgaagaattggaaacccatgtataagaggtgcaagaacaactgagaaacagctttgcatacaggttccgctatctccaaagcagtcgaagagcttaactgaccactccccagacatgctgttagtattgctgattgagaatctgtgatataaggtaggaggattgactgagatctgtgtctcaaggtaatatacaagcgttatacctgtgtagtttgagcagttggtacctttgatcctgctgctatttatatggctgtggcattgcagtgccttgatgtagaacatgtcaaattcagagccagcagtttatgttattttgctggttttcgctttcctatcacacggggtgatgtacgcttagtgttgtgtttgtatgtgtctttgaactggtatttctgagaatccaacgttcaattggcatgttctgctttgaatcgttctatctgagaacactatgctcgatcagcatctggcagcatttggaccttccatggcttgttagtctttgatttcttgtctatcatatatattgggtggatgtgaaaaatggaagctgttcagtgttcacctttcctgacagcctgtgttttcacattggaaaagtctggaacaaaaccttcacaaagatgttgtctcgtgatatataccctttgatgaaaggggcaaaattgttcgtcaatcttctttacgtccaaattcaaagtgagtaggatgatcaccgcacaaagcacctgatgtaatcccaattaatagtagtatggaagatgcactgacaaagtttagcttaaaaaccacaaattgcccaagtaaaagtcaacgtctagtagaatctgttatagtctccgttaggtagaattaacaatactccaccatttttgggctgcagctaaacacccaaaccttcttgggaaccaaacaggactaaagtaaaaggatttttttttttcactcagttttttcacatgaatccacctgaggtttactcatgacatgacatctcatcacacaagctagtactctctctgtttcaccgtttcagattataagtcgttttgactttgatcaaaatcaaactattttaaatttaattaagtttgtagaaaaaaaactgtaatatttttaacccaaaataaatatattaagaaaatatacttaattattgatctaataaaactaatttggttttataaatattactatatttgtctacaaacttagttaaatttaaagtagtttgattttgattaaagtcaaaacgacttataatctaaaacggacgtagtagcagctgctactctactcataaccaaaagcaaaccacacaccacacaccacatcaccactggtcaaaaccctgtttggaaaacgcaggaacagaacagagcaaaggattcccgcggaaaaccacgatatcaaccatttcaacctgggacgtgcaggggacacacacacacagagctgatcagatcatcagagagccagtacagtacaagaagcagagagccttgacggcgagcttcatgccggcgtcgcagtggcccggcatgccgcagatgaagtagttgttccctcgccggagcgtcacctggtcgtacccggtccgcagcaccgccgtgtccttgttcctcggcaccttgcaccgccggtaccccttgccgccgaccaccgccacgtcgtggtactccttgttgtacttgaacactgcatagccatgagtcagtcatgtaccctatttcgttgagtttaaaattgagaaataactaattggttgtcagtttctaagaacttgtaaaggttgtgaaacctaacttctagttactaattccttttccgaattctgtattggataaaaaagagatttgcttcggtccaataaaaagtatatcgaggtaccgatacctcacggtattaaatcgtttctgatcgttgcatctagctgggtaggatgggtattgttagatccaacgatcggaaatgatttggttccgtgagatatcggtacctcgagatactttttattggaccggagcaagtcacggataaaaaactactctatatatttaggagagtttttaattctgaaagaagatgcaactatcagaagcttctcgaaacatacgtacaatcacacaccaatggatctatgcatgaagctttgacattaacttgtgcacttaccgagcacgtcgccggcgtagaaggtcttgccggcgagccaccagtcgaggttgcggccccacccggcggcgtcgcccacgtagtacgtcttgccgccggcctcggcggcggggacggcctccatcagcagcgccgccgccacaaggcacaggagcaccacgccgccgccgccgcttgcactgcctcttccccggcgagccgccgccaccgccattttctcgctcgctcaaatcaaacgagattacaaaggagatcaccagtttagcttttagcacagttttgcacggtgtgtgtgtgtcttctgactcgtgtggtggcgtatatatagcccgcgaaatcgacgcagtgcagcacgtgctggcacgtcgagagcacgcatagcggcagcagagatgaagcttcttccgtggaagcaggactcttcgatcccggaatacaagaatattaatcctgggaaaccaaaatttcaaacaaaaagaaacacagaaaatatttttaaaaaataaaaagagaaaacatttccgtgaatcaaaataaattttgaattgaaattgagcccagtgtgaaagtatggaaaactgaagatccgtttgaaacacagaattttacagggaacggctgaaatgttgtaaactgctcccttcgtctcagaataaagcaacctacaatcagatgggacatatcctagtatcgtcctataataccaaaaacgtgaactttcgatgctatataaccaattttgccaataataaatgagaaatggatatatttttcacaaggccctgggactaggagggaatttggccggcgacaacatcgatctgcttgtaatttaaatcatttttctcggagaatttgacttccataaaagcgtgaaaaattgatagtactctcgatcgcctcgccacgccaccgacgatcgaaggtgcgtgctcaagtcagacctgatttagtcctggatcaagttagtcgctgtcattagatttcttgtcagcgtctacgtgtttggcgccaatacactcgcggggtgttcagttgaccacgggatgcagtgatgatatgcctcgaatcgcgcgcgaaaaattgcaatttgttccgatcttggcgggaagttaggccattcacattagcttcttcttaggcgtgtgatcgaattagtacttcctccgtattttaatgtacgacggcgttgactttttaaccaacgtttgaccatttgtcttatttaatttttttatgcaaatataaaaatacttatatcatgcttaaagaacatttgatgataaatcaaatcacaataaaataaatgataattacataaatttttttaaataaaacgaaaggtcaaacgtttgttaaaaaatcaacggcgtcatacattaaaatacggagagagtactagttaatcgtcaagccgacccgatccgtagtcgacggtatagccagcgcccaaccgctgacaattggtagatacagatagataaacaaggagagatgtgttgctcctgcctgccatttcgtcgctgctggtgacatgtgggtggcacgtttgagtatatagctaggttatgtatttaaaaccaccatgaattaatatatagacctagcagtagcacaatggggattggatttaaataaccaattcaaaggtcttacgatgtaaatatatttattctccccaccgcaagtcgtttctataaatgatttttgtgggggtatggatcaattgttgtataagggaagcattttgtaaaaaaaaaaaagagtgcaaacgtttcgcttatatttattcgttcagcttattagcaaaaaaaaataatattcgtgaataaactgttatattggtgtctttaacgatttattaaaaataagtgctataaaattaagtcccagaaattaaattttgacatataaatataagataaggctggaatctcattttcccacggtgattggagcagatacattcaccattcgtgcaagtgcatcatgccctcagatgtgccaagtcctcttcaattctattatatcatcagtaggataagtggcaaagccaggaatttaagcctgtggggtcaattactagtggtttgtatttaagtgaggtcatgtatctaaattcttttggattcatacatgaaaattaaggtttataggattttttttttcaaaaagctatgggtcagccaaccccacagaagaggcctaaatccgccactgaggcagatctaattgctagcagatttaactatttgccgtttaatttgatgtttaactacatgtgtcaataatttatgagccttcatatacctacaatatatagattcagtggtaaatagttatttgctacatccacgacgggcgaatagtctcatatttaaatatatcctaattgcttgcgatatcgactgcctggatgataagatttgaggaaagagaataaaagagagataaaactgggacacatacgaccaatgttgtcagtatcccgatcgtaaaatggtatcttatggtaatttttttttacacgggatgaagatgaattgaggggaaaaaaggagatgaactaaaagtattgagaaaatcagcatatgtctcttttgttgagaggaagagtagggaagtaaagcagagtttggttctagattttcgatgggctcagttcacctactatccctctactttacgttgagtctgtctaacatcccttatgtccaatactagaaatccccccccccccactatacgaaaccgtgtagaataggttctatggcagtataaataaatggttccgttgacgtgacatcctaatcagtaaagaggaaataaaaaaattatggggcccacatgtcatcctcactccttccacttctctctatcttctctctcgcatgccatgagcagggcaagcggggcggtgtcgctgtgtcgagcgaagcagcggcgcacaaagctggcaggcggcgggcggagcgctgtggcgggggtggagtgtagaggacggcagcgaacgccatagaggaggatggcgcagcggacggaaacgcaatgggtgaagtaggctggaagaggacaacgacaacgcgcttggggtttcactgggagacgatgacaacgactccccctccttctctcccactctcccgctggcctcatttcccccttctcccgccggcgcgacaggtagcctctcccccttctctcgccagcacgggcggtgggctctcccttctctcaccggcgcggccagggcagtcggtgtcacgcccagaaatttagcccaaatttccagactattttgtgtattaaatccctgtccaggaccagccagggtacacaaaacgacaagtaataaacagttccaaacgtaaataaagcgtaaaatacttacaaaagaggcacttagtcctcacaccgaaacaaaagcagcagcagcggaaaaaaggcgatcctagcggggcttcagctccactccacaggcaaaactcaactggggtctgagccttggtcttctaacttcgtcttcagctcagaaacactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggtagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgatcccgtgtaattagcaaaacatgcatatttatttgcaaacagtaaaacatttgtaaattaggatcaacatgctcaaggggaatgtgtgacttgccttgcttcctcactttgatcttccgaactcttttcctcgcgaccgcggacttccgaaacgacggattctacacgctggcacgcaaaacgaggaaaaactctaataaagaccaaggaaacagtacataaaaactaaacaaacatgtagacctcaattttagatgaattttgcaagttgaatggctcaattcggagttcgaatgaattagatatgaattttagaagttttgagccatttaaatgaatttctataattatttacgaattattgcgcaattattatttatttttacaaaggaaatggatctcgctgacgtcagcaaggggcgccggcgccgacacgcgggccccacacgtcagtgagcaaaggggacaggcgcacggtggacacggtccaccgcagcctcgggcgcacgtccaccatttggacggcccagatcggcccgagctgatcgggcggccgaggggagcggcggccaggggcactggcgcgacacaaagccggcccggccgagccaaggcgcggcggcggcatgcagccaccggcggcagcagccggcgacgcggaacgacggcgggcagccggaggacagcggcccgcacaggggacggcgatgcacctcaagaggcggcagccggcaagaaagggtgacgggaaaaaaaaaggggagggaggagaggtcctcaccgaaaacggcggccgacgcggaggaagatgacgacgacgacgattgcccgatggcggctggcgaggacggagggcgaacgaggtcgcccttgacctgcggaaggagaagagggagttaggttggggagaaccgatgcggggtgactagaaatgaaggccgatggcgacgacgagaggtggggctcaccggcgaacttagaggatgagttggagcggcggaagacgacgaccaagcagcggacgaggtgagggcgagcactgcgaacgcgccagaggcagcagcacggccgggcgaggtccccctcaccggcaaggagcggctggagcgctgtggaagcggaggtagctcggctccgcggtgggagggggttccggtggtgaatgggagggatgaggcggcggccaggcttgcccttgtggcgtcgaagccggcggtggatgcggcgcagcacggcagcggcgggaccggcggtagcgcgcggctggagggcaccgacggtggtggagctcggggtcgacggtggaagcagtgctcgggctaccaaataaaggggtggtgcggcggccgaggcgtggcactacgcggtgcagcttttggtggcggtggcgcagcgcggttgcgacaggaacagcggtggcgggcggctggagttcgccggggagcggcggagagagggagcacggtggggaggtggctagaaggcgcggggtgctcggggagaggggaaaacggatgaggggaggcacgtgagtcgtttatataggtcccggagggggagaacgtggccgggagaggcggatttgaagggggaaaaggcgccggcgacgtgggcgagtggcggagcaaaccggcgccggtttttgggggaaatgggggaggagagtggaggaggtggaggggatgcggttgctctcagttcggatgcgagcgcgtgaacgggaggacgcgaaaacggcggcatcgtgggcggcaatggcggccacgagcggctgctggctgggatggagggaggttggggatgacaggcggggcccatgggtcccacacgtcggctggagagagaggagggaaactggggaggcaaagcagacttccctcaaggcctgagccggcctagagatggaggaggcgcgcggcccgggaagggggaggggattttgggccaagcccgaagggaggagagggaaattatttggttttctttttatttaattgattaaatgatcttcgtgactttaaactatttctcgagctccgaaaattcacggaaaattatggagagtacattagggcacaaagaatattacaaaatattcccggccaataatttttaaaggaaattttaatttcctctattaattcacttgaataaattgcttaactttttatttaatttctaggaaatgcattatcaaatgatttttaatcccgaacgaaaatcggggcgttacagtcggcctcctatcccccttctcctgccggcgcggccggcggcctctcccatttctccagtcgatgcggccggccgcctctcctcctattctcacaggcgcggncagcgcggccggcctcctctattccttctcccgccggcacggccggcgacctctcccctttctcccgctgatgcggccggctgcctctcccgccgacgcccccctctcctgccagctgtcccgggctggaagaaaagaaagacgattggctgacatgcggaccccacatttttcttctatcacttacatatggacccccacaatttttttattccctctttgcggattaggatgccacgttagtaaaaccatctattatactgccataggacctattctacatgatttcgtatagtttagggggggagatttctggtattggacataagggatgttttacagactcgacataaagttgagggacggtaggtgaacttattcctcgtaggaatcgtgcaagctgggaataagttcactttgtgaccctcaaaagtgattgaaatctaatccgtgaccctaaaacacaaaaccggatatcttgacccccaaactatgaaaaccggtgcaatttgactccctcagcggttttggagggcggtttcgctgacgtggcggtattgaccaggtcttctttacacgtggcgttgatgtggcgccaccccggcatttcaattaaaaagttatacgtgggactcatttgtcattcacacacaattgtggggcccactaacatgtgggcgccgcggatcctctagagaagncntgcaggcgtgcaagcatgaggtgtatccatcaacacgct

SEQ ID NO: 59292 - DNA, 10390 bp, Oryza sativa
  unsure (1)..(10390): unsure at all n locations
attcacttgtctttaaaaaccaaaagggcttacctcccaaaaagagcctgtgaccacagcattcctctaattcctgatgctaagccagtgaatctgaggcctttatagatacaacccctgcattgaaggatgagattgaagcccaagtggccgaaatgctacagtcaggggtaatacagcacagtcagagtgccttctcttcgccagccttgctagtacgaaagaaggatggaacttggaggttagtgattgactaccgacaactaactgccattacagtcaagagcacatacccaatgccagtcattgatgaactattggatgagttatcaggagcaaaatggttctccaagcttgacttgagagctggttatcaccaaatcaggatgaaggcaggtgaagagtataaaacagcattccaaacccacactggacactatgagtataaggtaatgtcctttggtctcactggggctcctgctacatttcaaggagcaatgaatgccacattgcaatctgtgctcaggaagtttgctctagtgttctttgatgatatattaatctatagtcctgatcttgagtcccatttggatcacatcaaacaagtactatccctgttgcaaagacaccaatggcaagttaaattgtccaaatgctcatttgctcaacagcaattaacctacttgggtcatataattagtggagcaggagtatcaactgatcccagtaaggttcaggaggtggtggattgggccattcctactactcctaaaaagctcagagggttccttggattggctggctattacagaaagtttgttaaggggtttggcattatcagtaaaccacttactcaactattaaggaagggggttccctacaaatggtctgccgagactgacaaggcattccagacacttaaacaagcactggtaacagctccagtgttagcccttcctgatttcaatcagccgtttacagtagaaacagatgcaagtgattcaggcattggagctgtactgtcacaagggggacacccaattgcttttattagcaaggctttgggtcctcgtaccaaagactttcaacttatgagaaggaatgcttagcaatattgatggcagtagaacactggagatcttatttgcagattggggagttcactattcttactgaccacaacagccttatgcatctttcagatcaaaggttacatactccatggcaacacaaagcttttaccaaactgcttggattgtcatataagatatgttacagaaaagggagtactaatgcagctgctgatgcactttccaggaaattccaagatgaatctgagttaaacttggtttccagttgtactccaacctggttgttggatgttgctaagggttatgagactgatcaattttcattagatttgctcactgctctagctcttaaaccagatgcaaagcctgggtacaccttgcagtcaggaattataaagtacaagggacgaatctggattggtcagaacagcactatgcaaaatgcgttacttgcagcattccatgccagtcctattggagggcactcaggattcccggttacttatagcaaattgaagaaactttttgcatggcctggaatgaagcaacagactaaacaatttgttcaaacctgccaaatctgtctgcaagctaaaccagacagggcaaaataccctgggttactgcagcccttacctgtgccagaagggtcgtggcaagtggtgacactagattttattgaagggttgccaagatcttcatcttacaattgtatactggtggtggtggataaattttcaaaatatggccatttcttgcccttatcccaccctttcacagcaatagatgtggcaaaaacttttatgctgaacatttataaactacatggtcttccccagactataatctcagacagagataagatctttacaagccaattgtgggagcagctgtttactagatcaggaacacaactgcatctgagcactgcttatcaccctcagtcggatggccagactgagagggttaatcagtgcctggagatttatctcagatgttttacacatgcaactccttctaagtgggcagtgtggcttcatttagctgaattctggtataatactgcattccactcagcactgaatacatctccctttgaagttctatatggccacccacccaggtattttggaattcattcagaggattgtgctattcctgaactacaagtttggctcaaggagcgtagactgatgcattcattgattcagcagcaccttaaccgagcccagcaacacatgaaaaatatggctgacaagaaacgcagtttcagatcttttgaattgggtgactgggtttatattaagttacagccctatgttcagtcttctgtcgcagctagggctaatcataagcttgcattcagatattttggccctttccaagttattcagaagtttggctctgtggcatacaagctccaacttcccactactagttctatccaccctgtgttccatgtgtcccagcttaaggcagccaagggtttccaaggagcattgcactccactctgccttcttctgatgatgctttccagtatcctatcatgctcctggataaccggctgattaagaaaggtaacaccaccgtttcccaggttttaatacagtggtctgatactgcagttgaagatgccacctgggaggaccttgaggatctccgggcgcgttttcctgaagctttggcttgggggcaagccactttccaaggggaagggattgtcaaggcgtcaggcgaggaggagccgagtgcaagcgccaagctgaagatgaagcctgtgccggatggtgagcaggaaggaggagaagaagacttgaggccggccagagtcattaggcctaatcgtaaatatgttgggccggaatgggccatgtaacctgtatcgctggcatgagctggcatctgtcttgtgagaggggaaggaagggagttggtagcgagagagagtataagaactgaggtttctaaattgtaagggacttttggcaatctggtggcgaatggcggcggcggctcaaccctgttgggttggagcaagattatcctagtaaaagattgcctaaacacatctctgttcttcctgagttgttcgagttcttccacttttccttttcattttccttagttgtgttgagtccatctggtgacgctgacagtgagcaacatgtgtgatagcatgtcgttccaggcgtcaatggcgccgggaacacaccagtgcacgcagtcattgaagatggtgaagtactctttcatccattccttacgacgcgtccatcccctgtacctgctcgggtgcgcgtccgcccgccgtatcatcgcctccgtcgtgtccatcagcatcatcctcaccccgccggcgctcgccgcccttttgccgcctcgaactcctccacctacgaagctcagaacacacgtttactagaaagaacaagataattgatcactagatcaatggagaaaaatcaagaaattaacctgcagcgtgtggaagtcgagctcgaagccctgcagcgtcttctcgccacgccggtacggccgcgtccggacgcagttgccgtccttgttccactccccgccctcgtactgcgacggcgacacggtccgcagcacggcggtgacgccgccgccgtcgctgctcaccacggcgcggagcgcggcgcgggtggccatgcggagcgcgtaccgcagcgtgaggtcggtgacgttggggaggaggcagtggtggcacccgacgagccggccggcctcgtacagcatcgacgggcggtagaaccagctcgacgccgacacgacggcgtagtcgaacgccgggacgtgcggcgcccacacggcggcgggctcgtcgaggtagaggttccacaggcccgtgtgcgccggcccgtcggcgtcgacgagctcgctccggaccaggaacggcgcccagaagttgaggacggtgaagttgtagccgccgccgtagtggtacaccgtgtgctcgctgctcggccagctcgtcgttggcttggcaacctgcaggccggccaataaaacgtcacaccctttgctgctggcccatttctgaccgtccgatcaagcgatcaatgattcagatcgaagctagtactgtagcaaatccggcacgttttttactttttaccctggtcaggagacagatgagggagttcatgtggttcttggcaagggaatccccaatgaaggccaaggtcttgcccctcatggcagagaggaagcgcaacgggtcgagacgggggagatcacaaccgtcgggacgccaccgccactgcacgaagccaaggtccagcttgccgtacttcatacagtcatagtgctcgtgaatgaacaagcaggtgtcgttggtgtagtagggtgcatcagggtctggcacccattcgcctctaaatatgtcgcaggcctcgccgtcagccttccggccaccggaggaggtggagaaggaagagtaggacagccaggcggacagtgttcacggcataaccaccgggaaagggaagtatgtgtcggagacggcgatgacagcgacgagtaggaggatagagatggcgggaatcaagcacctgccgttgtagtactgcgtcttgacaagaaaattgcagagattattaagaagcgccatcgatcggcactaggagaaaactaagaatctatatttatgtgagaattgggtgtgaaacaccggtggagttaattcaggtgtatatataagaaggtgttcataatctcaatgtatcggaattttggttttttgggggtccactgctactggcctagtaatataatctccgcagcacacacagtctgtacgtagtatggcgtcgcacctcatggcaccgcgagtctctgttggcatccatgttacttcctcgcagcaaagctcacagatgattaaattgttggtaagttatgggatccgagggtctcgagcatgagcaaattctctcggcgcgcacatggacacatcacacatggttggtgtcctctacagaaagacccattttgtcttctatcgaaagacccattttcactttatgtctgtattgggtagaatctcccacttgttagggcgaagctaccatgaagctaagagctagcagaacgaagaaactgactatgttggtcatctaggcatatgacttcaacactcataaaaaagtgctcacatgtactccatccgtcccataatataagagattttggtgggatgtgacacattttagtactacgaatctggacagagagcttgttcagattcttaatactaggatatgtccacaaaaatcccttatattataggacagagtgagtaattatgtaaattattatcctttcccctcccacccgaaaccctcactgcctcttccccttgccatgccacctgagctactgacatcccgtagctgctaggacagcggaggcgaggcttgtgcatcagtaccaggtgaaggagtggtgcggcgacgtaggcaggtggcaacactggtttcggctggtgggcggcgcattggtggaggcgcaaagaatgtgcttttaggacatgtatagctccagcatttgctttctgcaatgattggcactttttcttcaatggctatctattagtcttcatttatcaatgttttccaagttctgcaacaaggaaaataaagaattttatgtttgcaaagattagcactctcttttcaatggctttgtggcaatcctcatttcccacagttgccatgccattcaacaaggaaaataaaggcgcattcatgaccttcactactcatttggttctcaaactgtaaaatttcctttacatatctattactccatgtatttcaagctttgcttgagcatatgtccattatgaacgctaaatatcacaaagggatatgattaatattagctactgataaatatgtactaacacaaaaaaatatcaaactgggtatattctaatttcatttattttgggtggttaacatggatattctgtaaccaaatgtcaactagttcgcttaggactcacaaattttactaaaaatgttgtaccgaaacagcatcctattctcgagttccatttatgttccaagattaacaggcatcacgggttgtaaattgcattgcggtcaatctatggacacgactgatcatgcgctggtacactagcatatgcaaataaaaccttacgaatggcaaagtatccaaataaatgatcaaaatgttgctttgagaatattgaacgacacagcatgacagtttaaaaactgtcatgctaataaacagaacaattcaaggtgaaagaggtacaagcaagagaaactgaccttagtccaccctctgtgctgttccaattctcaatcggaagatgtctgctatacgtaacagacaccataaaaggttgaaaagatcaacaaccttgatgtgcttacgttgaggtctgcaattgaaacttctcaacagttcatgggtcatgaattcctttgtccatggtgacaaaacaccaactctacatcagcatctcacctgaagaactcatagattttcttttgatcatatacattacatcactaatttcttttatcaagcctttgcagcagtcctttcacactagaattccatgtagtcattatgctagaagtatccgcataaaggtttgatggttataatctgacaaaatacaaactatctggtggcatccaagcagttattcaaccaaatatccttaaacatttgcaggtcatgaactcaataggtcaatcttcccttgcagacagatgcctaatgcctctgtagacatgtaagtatgcaacccccaggccccatcacatccaccagtaatcgctttgatcgattgtgaaacacagaggtgctgaatactcttcaaatgaatcaattcaataagcatatcttgcaaccaaggagatgaatagagtcacaaacaaaactctgcacaaacttatcagcggttatcatcattaaacagcaccttgtaaaacttcctcctctcctccctcttctcagcactatccaaccgcgctgcttcctcatcgtcctcctcctcttcctcctttatctcaatctctcctctcctcctcttcttctccaaattatccgaacgccgccgctgattatactcatgcagcccctcctgcatcagctccccgagcctatccttcgccgctaccaccggatccttctccctaagctccgacccctcgtaaccctcccggagcaccaccgtgtgtatcttgtacctgtttgagacgtagaagaggcacggatgccgatgcagcatcctcgccgtgtcctccggcaacccgaactccctcctgaaatgctccagcttcagaaccgacatctttttccacaatgtgagcgagaggagctcgtgcaccaccgccaccgctcgcttctcggcgtcggcgtccgtgcctatcgccgcccatctctccgagtacggcgagatgtacggcgtggaattgaattcctccatcttggcatgagacttggcccaggagggcggcagcgagcaggtgaaccgcggggcggaggagtcggcggcggaggcggccgccgcctcgacggaggagacggcgagggaagggacccaccggagaagctccagctcggcggcgttgcggcggtgcgggtaagggttgacgaggcggaagaggtcggtgcgggctgggaggagacggaggaggtagtcgtcggggagtccgagcgggccccgcagcgcggcgagcttggacacctggaggcggcggccgcgggcgagcatgagcacccgcgcgaggcggtcggccatcgccggctcggacgccgcgacggccgcctcctcggcgtcgaccagcaccgccatccgcttggtgaacccgaagcaggcctcctccccgccatcgccatcgccgccggcgccgccgtggaagaggtcgaagcaggaagggtacttgcggagccagttggcggctcggccgaggaggtcgagcgtcttgaagcgggactgaagaaggcggacggggccggtgcgggacggnaaacgagaaggaggcgcttgatctggttgttcacgatccagcggcggttgcggcggagcgcggcctccagcgccgggtccttcggggaggaccaccgtgccatgcggcggcgctccggcgacggcggcggcggcgggagggaaggggtgtgagagtgtggtgaaccgcgtcggagtgttggacggctgagattggcttgcgataatgggctgtaggattgtaaaaatgggccttgcatatttctttaatgggcctgtttgttggcaattggaataggttcactttagattcctcttcttgacgtcgagtttaaatcacgccctgaaccgcaataccagaaatcatgactcccaacttgcatcccgggttaaattaggtcctctagcagcatagatttgatttggtagatgaaagttataaatttgtactagtactaataattatctcaaccgtttaatttggtagatggaagttataaaaaatttagatgcattcatagcatgacatgtcagtgttagtactaagaatttacgtaaccatcgtttctcttattcgcgaaataagcaaaacggtatattcgcaaatgaaaagtaatttgtgaataaaacttttatatatgtgttcttaacgatctaaaagcaaatgctgaaaattaaacttcaatgaaaaaaaccttaaattcaactccaaatttatggttgaaaatttaaattttggctgataagtataaatataagtgaaaagttgagacccttagttagaaaaagttactccatgtttatatatatttttcctatttttttaggttatagttgacttgtagtattaagggggtgttcgggagagtttagtcccttttgatagggattaaagttttggtgggagagagatagtccctctctcccaaacagcccctaaacttgctcttatggaaagaggtagtacgtactgtacgaaccaagtgcaagtttgaagtttcccaacacgatggcaacatcaggcacggcgatgcgaggtggcgctaacgtccaccgtgccgaccggtttggagcctcctccccgcttgcaacgcaggggacgaggagttaggctctgttcgttctgggggacagaggagattgtgtcccgtcttccaagcgcacatttttcaaactattaaacggtgtattttttttaaaataaaattctatatgaaagttgatttaaaaaatcatattaatccatttttaaaatttaaaatagttaatactcaattaatcatgagctaatggcttacctcgttttgtgtatactcccaatctccttaatccccttctgctcaaacacacccttaggccaccagctacatgcaagaactgcaagctgcagttattaggggtatgtttagtttcaaagttttttttaaaactttcaactttccatcacatcaaatcttttatatatatagtaatttttcagtcacatcgtctctaattttaattaaattttaaactttggttgaaactaaacacactctagatgatgatgcgatgaattctgaaccgggggcctactaccgtctaccactagtctggtccttcccctcgagtaataaacgatccaggcgctgctgctatgctgctgcctgctgctcaatggccagggccagcctgatcctgcagatgatgagtgtggtagagagacagagagaaagccagctaggctatgcatggcagaaagtagtataggagtatgtgcctctaggcacaagtacgtactgtactcctacaggtacagtagagtaactggacggatagatggacgggatcgtcactgtcctcaccctcgtagattgcaccccaaggcacaaaactagggctttgcgtcaaaatggccagagacccgtgccgcggtggtccacgaaagaatctgagagcgcatgtacgtatgagtatcatcttaaggatatgaatgtgttcaaagattatacgttatgttttttaaaagtgtgtttaggcccattattagaattagattttttttataggacggagggagtaattggtaactaagctaggcttaagttactaatactctccctaaataactcaaaccctagcttcccaaggagttttcaaggaaaaaacaaaatagcacaatacccttaattaatgtgaattagttgggtgcccgcgcaattgcacggctagcaccctataaaattatctattttttacatatgattttatgggtaccgagctcgatncaacaaanncacatca

SEQ ID NO: 59293 - DNA, 7962 bp, Oryza sativa
  unsure (1)..(7962): unsure at all n locations
atgggaagcgaagtgcataaaaatgacacatgctcgtcatgatcgtgagacagcagttctcttgtatttatacagcgccgtatccttcagtctgcacacaaggaattttgcagaaaccattagttggtgaggcgttctgccaatgcctcactctgcaagtgcggaggagctgaaccctcaatactcgcaggcaatactaagttagcatttaatggatactagctagtgctgaacaaaataagaaaagaaacttactagcatttaatggatgtatttgttcttgcatcactagagcaaagcaagaacttgttgactaactattgttaactgttatgctgtggtatgatggcttgtacattgcgtactggatggaatcattccagaaatattactggcttatttgacattgttgattgaaaatttaccaggagataacaaaacattttacccctattgaacagtgatggcttatgattatgacctggaagtataactgtttctggtaaaatggaaacatggtactgtatagtgtacagtatgcctcctaaccgaaaaagtacacccagatagctgtactgccagaattcagagaaaccaaagctgtactgccagaattcagagaagcaaaagcagcaagaagtaccaaagtgtggaccttgcattctccatcatctacaaatcaaatgccgggaatgagaggccatccagggatttccaagatagggagccaaccaatcacagaccagcatcctgccacgtgtcagccagaggcagcacaccatcctgccacgtggctacccaccatgcgaggccgaggtcccgagctgtggtgcaagggtgcaccgttaatttcgtttcgctagtagatagcgtgacagtgtgagatcgagctgaaaaaaaaagagaggccacgaagagagctcagctgctgcctctagcttacttggtgataaggaggaggaggaggaggagggcaccgacatggccgcagccacggcgtacaccgtggcgctcctcggcgccaccggcgcgcgcgtccccgccgctccacgctccgccgcgcttctgccgcgccgcggcggcgtgctccaaccgctgcgcctccaggacgcgccgcgactgtccctgctccgcgtcagggccgcctccgacgacacctccacctcggccagcggcgacgagctcgtcgccgacctcaaggcaaaggtgagttcgtgcatatgtttgcatccatccatggtcccatggaacatctcgtcttaatttgacatatggttggatgcagtgggaggcgatcgaggacaagccgacgttcctcctctttttaaaaaaaaaaaatctacgggggcgggggcccaaccctgtcgtcgccttctggctcaccaccgtcgtcgtcggcgccatcaactccgtgccgctggtacgtaccatcgaattaatcaatcacttgcagctttgtctgaactgtgactgatgacgagttggccgacgtgctcttctcttgcagctccccaagatcctggagctcgtcggcctcggctacaccggctggttcgtctaccgctacctcctcttcaaggtaactaagaaatcaatcgtccatgcagatgcatccatcggtattaattaacatgggaattaaccgaatcttgtccaattcatgcactgaaaagtttggattttcaagtcgaataatcgtcctgaacttctctatcagtttacttcaatttgaattggaatctgaatttctgtgaatgttttttttttcgtgtgatataaacaacaggagagcaggaaagagttggcgaccgacatcgagaccttgaagaagaagatcgctggaacggagtaattaagcagctgcatttgtccggggaagttttggggggtgactctctagagtgcttgctgctgcttcctctgtgtgatgtttgtatatctctacgagaatatgttctgctcccatgtgcagtaacagcgtagtgcaaaaactgtatcaaacctactatcagttgtttcttcgaaattcaaaacaatttcttcgctttcttgttgcgtggaagtgttcatataatctggcgtatgacaatgagaatatatatctcggagaatggttgatcgactcattagaaaagaattgcaaatgagttgatgataaacatctctgaaatgcatcccctcatggccattaacgatcctgctgatttatgaagaagcaattatcccgtttaccatgactcctcccttcagatcttcataagtgcaattatctcctacaacaaataacgccagaaaatattgattctataacaattcgggaggtagtgaaacaaccaaaataatatgcaaaacacaaggaacatgacaccgcagaaagtcaatttacagaaatgcttattcacagcgagaccggtcacagaatgtggcccatattgaagcgacggtgttcccgcatacaagggttgaaatgcaatggaccaaccgtaggaatttttcatatttgtccttaaaaaaattatttcctctgtttaaaaataaagaatttttatgttgtttagcaaatattaaggataggttaaaatatttctttttaatcactttgtttttgttaatttttaaattttcagttgtttagatcaactaggaaggtagcccgcgcatatgcgcggacatcatatttaattgtgttagaaatttgattaggaatatttatgattaatctattgtaaatatctttaattttttaataatttgtgtggtgtttctctgaatgctagtaaccatcgccgacgtataaattgtaaactaaaattactcaaaacaatgcagttttggttttataagaaaaaatatatatgaaactatatatcatttgtacataacgcgtttcttttttttaatatttagcataacttaattttgtactttctaaactctaagtaacaattttcttttgtataatatatatgtctttatgaattttaggatatattaattgaagatattttctattaaaaatatgcctaatatgactacatataattatgagctgaatatgttgaaatattgatttatttgtgtgtatatagtattgcagtatgaaactacagtttagcatttatttgtgtgtatatagtattgcagtatgaaactacagtttagcggtaaatgtttttctcaatgagaaaatatattagaaaataagacttttatcgctcccaagttgtagtttagggttgtatactttgaactgaaattatgttagattttgtttccaacataatacagaaaaattcaaattttctattatattttatttaaaattttagttattttcattatttcagtactccaaaaatattaaaacattgctatttaggatgggtatcaatttttttaagaaaatgttaaatttagaaaaaaaaaagttcagtcttcaattatttttatcatgttatttttttatagatttccattccatcaagcatctcttaaatgttttgatctctgccatctagaatggtaatataagtgagttaaggctatacaacttggcatgagataaaggtatcccttaaatgttttcaatgtgttgtgtatgataaatagatcctagacggggtacacgttatgacatgaaataatgatataattaaaagttttttctctaatctattagtgacatcagatatcatatgtataatttagatattatcatcatcttaggaacgtttatttatccctaaaaagatcatttatttataaaagtgtatctacttatgatcaagtaaatagcccccctatatgcatgttaagataaattaactacttccactgttgaggaaaaatatatcaatatttacaacaccaaattatttttattgaattcaaaattgaatatgtttttataatatgattgttttgtgttgaaaatattactatattttttataaactaattcaagtaatttcacattgacaaaatttaaaatgacttataatctgaaatagaaggagttggaaaaaggtgattagatgtctagcatggtataaataatgggttgaccgtttattaaaaacataagtggtatattttaactttttaatgagaaattttagtattctattttatttattggaggcttaaaggtggatagatgtggtccacaatgtaagtcaatacaaatattaaattattgatttaattgaaaattacaatagtgtagaaatatcataaatgaatatacgatttaaaattttatgagtattttaaagtctaatttacgttgtttttataagtgctagcttgaggagaaagagaagaaaagcacttgacacaggggaaactggctagacttgttatgcggagtccatttgtgggagtttgtttttatcacaaagataatgttggatttagttactatggagataaaaaaaagaacagagaaggaatggtagggagagaggaatcggaggaatgggaggaacaggagggggttttgggattttctttttaaagatagatctaaccatataaaatagtggatccatcgatttaagtggaaagcgatggttagatgttttattttcatttgtcatacttatagatttttctaatttattagagtgttacgtggcgagatcaacttagaagtgtttatgggcgtaccattaggccctaacatttgtagttagaacggcagcacgatctattttttaataacaaaatatgagtaatatggattttgaattttatatttaattataaataacacaacaactgataaaaactgagtataaaattataacttgagagtcgtgatcatttagatgtccgaattattttttgatatattgagtgttaatgagaaaataggataagttagctcgaaaataggagaggatgggagattcggaggatggaaggagtacgtactacctttttttaccttatgtacgtaaggtgttggtggtggggataccaaatttattttctttgcgttggagatctaattgttaaaattaacgggtccaccattttaaaagaaaatcgacggtgtgattatagaataccacgtggtgatttatgagcgtttgtagaaggccatatgacggcttgagagtatttattgaaagtttaattaacttttagtatataagtcctttaaactttttagaaacgctattaagctgtcacgtgacactcatataaaagcttgtaggtcaccacatgtcatatctctcaattaaaagaattattaaaaattataagaaaaagaaaaaaaatctaactgtggattttcacttaaatcggtaagatgtgattttatatatctattaacactacctcctaaactcccctagtgtacgtacgatgtgcgtagtagtagtactgttttcagaacgtgtaaaggaaaagtacttttgcaaaagaaaggaaaaaaaacaatactaacgtggagtatgtatgtatgccgccggaaaaaaaaggaaaaaaaataatactaacgtttcctgcccgatccagactttttctatatattagttagagtaaacatggtaatttttttaaaaaaaaagtagggacaccagatttattttttagatggagatctaatggttaaaattaatgggtccaccgattttaaaaaaaaaatcgacggtgagattttagaatgccacatgacgacataagagcatttgtagaaggccacatggcggcttgagagtgtttgtaggaagttttatggacttttagtatataatagatagattacaattaagtatgtgattggctttgaacccataaaaaattaatgataggaaccaatacataaatgcttatattgtggtacaacatttaaatcctaaaatacttatattttaaaatggatgaagtattttacaaatatatcctcctcaagcacactaggcacttatatatgacagctcggtaccatgtttgtagatgtggccgagggtcaacacaaacctcgttcatgccaaggggtttgaggcttatggactccaagtcttgttcattttatttctatctttaatccaatctcattggcatgggccttatagactttgaggcttgtttattttattgttgcctttaatcctatcaatttttggtaagataatgaatttaagatagtcttactaatgctatcataccagaatttggtagctctaggaatttcctctcataaaaacaacaccagcataacaaaggtattaaactagacacatccaacgctgccaaattttagtgacacaaaaacgtgctaaaatttggctgaattttggtaatgttgattttagcaataaaatgaataagccattagtaccaaatagtccttggttgcagagtgaacacttgaagggttcggtcttcgttgccaaattctttagttgtaggcttctacgcttcattgccaaggaagcaaaccctctgacttaactgcacatgcagttgagtcactgacatgtggatcctactttgctatagctcacatgccagtaaatccctttcatctcgccaattatgtattgacaacttggtacgaggtccaacatgaactcttgtatctcaaagccaaatgctatggcaatacatatcatttcacatattttagctttagatctgtagcactattatttatttaaagttacaaaagttgtaatttattaataaaattgatgttcaatatatagttttgtgatacaattccttagatctatcgttttgtaaaaataattgacactaaatctatagtttgtaatacacattcttataagtttgtagttttacgacagtttccttagatctatcgttttgtaaaaaaaattgacactaaatctatagtttgtaatacacatccttataagtttgtagttttacgacagtttgttttaaatatcaatagttttgtaaaatttattttatttttattttctttttactagcggatgtctggttgatagattgcaatgaaaatgagaaagctgagggagcatatatttacataggtttttcaaattgttttattacgagttcagtgaggggtctattagagcaggtacaatagcgggctattagccagctataagcatattttaatgagataaaagatgagagaggagtagcgggctacagatctgtagccagctgcagcacggactccagaatacaatatgtgtatggtaggtgggaccatgtgttaatagtatagtaagcaactattatacgaattggctattagatcggttattatagataaattggagttagtagtgggctatactatttaacttgctcttaaattgacgaaaacacacagaaatctacacgggcacacacattgcgtgtagtgtgaagcatgcatgaaccgtccgatccaaatccaatggtgcagttaacgtgctagatggcaccgcagtttcccatctatgggccgacgcttcgaagctccagaaaccctctctctctctctctctctctctctctctctctctccccttccttccccgtgtcttccagaatgttccctttcgccaccgtcgccacgcctcgccctcaccccgcgctccgttgccgccgcccgccgcgccatggtctacgccgccaccccgtagccaagcccgcccagccccaaggcggtgcgggttgtggtgaagggccgggtgcagggggtctttttccgcgactggacggtggagacggcgcgcgcgctgggcctcgccggctgggtccgcaaccgccgcgacggaaccgtggaggcccttctttccggcgaccccgccagggtcgacgagatggtgttccgccacctccccgtnggccccccgcgccgccgacgttaccggccgaacttccctgcctcggcgaccccgttaaacccggcgggggctttacccacaagctcaccggttggagaagaagacaacgtcctttttt

SEQ ID NO: 59294 - DNA, 6712 bp, Oryza sativa
aatcataccttagataaactgttgaagtataacgaaatagttcataattaaattaattgccaattcttgtgcagctacatatatagaatgaaaattgttgcaataacaaattagttctccaagttgccattagtggaacaaaggcggaaataaatcgtgtctagtcctcaactgattaaatagcttcctttatttgatgatataattcaatctcaagaagaatttttcttcttgcttatagcattgacatagatagtatgaaattgatttccttgcagaaaaaataaaacaaatgtagatcagtatgagaaacatagagtggcgacaacgtttggcgtgtcattgcttaggagaactttccttgtgcagaaatgcttgttgacagactcctctgttggctcgaggccttctgcttccgcactgaagctcttcttacctaggttgatgaggataaggcttgggagttttgggtacaatatggaggtcatatgggctttgatgtaaaaaaaagatacaaaaataaaagcaagtctgatgacaagatcacatcctgcagatatgtatgttcaaatgagggtcgacgaacagaggacaaaagagatcatctcactaggtatcctagagctgaaactagaactgactgtaaagtacgcatgggtctcataataaatcgagaggtaggaaattatcaagtgtcggatctagttcttgagcataatcacatccttcatttgccagaaaccatccacttgatggcatcacaaagaaaaatttcagaaattcaagcctttgaaattgaagcggctggtaattcagggattaggccaaaagctgcaatgagttggcatgttaagaagttactggaccgcataatcttggctacacacgctgcttgtacccagtgcaatacttttgtttttttttcaattctactgttttagtcacaatagccacgccttgtagtgttctccaaactcagctgttgatttgcaatgcatgaatgatgctagttgaaacttaggtcttattttgaattattctaaatgatagcagttttatgcttcagtagttttggttctcttgttcttgttgtagacttgacagccttgtcctctgcgagactgagtccttgcatgtagtagcaggcaacagggtcattgtgacctgatggcctagccgatggccacagaaatcgaactgggccgcacaatatgcagttcgaaggagggaagatggatgtgtgccgttggatgcagtggtcagcagggatgaaaccaactgcaacaccgtgactttccacccaatgtcagaggatctgtttccctcctcctcctgtgatccacgctcaccctaaccccagatcatggccggccgacagcggtgcgaggcgggagcgaccgcgatggagacggcagcgactccggcgtcgggccaaaccgttccgattgctcgcgggagggcatggctcgcaacagacgcgtgattctaggactgatgtacgggtactacgaggaggcgctcgacgcgctgtcgctggaccgtgtgctagtgctcgccgcacgctattgatgctaaaaacacacactagcctgtaagatctgcttaacttcagtgcaggtccaaaatcttgcttttaggttcgtgagcgtgccagttgatttgatcatgcaatcaataagaaagaaagataagaaaaaccgcggttaaatctataaacgatagccgatcggctagttgccgatgacatatcatttatctttgagccgatgtcatgttggaatcgatcgacagttatgaataaataagataaagctaaatctactcgatcggctgtagatattaacgatatataatgctttcttcgatgtatatttaaactacgtgattgggatagatcggtcgccatgccgagatagtataaatcactaaagtcgaagtatacactaaagtaatgattatatatacgtttatagcatagccgatcaggtagatctagcatgtatcggctaatactccgataccactttatactaagatattaaaacaggcaaaatatatcaaacaaaaagtctaatatactttaatgcaataagatctcactctaaagggtagatctagcctatcaatcaagcatatgagatgtaaagtagctaaatcaggtaagatcggctgaaaccccgatgctatctctcttgataatcataaaacaagccagatatcataattaattatagatattacttaatagatcgaattcaaccgatgtagcattaagcataaagacaagtataagatctaggcaagaggatgaaaacctctaagagatggtagatacattatataatctagattaataacaaaacataactctatcgtttacttcctaatagtaagaaccagccgatgacaagtcatatagcgcaactaacagagattacagagtgtatatgataactcgacgaattacataaacaggattagagtgtcataaagatggacacactaatccggagaacgcaaaccgccatgacaagtttcatctagttgaagatcgaaaccgatgcagttcaacccaaaagtaggaactcgtcgaaatagaacgaaagtaaaagggtggcgatgcaccgaaagtattattgaactgttgttttttattacattgggttcagccgttcaggtcatatttatacctgagatacaaaatatgtccttgccggacacaactcttatctctaacaaactctaagataccataagtctttgcggcagacttttgcccaaacatatctctaaagagaattacacgaaatatcctaattaatatatataattgtctttctgagagatttatctccatcgtggcaatccttgtgaagcacgttgattgattctagaaacagcctcggagccatccccatcggaatcggttgtattgactctaccggctgtatccgttgttctctatccgatccatctcaaacgatgcagactccagccgatgccttcgcagccgatgcatactctgttcttcgaatctaactctttgccgaatctgcttcgattccaatgccgaacctggttcatatcttaccaaatttggtcgttaacacacgcctcctcaacgcaggcgtctacttcggcttcgccgaccctgtcaacaacatcatcgccaacaccctccgcgtcgtccccagcgaactccccgactccgacggtgccatgattccgaagcgggagaccaccatggcctcacggtcgcgggtggcaagagcaagtggggagatggtcctctctaagatcgtcaccggcggcgacgtcccctcccctccagaggcgcacaccgtcgcggagcgctcgctggaaggcctgatcaccttgacatcgtactaccactatctccccacctaggatgcgctccgctacctccgcctatccatggcggatctccttctcgccgtccgcctcatcgaggttgaccgccaccatcatcgtcacaaggacagattccaattccgctcacatgctgccaaggctgctcttagatgcgccgcgttgtccacgaggctgcctgatgttgatgctgatgctttcctcattggattgtccgcgccagtgtctcacctcgcccactctttgtctgcagagaattccggcccgtcgtcgcctcctctcgattcaagatgtgaccaggttaaccagattgatgcagaagccgctggatctgaagaatttgaacaatcctatggatcttgctgctatgagatgccataaattcgaaatgaaggttcagcctacattgacactgtcactccggggcatttttctggacagaatccatggtgtgtacctcagggcaatttctcggatccctatggaagatttccgcggccgttatcaccacggccttctcaaggccggctattgttacgggccactcaatccaatgtttcctgcaccggatcaagctctcaaatttttatatgtatcgagtctcaatctttggatggtctcatcaatgtgttggttgcccgtgtttctggcctctctgaacatgatgccatggtttatttgctcaaaagtaatctagatcttactcaagcaatctagacagcgggacaaaatgatataagacatcaagttgggatgttactgcttacatagctacaacatatgcatcgtctcatccgaaacctgaggcttatctgcattttgccatggaattgctacctatggtgcggtctgttgtcatggaactgttggcacatactctctcttccagccacattcttcaagaactgttggcacatactctctcttccagccacattcttcaagaactgttggcacatactctctcttccaaccatattcttcacctgccagagttgttatcatattcaaggagttacccttcacctctcagagttgttatcatatacaaggagttacccttataattcattgcagccaactgatgagctaacacaggacgccttgaaaatggcctaaagctacaaatcaaactttttctctcaacagaacattgttcgcaaaaaggtggaacatacattgtgaaactatgatcaaaataaggttagttctggtcctacaactttagctttcgtgtaatttatgccctccacatcttacagtttaatgtgcatgccccggttgtaaaatcagttgtttagttgcccattattcctttttgtgatttttaggatgggcacatgcgaggctctttggtccagcaaaaagtacctggaggtatcggtagctcatgataccaaatcgttttcgatcgttggatatagttgggcatgacgagtattgttagatccaatggtcagaaatgatttggtaccgtgaggtactggtacgtcgaggtacttttttattggacggagcaaatctcatatttttgacacttgtgactatagggacaatatgaactacgtttcatttgcaccatgagtgtgtgggcagcaaaagcttcagggacttgaagtatgttgagaatataggcatataatgatttaatatattccataaataaatcatgacattacagatgtatactagcattaacgcatcattagatctacatatgtaaactaagcagtaaaacatgaacaaatcaaatatgcgcaacatgtcgaacacgtaccgaggtggcggaaagaccggttgctcggcaggaactactcgcggttgcgagcgtcgatgaaggcgcgcagcacgcgagcagagaggaaggcgagccatcgcggatgaacaaggagcagcgcgcgaagcgcttcccaaaaaccttattgccgccttctcccggtgcaggacgtcgaaggcagaggttcgggatacctgctctcccgatcgccggtgcacgctggcgagcgggatggagtagtccacgagcgacggcacaacacagaggaggaggcaatccctagattgatttcgtgtgttttgcgtgaaggcggcggctcggtttatatagagataaacccgcgtaaccgaaccggataaggcgacggttgcttgctcagtgcacccgcacgatctccactccacgtaaccgaaccggataagtcgcgcgtaacttatccggactccacgccgttttcacgcaccgaaccggattttccggactccaaaacaaaacaaatctgaattttcctgcagcaaaacaaaactgcaaaaggaggctgcatctgcgcaaaggtgaggagccaattttgcggaccattcgacgcgtacgtcgtgcacgcgcgccgcctgccaggctaggcgaggcgagcgagcgcgcgcgtgtgttccccctcttctctccaccacacatgcctcaagtggctaggagggcatcctccattttaaggaggtccccctctcctagaataagcaaggtggtactaaactccacatgcatgccatcctatgaggtgggcttttgtgattttccaaagaattaatcttcgaatgggccttagcccatctattaattccaacaatccccaaccaaatctcagaatcccactgagatttgtcttttccaatgtattgtttatataccagcggttcgatggagaccgatcaaggttgaacatccacctagatctccaagctacacttactcacaacttgaacaatggactacgccttgaattgacagtcttgtgcaagcaagtttcactcagagtcttatctggtactagaccgtctgtagtttacccctcgggtagagcatataagtcatactcctaggtctttagtaagcttcctagaagattcacccaaaatcttcatagactgcgaccaacagtcaagcttacaaaggtgagttctttcaagaatgctctgcaggacagcatcttcgctatataaagccaacagaactcattaaggcatagccaacctgccttgtagctcacgagagtacatgcatcttcacttagagagggtatagattggtactctcctctagtttactaatggtttgttcttcccaggttctaattcacaggatctccgatcacatagactgggttaccaccatagtataactcacatgggtctcaaacccatctccttcgatgcattatctatcacatttcgtgatagtcccttcgtgaaaggatctgccaggtttctagctgtttggatgtaatccaacgttataactccggagtttctcaatttcctaacagacttcaat

SEQ ID NO: 59295 - DNA, 128629 bp, Oryza sativa
  unsure (1)..(128629): unsure at all n locations
ggcaaggcggtttcggtgcagtgtatcggggctacctcagagagcttggcctcgccgtcgccataaagaggtttgccaaaaattcctctaagcaagggaggaaggagtacaagtcagagatcaaggtaataagccggctacgccaccgcaatctggtgcagctcattggctggtgccatggccgcaccgagctgctcctcgtctacgagctattccccaaccgtagcctcgacgtccatctccacggcaatggcaccttcctcacatggccaatgaggtttattaattaactcattgatttagtaattttcgttatgtgcaatcgacacctttgaaattcaactgatcagctgacttggatgttgccacaggatcaatattgttcatggactcggatctgcactactctacctacatgaggagtgggatcaatgtgtagtgcaccgtgacatcaagccgagcaacgtcatgctagatgaatccttcaacgcgaagctaggcgatttcggccttgcaaggcttattgaccatgctgttgggatacaaacaatgacccatccctcagggacgccaggctatcttgatcctgaatgcgtgatcaccggcaaagcaagcgccgagtccgatgtttatagttttggcattgttctattggaagtggcatgcgggagaagaccaattagcttacaggacacccaaaacaattgcctcttccgactggtggaatgggtgtgggatctgtacggccaaggagccgttctcaaggcagccgacgagcggctcaacaatgaatacgacacaactagcatggagtgtgtcatggccgttggactttggtgtgcacatccagaccgatgtgcacgtccgtctatcagagctgtcatggcagttctccaatccaatggaccactacccgtgttaccagctaagatgcccgtgccaacatatgcaccgccgatggcctcagcggaggggcagccctcatcatcgacacgaatgtcgtcctcaagtttgacactaacatccatcacacctcgctaggtttgcaagttttctcactcataggatttatatagcgagacaattattgtcatatatagatttttatccatacccacaagttggtttgaaggactcatcttcgttaattgctccatacaggagtattagtcatgtttagttcattttacttgttctacatttacaaattgacgcttgaatgggatatgtacagctcgtgaggcaattggtttgctctttagagagctgcctaattggcaatgtgagcaatgtgtttagtttacatgacgctttcagttttccaagcatttatttattttgtccagaaaacttttcctacacctctccaacaatccaatcaaacagtccatatctctaactgatatttgttacatacttttcttgttttcagtcgatatcctagtccttatagagggcctggaattgttggagttgtaagaaactcagaaatattaacaaaacagaaatgatcgaaggcaccaacagaagagacctcttgcatgacatgtgttcattgttgatagatctcatatgatattcagctaatgctgtccaatgactgcatagattactactgaaacattgttttgtcctaattcatccccatctctggctgagatctagaatggttagttcagtctagaagatctaaatgtgtataacatgatcacaataatcatataagtatactaaaattcagaacaatagatctcaatttgcagaatactttggatacattgctgctatgctctcgttttgtcaagcaaccagcgtaacaaagataggtgaatttgaactttcagtgcagtttcgaactggtccccttctccaatcttcattaccccgtggaagaacaaagtcttaaagtgtagttcaaagcaaaaaaggaaaggtacaagaaagcgactaggttctctacacctagtaggtgtcatgacacccaacatttacatgtgacttaaatagttattatagaaaaaattaaaaaaatttagtaacatcaattatgatgatataagtctatacacaaacatgcaagtttctatctaatctacaagtaaaaaaataaaaataataaaatttgttaattttgtttcttcatgtgtctgctggggaactcatctttagtcctggtttacaacccctttaatcacaggttacaacccgggactaaagatgcccatcattagtcccgcttgaaataacccgggactaaaaattgtagcactaccatctttagtcccggttggtgttaccaaccgggactaaagttttttttcttttttttcagtgttttttgctgtttgcatattggccttttttttcattgttttttcacagatttaatgaacatcacaaatttatagatcgaatgaacatactcaaattcacatagtgaacatcacagatcaaatggacaccacaaattcacaaaaacatctgaaaaaatgttcatctaattatttttctattttcgaaatttattttatttgttattcgaaattttaattgatcccgtcatgtgttctaaatggtcttttcttttaatagttttaattttttattatgaatttttaaattgttttcctaactgaactcttatttttcttttttttaattaaatattttattttattttttatttagaattttaattcatctcggttggtgttaccggactaaaaattgcagcgctatcccggttggtgttaccaaccgggactaaagttttttttcttttttttcattgttttttgctgtttgcatattggcctttttttcattagttttcacagattgaatgaacatcacagatcaaatggacatcacaaattcacaaaaacatctgaaaaaaatgttcatctaattatttttctattttcggaatttattttatttgttattcgaaattttaattgatctcgtcatgtgttctaaatggtctcttcttttaatagttttaattttttattactatttttaaattgtattcctaactgaactcttatttttctttttctaatttcatattttattttattttctatttagaattttaattaatctcgttttgtgttctatatggactattattttcatattccttatttatttttttcaattttagttgtttcaaaattatatcctacttgaactctcttttttatttttctaatttcagattttattttatttttagtacaaattttaattaatcacaatgtgtttttatatggacttttctttcaatattacttattttaaatcaaatttcagttatttttacattctagcccanctaactgccattaccgtgttgcttaacgacttgcccgttgttcctccccttaatcgtcgttgggattctaaaaattgaacctaatcatcttttcggttttgttaatagttttcaccagatgtcccgttaaccgtcaccaccctattgctttataggtctgttgttcctcttctctttattgtcatttgctattattgtattttttaatggactgttcttttaaaattttgtatttttttcattccttttttttgttatttgaaaattttatttctatctgaactcttatttttatttttttattctttggaacttattttattttttctgaattttagttaattaacctcatattctattctacatctactgttctctcaataatcatttttattttaaatttctgttatttctaaattgtattcttactctaactctcatttctatttatctactttcagaatttattttaatttttattccaaatttcaattaatctcatgttgtgttctagatggtctcttctttcaacaattcttattttttatactgatttttttgttatttttaaatcgtattcttacttgaactcttattttattttttataattttcaaatgtattttattttttattcttaattataattaatctcgtattatgttctaggggattactcttttagaattttttattctaaattttagttatttgtaaattttattgttacttgagctttttttttataattttgaaatttattttatttttaattcttaattataattattctcgtattatgttatgcatggactattctttcattattccttatttttttattctaaattttagttatttctaaattatatttttcaaattttagaatttattttatttttattccgaattttaattaatatctaattatgttctatatggactctttttcagtattccttattttattttgaattttagttatttttaaatatatttctacttgacccttttttctttttatctaatccacagtgagcgtggtgccttctttcgagatttgcttttatagttttgtataatacagtagacaggtagaccgtagattcaagatttgatctaatactaacaaaaacatgatcaatatttaatgagatatttttagttattatcttttctcatctatgtatgtacgtggctaccaaaaatcaggagcattcagtctgtttgtttcctagtcctttccttgcatatggccatatacgtcagttggacttgatttttttttattacccgacgataatcaagccatgcaatccggttcagagagcacttggagttggaacagaagtatatgtaagatttctttctttgtcagtccaagcaagattagtctatagtatttttccttctcttatacatacatatatccgatcaatctcgactgttaaaatctgaagctatcatgatccgatggtgtagatttctctttttcttcgattaatgtggcaatttctagccttcaaagcgaacttggtgtcttctttcaagactgtttttaataatataacttgggtttcgtttttataatttttagaagtcccatcaaacgctgtcattatactcctctacgactcgtccgctgtctcatctctttattgtcattgggattttaaaactcgaacataattatcgtttgggttcattttttttactatctagaagtcctgctaaaccatcagcggcttttccattgtacttctctacagctcgcccgctgcctcacctgttactgtcattaagatttaatcaaacataattattattggggtttactttttactttttagaagtcctgccaaccgctgtgcccgtattgcttaactgcatgttcattgtcgctattaggattctatttggggttttcttaatagtttttggatttcccatcaaccatcaccaatctactcctttatacgcatgttgcttctctcatttttactatcatttatcatttgtgttctatataaaattttttgtttgaaaattccatatttttcattccactattttttttataaattatattcctacttgaactcttataactatatttctatttttgggaatttcttttattttttatttagaattttaattaatatcgccatgcgttctagatggtcgtttctttcattagtctttatgttctattatgaattttagttatttataaattgtattcctagttgaactcttattcttttctttttctaattttagaagtcattttattttttattttaaattttaattaatcttgtattgcgttctatatggattatttttttaatatttcttattttttatttctaattttagttgttttaaaattatattcttacttgaactctcttttttatttttctaatttcgaaatttattttatgttttattccaaattttaattaatatcgtattgtgttcttgtacgaactcctttcaatatttctatattgcttatttttaattccgaattttagatatctctaaattgtattcctacatggactctctttttctttttttcgattaatgtgggaatttctagcacccacagcgaacttggtgcctcttttcaagactgttttaataatataactagttaggcggcccgcgcaattgcgtggctagcatcaatttaaaattatctattttttacacatgattttatttaaagttatcattcccgtgattctaataattttatagtttttaaaagccacaccagtctttatccattacttccttgtcacctttttatttgcttacttgatctaccactacctttactcatcttctttagaacttttaaaattagtccttatagtttttagagttcattgttttgttgggtttcgttttcataatttttagaagtatcttccaacatcgccagtttactactctacggcccgtccgctaccacctctctttattgttattgggattttaaaaatcgaacataattattgtttgtgttctttttttacattttataagtctcgccaaatcattagtgacttcgccactatactcctctacagctcacctgctccctcccatccttattgtcattgagatcttaaaaatcggatatgattattattggggtatattttcactctccttaagtcctgtcaaccgtcgtgaccatgctgcttaacggcatgcccatcgtcactcctcttaatcatcattgtgattctgtttgggattttgtttatagtttttagatatcccatcaaccgctagtactctacctattgcttctcccctttttattgtcatttgtcatcgttgtgttctagatggactttttttttaaattgcatatttttcattctgataatttttattcataaattatattcctacttgaactcttataattatttttctacttttgaaatttattttatttgttattttgaactttaattaatctcgtcatgtattctagattgtgtcttatttcaatagtatttatttttattacaaattttagtatttataaattgtattatagttgagatcttatttttctttttctatttttctgaatttattttattttttatttcgaattttaattattcttgtattgtgttatatatagactatctttttaatagttttattttccaatttcaattgtttcaaaattatattcctacttgaactctcttttttattttgatttttaattaatatcgtattggtttattatatggactcttctttcaatattgcttatttttaatttcgaatttcagttaattttaaattttattcctacgtgaactcttcttttatttttttttctaatttcggattttattttatttttattctgaattttaattaatctcgtattgagttcttatatgtactcttttttcgatattccttatttttaattccgaatttcagttatttttaaattgtattactacttggactcttctctttttttttctaatttcggattttattttatttttattccgaattttgattaatcttgtattgggtgcttatatggattcttctttcaatattgcttatttttattccaaattgtatttctacttagactcttcttttatttttttcgattaatgtgggaatttatagccccccacagcgaacgtggcgtcgccttttaaagttgttttaataatataatcgatagatagatagatttgagatcgtcaatggtaatctatagaactggctccttgtcaatgataaaaaggtaagagtttctctaaaatcattggattgttacctattttctcctttttactttacgacagttcttgaccatctatctatctcaaaacaaagtacttgacgaattatttttgaatctcacaacggtgctttctaatggtagtaaaaataaatctagctaaaccgtagattcttttctattcaagggatcagacctattcgtactaccaccatatttaatggtagtagaaacgtgcatgggaggataattttgtaaatttgcatgttagttggaaacgctcggatttttgggtcttgctgggctgagcatgcggggtagcgttacagagcgaggagtggaggtggctggtgtgctgccggcagctgatcagcagcgatagatgcgagtagtttatttctttggttggccgtctcctgcctgcggaaagaattaggactaaacattataaaatttactacaagagataaagataaaagtctgaacttgacgtgctaaactgctactgttttttaatcagcatatcagagcgaagcttctgttctcttgctcatctgcttcaattgaatcccactctaaactatgggacctctaatagagtctacactgttataattcagagaatgtgctttatgatttacatgttaatcagcgactatactacagtctgcagtgcaacagtttttatcttctacttctctgttcatatttgaaaccggacaatgaattgaaaagaaaagggaacataacggccttgtgaacgcggccaccggagccgccggcgcccggcaggacgatttgccgaccggcaacggaaggatgtgccgtcgagtagccaagcgatagatctaaatgtacaaaaactttttttttaatgaagagtggataatatcctaaataccaaccttacctttaatcactaagttagtaaagtactaaaatgtccttatgaatcaacggtttaaatcaattctactagttgtataatactacgatatagagtaccggagcatcgctctttattttttgggaatgctatggatctggaatcgcagattaggtttcatttagagcaagtttaatagtgtagccaactgctgactctaaatcatctatagtcaacttaatagtcaattcatacaatagttacctataaacatatactacacaattaatatctagtcccacctgtcatacacacatgcattttggagtccgtgctgcagctggctacaaatctgtagcccgctactcttctctcttatcttttatctcctcgaaatgtgtttatagttagcttataggctgctattgtacctgctcttatacatctatagtcaaattcatctacacacacaaaaaaaccgaccgtaaaaattatgattgaattcccagttagatttgctatatactcctacctatccatatagattttttttagagaaaaggtcacaaggacccggcctatattgaaagccaacctcgagcagagtttttgctggggttaccagctttacaaaaaggagcacagaaagcactcggagatgattacgtaccaacagacaagtgatatattaaacctctgaaacagaccgaacgccaaaaacattgcatggggctagcaagatcaaccaactcctattctattttgtcttagagcaggtcctccctccttcaacctctttaccggccagcttctctagatcactcttattcatctccagccgatgcaaagtgttgaatagtctttatattgattgtggaaggacaaatgacataagatataagtggaagagcccctcacctcaaggctagcttttgtgatgggaaagactatttacgatcctacgcaaagaactccacggcaataagaaagagacaatttggaaaggtagatacgatgttgtttctcgttgttcatatatagagtccagcaaatggttaaattcagctctaatgtcagcaaggataaagaagtcatcaaaagctctaatgtcagcacggataaagaagtcatcaaagttaagaggaacataatcccagttgagcacatctctacataaacaccaaacaaccagttcagcacatctctacataaacaccgaacaaaatacgccaaagggcagctaaagattatgtacatctctacagaaacaccaaacaaaatgcgccaaagggcagctaaaaattatgtacatctccacagaaacaccaaacaaaatgcgccaaaggacagctaaagaatatgtggtttgtagtttctagatggacagtggagaaaaaaattctaattttaaaatcagtaacaccaaacaaaatgcgcctaaggtcagctaaagattatgttgtttgtagtttctagatggacagtggagaaaaaaaatctaattttaaaatcagtaactagagggtgagcgtgtacggtacggtgttaacacgggccacggccggcggggagcacaaaagttacagtctctatatttattttagtgctagagaagacacatatagtaaggccctgtttagattctaacttttttacttcaaacttttaacttttttgtcacattcaactttcctacacacataaactttcaacttttccgtcacatcgttctaatttctttaaacttctaattttaacgtggaactaaatacagcctaatatatgctactccctccgtcccaaaatataaatatttttaaacttcgacacggtcttcgagatactactttgacaaataatatctatgttttaactaaaaagagttgtatattatgataatttgtttaatgatcagtctagtaacatcaaattgacatgatcaatcttttttcttttgctattaatagtcaaaatttaaaaggtttgacatcacattactctaaaaatatttatattttgggagggagggagtatcaatcatttgaagagttcagtgacattgtaccctaaggacgaaacgaatactggtttgacttactcttgtttcgtcgtcacgcgccaggccgagaacgggtccaatggaggatacctcaaatacagactcagactggcagtataggaagttgtgtcgttgctcctccagctggagaagccgatcagtacacagtactagtatcacagtactgtatcagtatcaccttgcacacgatctatcgacgctggatcgccgacggcgatggccggcttttcgttgaccacttgtgctaccggcctcgtcatcttcttctccgtctgctacctgcagcctccggctcctgtcgccgccttgtccttcaactactccaacttcagctcaaacaaccagaacatcgaaattgaaggcaaagcctccatccgcgtcgggtatattgacatcagcgcgaacgacgctcgggacattttcaccagcgcgggacgggtatcctacaagacaccggtgcagctctgggacgccgccaccggcgaggtggccagcttcaccacaaccttctccttcaacatcgtcaccccgagcgataggaacaacaggggcgacgggatggccttcttcctcggcagctacccatcgaggttgccaaagaatgcctccagtagtggactcggcctcaccaacaagtcctacaccaacgtctccaccggcgaggaccggttcgtcgccgtcgaattcgacacttatctaaaccgcgacttcgaccccaacgcaacctacgaccacatcggcatcgacgtcaactccatcgtatctgtgacgaacgagtccctaccagacttcagcctcaacgggagcatgaccgccaccgtcgactacaacagcagttcgagcatcctgtcagtaaagctgtggataaatgacacaacgaagccgccttacaacctaagcgacaaggttgatctcaagagcgccttgccagagaaggtcaccatcggcttctcggcggcaacgggcgcatcagttgagctacaccagctgacttcttggtacttcaactcgagcccgtcgttcgagcataagcatgcacgtgccggagttgaagcgggagcaaccgtcggggcgacgttgttcgttgtgctgctcttcactgttgcagctatcctcatacggcgacgtcgaatcaaaaacaggaaagaggcagaggatgagcaggacataagctcggacagcttagacgacgacggcgagcccatcgtggagatcgagatggggactgggccaagacggttcccatactatgagctcgttgaggccaccaagagcttcgcggcggaagagaagctcgggcaaggcggctttggcgcggtgtaccgaggctacctgagagaacagggcctcgccgtcgccattaaacgcttcgccaaagattcctccaagcaagggaggaaggagtataagtcggagatcaaggtgataagccgactacgccaccgcaatctcgtgcagctcataggctggtgccatggccgcgatgaactcctgcttatttacgagcttgtccccaaccgtagtcttgacatccatctccacggcaatggcaccttcctcacatggccaatgaggttatcaaccctcgctagttctatctcaatctttgtgaccgtattaattaacatatattgttaaattaaacttaatagattagctaacttattttttacagggtcaagattgttcttgggattggatcagccctcttctaccttcatgaggagtgggggcaatgtgttgtgcaccgtgatatcaagccgagcaatgtcatgcttgacgagttcttcaatgccaagctaggcgactttgggctcgcaaggttcattgaccacactgtggggatgcggacaatgactgcagtgtccgggacaccaggctatgttgaccctgaatgcttgatcaccggcagagcaagcgtaaagtctgacgtttatagctttggcatcgtcctgctagaggtggcatgcgggaggaaaccgatgagcctactagacagccaaacggatggcgtctttcggctggtcgagtgggcttgggatctgtatggcaagggagatgttctcaaggttgtcgacgtgcgtctcaacgatgactacgatgttacagagatggagcgtgtcatcgttctcgggctctggtgcgcgcaccctgatccgagcgcgcgaccttctattagagacgccatggccatactccaatcgagtggaggctagctgccggtgctaccggccaagatgcccgtgccgacgtacgcgccgccggtgatctcattggatgggctctttgcgtcatctacagggttgtcgtcgtcctcaggtgtgacgcagtcctcgtccacatcgacgacgagtggccatgctactcacacctcgtgttcgtcggttccgtccgattcaaccggtttgaaggactcgtcttcattgctcaagcatcagtcctagcgtttagtttttgttttttttaatttgtttgttcttagtttagagtttacggttgaatggtccgttgatttggtctttagtgttgcctaattgccgatgtgagtaatgtatgtgtatttacgcgatggtttgaacttcctttttcaaaaaaactagctggtggcccgcgcaattgcgcggctagcacccatataaaattatctattttttacgtatggttttacttaaatttgttaaataactatctcgttatgttagaactttgaaagactgactttatcatgccggtgtttttaatagtcacgccaatcactacgccttatttctttgtcatcgctttatttgcttgctcaatctaccactgttttcattcattctttttggaacctttacaaatttgaccttgtggttttagagttcattgtatcgttgggtttcgtttttataatttttagaagtctcgccaaacgccgccactgtactcctctatggttcgcccgctgcttcccatttttattatcgttgagatttaaaaatcgaacatgattatgattgaagttttttttactttctagaaatcccgccaatcgtcgagacagtgctgcttaacgacctgctcatcgtccctcctcttaattatcattgaaattctatgtgaggttttgtttatagtttttagatatcccatctacctacaccactctatttttttgtgggtctattaattctctcatctttattataatttgtcattgttgtgttctgtgtggactattttttcaaaaatcaatatttctcattgtgatatttctttcatttataaattgtattcctacttgaactcttataattattatttttatttactttaccaccctcggcatgccctcctatggcaattgcctcctatctcatttatttgcgtacgctcgcctgcccattgcttctcttctttgtcatctctcactacaccggtaagactaaaaaatcaatccatattattgatatgatttcattttttataatttttttagaattcctgtaagccgtcgttgcatgccgccttatttgccgtcccttggcaatatgtttgttttcttttgattaaatgtggcatttttagtcctgcaaatgtgaattaattcttagatagaatatggtcaagaattgatgatcgaacattggcaggctgccaaatactgaccttgatcttgatgtcttgataatttctatacctcattatgtaatatttgaaatttatagtattctttaaccacaaaattatctcaaaaaaagaaaaattgggaatatatttttgtctttcaatctacgaccaacaaaacaattaaacttcttacttaacaaaattttgatcatactaaacttgcctttaaatgacatcgtgtgcgtgcgcgtggctgactaaatcacccgctgctgctgtgcaaggaaagggtgcattggttggcagagtgagtttgattgttagctgacacgtctatgcggtaagtgccaaggaaacatattgattttcctttttttttataagtttctggaaacaaaagaaacgttgactcagccctctgtccggttgggccattacagtccgaatagaatttttgttttgctgtatagtattttttttttacatagtttgagtaggatttgtcatgtatcctttcttacttatactattctgatcaatctcaacggttaaaatataaatctatcatgatctagcggtgtagattttttctttttcttcgattaatgtgataatttctagcctccacagcgaacgtggtgtcttttttttgagctgtcttaataatataatagatagataatgaaggcaagaagattgccttatatatactgattgatacggcagggatttgaactttactgccgttataatttgtctacaaagaattgtccagccattttctgttccagcagcagcggaagtcgagtgagggagacgggcagagatagtggctgcagcagcattaagggtgcgtttggttgctcgtattctcttagtctggctcatctcttctatccaggctgagtttggtctggctaaaaggatacatatgcagctgtttgattacccgcatccgatgaacctggatatgctgagatgatgtttggttggttgcagcaaaggattggtggaatggttgcatgcaggagatgttgtttggttggatggatacatcttaggtgtaaataccctctcttgtgagtggtgaggttaccctcataaagtttacatctgtgtagtgaggttactccgtgaggttgtgttaaaattttatttggtctttggctactattatttgtgagctaaattacttagaatattggcatacacgtctattttcttcggttggtaatttttgtaagaatcggtaagcagcattgaggaaacaaacgtgcatacaggaagttgttcacaaggaacagatcaaacattttggtatttgagtatataaaattacatcgatgttatacaaaactgaaccaattgttatacaagtacatacttattacaatccttttacagacatctttaaactcaacagccttatatatctgcaatctggtaaaatgacaagtgtatataagtatgttcttatgcatcacagctcagtactactagaatggtattgcctagaaaattaaatatcaaacaacacaggaggtcaaacaaaaggaataagcctaatttctgatattgcaatgctctgctttctgaaatttgtcctatgaacccaaaaaaaaaaagatatacatgctctaaacagaaatgctatgatgggaaaattgatcatgcttagtattttctgctgcttcctgctagcctccttttttgctggttgtttcttccagatggaactgggaaatcaaatggcagccacaacgactgagtatggagctgtcatctccaagtggccattttcagttccatgtacttacctttgttcttccaagcttgactaaattagtcagtggatgtcaacatctgattatattacaaagactgaaatgtaacttatgcagagatttagaagtatatgcttaacagcatagccaatccatggaccttgtactccgtaattcatataaaagataattggaccaagaaacataaacacaacatcctaaggagcacaacctgagtatgtatgtatacatccagtggcataccatcatcgaccatggatatttactcagacaaaacacaatcggcaaaataaggtgcacagccaaaagtgtaacacaacagcacaccataaaaaacaaataagcacccaaagtttgctctgacattgaactaatattaatctgtatgaaactgaaaaaacagtagatctgaaagaaaatgaacagctaaaaaggataccaacaatacacgttgacattgaactaatattcatctagccattgacacggtttcaatatttaaatctaccaaagtcaactaggaaaatgtataagcttttactagatctagcagatttatgaaggccccatactctcatccactcaaataacagcaaatcaaccaaatagagaagaaaaaactggggaaggagggacagggaagaggatgcccaaccttgcaatgggcgatggatagccatcaatgcacttaccctgctgctcgacagagagtgacagtggaacaacaggcacgacggagagaactggcaaacgaggggaaggaccgacgcgggggcaggaagtgagacgacctcggaacagatgaaggagagccagaatcgggggagagggctgccgcttatggccggagtgacgagaagagcagcgccgcgccgctgccaaagcctaggttgaaccctagttttttttcacgagagggagaagtgaggcagggagggagcgattctggggaagcagtggtgaccccatcccgcgagttgcacgcgtgggtgcaggcgcgggtgaagcggtgcacatcggtcgagccaggccaagcagcgaagtgggaattgaccgtttctgccgtgcctggctgagggggtatttttgcatccgcatggacaggctgggaggcccgagcaggcaaccaaaacaccacgaatttgcatggaccggtgcgggccaaccttggtgcaggcaaccaaacagaccctgaacgttcggccaagaggattactggaagcgaattaaacgatcggcccattacaattgaagaggtggccgccatcctcttcatgggccatggcctacagaatgaagttgggctgggccacaaccgctaggaaaagcctgatctacatgcctacccccaatggaaataagtccacttgatgttctcatctttccaataaatatggacatccaacgtgcaaagccgggttaaattaggttttttggcagcatagatggctggtttaactgacaaatataaaatgttcaaagctaatctaaggctataaatagacacctccaagagaaaatatatgtaagtgagagtttttaaggattaataaatatatttactttctttgtgtacacttataaatgcactgttgtcttcttagacaacaccatgaaaacttaaaatctggaccccgatccatgtacaatattttatttttatcaatcctaaattcagaaatcctttatcaagaaaaatactaaaagtaagacaccataacaagtacaactcagtattattaatttaaagcttcatattatttaataaaaaacatttatattccgtaatttcgaagtgtgtattaacataaggaaatagaaagtaagggataaaaagtattatattttattctatatacctatgatattgtaattaccaatttcaaaaattcgaaactatcggtttcattattgagcacttaaaagcaaaatacacacacttatgcagaacatacatatcagaagcccagcgaaacttttttatctttattcccggtaggtaacaccaaccgggactaaagattatttttattcccggtttgtcttttgtcaggccgcccaggatctttaatcctggttagtaacacagcactttaatcctagttggtacaaccgagactaaaattgaaaaaagcgcacggggagggagagagccgcatcgcgtcttaattatctctgatgtctctctttctctccctcgtccttatcttcttcttctcctaccccgtgtcgcgtcttatctccgtcgcatcctcctatcctctcctccacccccctcctcccctctcacctaggcgaggcgtggagatcggagcatggagtcggaggtggtgaagacggagatggctatgagcccgtgacgttgcgcggtggcctcatcgtcctccgtcacgcgcgggtgagcgacgacgacagcggtggccggcggcaggcggcgccctccgacctctgtgtctgcgaccctgtcgccagccgctgcttcttcctcccgcacctcgggatttcccaccgagcagcttcatccgcggacctcagctgctgcgtcttggctctctgcctcgactggtcatcgctgccggcgtagatcaagttccccctccttcccacctcatcgccaagccgagcgtggagattctcctcgtgtcgccgccgtcgccggccgacagtacgtgttggtatttcttaacgacattactagaaatataattcccagcaatggtgccagaaatagtcatggtatattatgattacagagtttatccgcaagcgcacggatataccattgtagcattttcacccgagagtattccaagggtatcgtatttgtttatcccgtgggaagattataatagagagaaccaaactaatatttatatgttacttgtattaatgatgtctaagcagggataaatataattgcagggtagaatgacacacaagcataagctactcatttttatattaaacctcctaagctaagtggaaagaatatagaaaagaatatattcctatacttctagtatacatcctaggtatatgattaactagctaatacctcctttccgatgccctcgtggtactttgagaagccacccttgactgccgagttccttacgacagctcgtcatgactatacaactggggctaaatacggaggagtaccctccccaaggaattaacttaggactatatacacgtgcggacgaatacccatactgagctgtcgccatcagcggcccacctctcatccgcagcatataaccccaaataatgatacccagtaatctagacaccacgcctaaacttccagatactactctaatatcatcgtcatgacatagaataattgcatatgcaaacattatacccgtaccaatgcatctcccagataagctagcagtataatcataatatctcggacatattgtaaagctggtagtcatataataggagagtattacaatactagagtcgtatacaaaagtatattctaaattaaatactagtcttacaaaagagaaagtaaagctgctagagccatacccgaactcttccgaagacttttggattccgactactattctattcctactccactagcttgagagcactaaactaacttgagagaatatgagatctttgttgcttgaagtgtgtgagagggtgaggagtttatatagccaaccaatgacggttgtgacggttggaatggtcggaaataccctccaaccgtcattgggggctaatctaagccgttccccaaaagccctgcatccaacgacgatgaggagggttcggccgaacctcgggctagcccaaccagcccactttttgcctggcggcttccctgacttcttctctctgcagatttgtgaattttgggctttttgggtcttctgaaattgatattttcagcccatcttcctttaagtctgattctcggcatcgtctgattgatcgatcgagtgttttgatgccgattcttctccatttattgcttattctctgcaagaggttagtaaaccaagtactagtggattttattttattctaacactatatgcattgcaagcatgactagctctccttttattccggtaatattgacgggcgaaactgatcgataacgaccatcaacaaaacaccccaagcttgaacctttgctcgtcccgagtaaaggacgaaaggaaacaaaacttggttattgatcaggagttgctactatgctgtatattctcaaatgtacaagtgcaaggtatatgtactctctctcaaatcaaataattttatcacgtggcttacccttacacctgattcccgcgagacattgctttaccttgccctgagcggttgaaagacagaacagcaatgatgagcactagtcacccaatctttattcaactttttattccgaaagttttcaaatgatttttcaaaagaaatctaagttcctcaaatgatcctctcgatcactcaaagtgtataaatatgaattcctcaccaaagtaaccttgttgattcctactctaaggtttagtatgtggagcttggtagggatcaaacatggcatacctgtattcacatttattattaagtcaaaaacttagactagagcatatgactagacatactcaagatcaagatcgtacataaagtgtgtgatatatggtggaaatggaatgtgaaaaaataaagaaaatacttctactttgtgctttctttcttctctaaaaaatccttcatttctttttaggagggggcatggctatattttttttatcatgctcaatattttgaggagcaagaatttattttcataaccatgtctttccctcttttctttctttttggaaaggatattattttgggaggagaaagcatataattagagagctttatttgggtggtaacatgatagatataaatggaatggatggatgctaacttctagtgcaaaagttcgcatgtgcatatatgtgggtgtatgatcttgatcatagagcatgaaaagtatctacacaagtctcaaaaatttgacaaagttcaatggaagtacaagtgccaaaaatatatatggtttgtcaatatgaatatttttggctctggtaggaatttatatcaaatgatgaacttctaagtttatcattttagaaaataaaacatccaaaatttaagtcaaacttagaacaggatcatagcagctcttatcactatctcatatctcacaacaacctagacttagttcagcaagtgcagcccacttacctcaggttcccggataatatgtggccacttttatttaatctttgagatattacttaaccgtgaatccatatataagagatataaaacagtgcaactattcatcatttcaatcaagagaactacttgtcttacctagcataataaaatctaacctatatttttggtattttctattttgcaaatttttatgtcattttttttggtttataggatgcaatgtggaaatgtaaatatgcaatggaaaaggaaaatatgcaatgtgatacaagttacctcagtggggggagatgtctccccccaagcttatctttcgctcagggtccctggtagggattgaacccttggaagcgaaggtacgcttgaagatcagcctgctgttgttgcatcagattgttgatgttaacgaactgagcattagcattttcctaccattcttgcgtctgaacgatgtgtccatcgaggtagtactggatctctcctgtctgcatatcaagggtgtctagcctcctcgtgatttcacccaagtcctgggaggaacttgagcgccaacagttggaggcgggaggcatcccgcttgatccagaggaacaggtgtgcgcgttcccccagtgtacttcacgcggtgcttgccagcggttctcactggcactgtgctaggacgaacctcctgtgttgtgtcgtggtgcttgggtccaaccgggtgcatcccccgttggttcccagtccgcctcgtacatctgcatgggtgttgatgatgatgactcctcgtgtttttgccttggtttgttgcgtgtttccctgtaggatgtacctgcacgagattcttctatggtctgcaggggaatggttagttcctgacagttgtacaaatgataccccgcattgggtaacgggatttcatttgtacaggggaaaaagtatatcaaagagccatcggctccatgcttaagtatatgcccttgcattaaatatgtttcatccacatagggatggacagtgaagatatactcgatttgatcagtggtgataactccatgtccgttcgctatgcgggtgatcaaggaagtgcactcaacaggggcattatacttaatactttctaaccattgcctaatcatatatttaacaggagcaactttagtcttcctaaccttggcaaacatgataatcaactcatctccccgaatgggtctaagatcacctcaaggaaacaaagtcatagcaatccatttgtgcataagcctaagtgtaggattatggatgtcatttgtcctaggttttctgcaagttggagcaccagaaatgtcttcccaaaatctgtttttctcgaacccggaaattcctttccgaagatcgattttacagttatcgtgaaaaccaagaagtgtgcttaatcctttccatgaaagtgtatactccttatggaaaaaacaaaaggatatgctatcttctgtttctttcaaagtgcacagaaattgtatagtaagcaaacgagaacctggctcatctactactacaaatctctgctaacagcgtgaaaatcaacatccatacctgtttttcttagaagttctggatcatacgccctggtgtggccgaactcccggtccttcagcatgtggtaggcttgtagctcccgatcaccaacaatgtcgaggtcggtgtcggtgttaaggaccaaatttggtaaatcatggatcggagatagagattaaaaccgaagcggaatcgaaggaggttgatggtttcggaaacagagtgcgcatcggctggagatcgaatcggctaaggtatgcatcggcagagttcgagtcggacaaggtagccgatgaagtcgattccgacaagatggcattgcaatcattgtcggatcgggttgatatgcttcatgaggattgccacgtgcgtattgagtctgaaaaaagcaattgtatctattaattagatattttatgtaatttacttacagtttgagttggtaagagtctgccttagggacttgttcgtatcctaagttgtaatagagttaggagtcgtgtctgacaagggcatattatgtactttgggttgggtataaaagtagcccaacccgtgttgggctgcttcgccaacctttcactttcgtttactttcgacgagttcttgctttcgagttgggctgcatcggttcgatctccgatgataaggtaaaacttgttatggcggcttgtgttctcgggattagtgctttcatctcaatgatactttaatcttgtttatgtaagttgtcaatttatcatatttcctatataatctagatcaatattgctatctaacctagaattggcaaacatctcttgttggaaggcaaccgatagggttaaataccaacgttgacttagattatatagtatatccaccatcctaggaatcaatcaatgacttgattatctagatattgttcttcttttcatactcattgctgcattagttaagtttgagcttataagttgtgattagaatagtaatctctagcctgtttattgattgccgattagggtttcatcggagtttcaaccgatcttacctgatttggttattttgtctactttatgtttacttaatatgctaagtctgccctttatattaagatctcactctaattaaatatattaagcacgttattaatctgttaagtcatcttaatacttgattgatctctgtttaatatattttgtctatattgatatctcagtataaagtggtatcggagtattagccgatacatgtcagatctgcaacatcggctatgctataaacatatataatctttatattgaagtacttttagacataagtgatttatactgtctcgacaagttgtccgatctatcccagtcacatggtttcaacatattttgatatactgattatatgttgttaatatctacagccgatcgactagatctaaccgtccttttttctttacatatcattaccgatctaattcacgttacatcggctagattacaaacgatacgtcatcggcacatggccgatcggctatcgtttatgaatttaactgtgtttctttctttgtttcttgttggttgcaggatcaaaccaactagcatgcctttgaactcgaaaccaagatttggacctgcactagagttaagcagatctctcaggccagtgtgtgtttttcgcatcaacatgcttttggcacgcccggtgggacacgagtgtgacaagcttccatcatggtggacatcaagtctaccgaggtggatccagacaatgtgattccaataaccatggacatgctaacatcagaacagaagcaagggtttgaagggatgataaatcaactgcaaaatcggtacttacattcatttgttctgactcgttcgggtacagtaattcaaagacacaaggtggatttgccaccggttgatgagaagcctgagtcaagctctgctaatgatgataaacttaaggaagtcaaagctgaaggactcaaacgggaggatgatggtgctccagagttcaacaatctacaagatcgatcagtgtggtcgtgacactgaaaattttgatttaaaatttgattccattttgctctgaaaaattcaatttgaataattgccacaaaattcaaacctaaatgcaatttctttaaaaaaattcaaacatgctttgttgcagaaatcaaattgatgaaaacaaatatgaggatacataccaatttacctattggcgagggcggcgtcgcttcaagtccgacgtgcaagaccgtacctccgacgttcatttcacggatttttcacccgtctccggaggtgatggagtgggcgttttctgcttcgcacgccataccttctttgttcttggtatgggcggcggcttcttctgagccagcttttcttccttcttggccggtgtcttgggttttaccggcgttttccaataacgggacctcatcctggatggttgaatttctagagatttcttcataaacacgatgaggctatccattttgggtggctccacttcgaccgtctgaatgttctacggggctggcccgtactttattcggaacatggagcattgttccgtccttggctggaactcgaacttctcctccttcccgttgatgcggaaacggatacttcccgttccgacatcaatgtttgcttccgcagtgctcaggaacggacgccccaggatgagcggtgtctccttgccagtgtctatgtctagcaccacgaagtcgaccgggataaagcaatctcgtatcttgaccggtacgtcttccgctatcccagctaggtagtgaaccgatgagtcagccaattgaaggcgcatcggtgttggtgtcaacaccgtgaagttgagcttgtcaaagacatccttgggcatgacacttacacttgccccaagatcgcagagcgccaggtcgaatttctatgtcccaattgagcaagtaattgtgggacacctcggatccttcggatccttcttcttctccgggagtttgtggaggatcacgttgctgcattcctccgtcagcttgaccacctcggttgttggtagtggtcgcttgttgttgaggatgtccttgagataacgtgcgtacgttggcacttgcatagcatccaacaacggcatgttgatgtggattttctagatcacctcaacgaatcgagcgaactattcgtcaactgacggtttcctgatcctctatgggaatggcagcaacctcgcgttgcagtagtcttgcggcacggtcttctctggctgaatttcttcttcagccgttgtgttggatggtgcttcccgcgtgttgcttgtacctgcagtgttaggatatggcggatcgcgagtggacttacctcccctcgtcgtgatcaccttaacattttcaatggagggtttgggttgccccgggatccttccagtttcatttgcaagtactagagcggcaagttgcgccaactgggtttcaatcatcttattgaaactcaactggttttgaaatgcggaagcaaagccatctagtttcacatttatattttctaagatcttgtcattggcagccatctttttgttgagtgcgtcggtagttttggcttgcgcaaagacaagatcctttaaggaagacagattagaaaagctaccttggttattgcctccttggaaatacggacggggatggtttcacccctgacctccttgtgggtgatacccattgttgttattgttgttgttacccatgtacatcacctcctcatgggttttcgggcagtcgttcccagagtgacccgtgttgccacagacttcacacgtaacgtgtgagtccaaggccttgacggtgccttggggcttcttctcgtgttcgtccaatctcttcatgaggaggtcgagttttgcagtgaacatttccgtctccttgacggtgtgcattccttgctgatgggactagagtcgtacctcgctccaccccatattagagaccattttctctatcagatcgacggcccctctgaccgtcttagagaaaaaggctcctccagctgccgcgtctaggtggtcacgggacgtgggagtgagtccattataaaagttctacaggatcagccagtcgtccatctcatgatgaggacaggcggccacgtactcctgcagacgttcccatgcctctggaatggactcatcacgtgtctgctggaagctcgaaattctcccacgaagggcatttgtcttgcccatcggaaagaacttcgacaagaatactatcgagcatttgtcccaggtattgatcacggcacgattggcataaaaccactgcttcgctttcccgaggagggaaaacggaaacagccgcagcctgacgacgtcaggactgacgccctttacggtgtacgtgctgcagatctccaggaaccattgcatatgtgcattagcatcctcgttaggcttgccgcagaatgggctagcctgcgccatcgtaatgaggctggatttcaggtcaaagtccacgtctcccatgttgagttgcggcccagtggccacgttctcagaggagggagcagcgaactcgcggagggtcttgtcagccatagtcttgaaagttggtggcgctggtacggctggcttctttgtcggaagagtcttctgcgggggaacaacccgcggctttacgcttcggaagaagacttctggattttcttgaaaattttccggcaagtcgaaacctgtcatgcactaccctgttttcacaacaaaaggtgaaaacaacatggttagcctgcaaagcacagtgattatatagaggtaaatataagatattagttttagtaatctctttttacaaatcttccccgggaacggcgctagaaatgcttgttggtatttcttaacgacattactagaaatataattcccagcaatggcgccaaaaatagtcatggtatattatggttacagagtttatccacaagcgcatggatataccattgtagcatttcacccgagagtattccaagggtatcatatttgtttatcccatgggaagattataatagagagaaccaaactaatatttatatgttacttgtattaatcatgtctaagcaggggtaaatataattgcagggtagaatgacacacaagcataagctactcattcttatattaaatctcctaagctaagtggaaagagtatagaaaagaatctatttctatacttctagtatacatattatacatacatcctaggtatatgattaactagctaataccccctttccgatgccctcctggtactttgagaagccacccctgacagctgagttccttacgacagcccgtcataaccattcaaccagggctaaatacggaggagtaccctccccagggaattaacttaggactatatacacgcgcggaggaatacccatactgagctgtcgccatcagcggcccacctctcatccgcagcatataaccccaaataatgataccgagtaatctagataccatgcctaaactaccagatactactctagtatcatcgtcatgacatagagtaatttcatatgcaaacattatacccgtaccaatgcatctcccagataagctagcagtataatcataatatctcagacattgtaaagcttgtattcatataattggagagtattacaataccagagtcgtatacaaaagtatattctaaattaaatactagtcttacaaaagaagaaagtaaagctactagagccatacccgaactcttccgaagacttccggactttgactacaattttattccgactccactagcttgagagcactaaactaacttgagagaatatgagagctttgttgcttgaagtgtgtggagaaagtgagagggtgaggggtttatatagcctcccaatgacgattgtgatggttggaatggtcggaaataccctccaaccatcattgggggctaatctaagttgttcccccaaagcgctgcatccaacggcgatgaggagggttacctcaggccggcccaaccagcccaccttttatcctgcggcctccctgacttcatctctccgcagacttatgaattttgggcattttgggtcttctgaaattgatattttcagcccatcttcctttaagtctgattctcggcatcgtctgattgatcgatcgagtgttttgatgcctattcttctccatttattgcttattctctacaagaggttagtaaaccaagtaatagtggattttattttattctaacactatatgcattgtaagcatgactagttctccttttattccggtaatattgacgggcgaaattgatcgataacgaccgtcaacagcgggcggcgccagaggagatgttgccgccattgacggcggacgatttgtgattttgtggttttttagatgatttgtgaatttgtggatgattttgttgtttagtatgttcattcgatctgtgacgtcaatttgatgtggggatttgggaatgtcggcaattagcaaaataaaaaacaatgaaaaaaagaaaaagagaagacctttagtcctggttggtgaatctttagtcccagttatttcaaccgagacaaaagatagatatctttagtcctgctttcagagtcccagtttgtaacccgggactaaagaggttgtaaaccgggagcaaagagggtatacccaacagtgtatagtactaaccagtgggtttagttaagttgcccgcatctctttcgataaaactgacatccagaaagtaaggcaagtgggggtaagcgtaagccaaaaacaagttacgtcaaagaaccaaagaagcacggcggtatcttcttctgttcacgcacatgcatttatgcatttccaactcgaatgtgtgccagtgccactcgcatatatcaaatcaacatattggctcgtccctccaattcgagacaatactacaacatctagaaaacaactttaaacattattttttattataatatatatgaaaacaataacaaataaatgatattattaaaatactttttaagactactctatacatataatctccatatttctaagataaatattttagaaattattatagataaagattttaaagtttgatcttatattctcatttgtgttcaaaacgaccagtattatttgtccggatgagtagtataattacttttagagtttaaatttatcttaaaaaatatagttatttcttctttatcttctcattacagtgaataataacaatctctcattgaatttctatacctactttctatttttaacaaatcataaacttctaaaatttatacacctattttctatttttaaccaatcaaaaccttccaatttaaaagtatttaagaatacttaaattttagtactgaggggagtagtctggtacccacactacctgcatgaaaataataataataaaaaactgatgccaccacactaccacagcaagtctggtacccacgctaccaactttctctaacttctactctctcgttttttatgcacatgttttccaaactgctaaacggtgtgtgttttataaaagttttctatagaaaagttacattaaaaaaatcatattaatttatttttcaagtttttaagactaatacttaattaatcacgtgctaatggacaaccccattttccgtggaattcaacctcccgaacgtagccctagttaacataccatcaagatttcagatcatctatctttggatatttgatcaagtaagaggagcagctaaattttataattttttttataaaatttggtgaaaaaagacgaaaaatttgcactcaatctgcagggcctatgccaatgtccaaagcttcacctttttttttataaaccagcttgatgttttatcattcttgaaaatgtatcagaagaaaattgaagataccaacaagaaacgaaacttactcttaacttcatttaaaattattaggaaaatatacaaaatatgatacagcactttccgaggaaccagagttgtcagagtcatggtctcatggagcctaattgatttgccaaccaccaaggcaccaacttgttaaattagtagagttcttctcactacgctaactcgctatgtccttaagatcttgactggtctctccgagtggcgacctgctgattcttcgagtagtagttttcgtattggcagtattgtccggccgctgattctgctcaaagaccggccatggccgccggcgtcctcatgacaaaaccgttcatggctgccgcttctgctctagcctgcttgctcgtcatgctgcgctgcttgcctagcgtcgtcgctaccacggtatctttcaactactccaccttcagcaacgcgaagaacatcaccctccagggcagcgcggcgttcgccggcggggggtgcatcgagatcaccaccggaagcaacctgccgagcagcggcaccatgggacgcgtggcgtacacgccgccggtgcagctctgggacgccgccaccggcgaggttgccagcttcaccacgcgcttctccttcaacatcactccgacgaatttggacaacaagggcgacgggatggccttcttcctcgtcggctacccgtcaaggatgccggacaagggcgacggtggcgccctcggcctcaccagccggtactttgacaccgtccagcccggcgagaaccggttcgtcgccgtcgaattcgacacttatctaaaccgcgacttcgaccccaacgcaacctacgaccacatcggcatcgacgtcaactccatcagatcggtgcagaccgagtcgctgcccagcttcagcctcaccgggaacatgaccgccattgtcgactacaacagcagctcgagcatcctgtcggcccagctggtgaagacatggacgaatggctcgactacactttacaaccttagcaccaccgtcgatctcaagagcgccttgccggagaaggtctccgtcggcatcttggcggcgacgggcttatcccttgagctccatcagctgcattcttggtacttcaactcctcgttccagcagaatccaccaccggcggtgcaacattccccgaccacctcaggttccggacttgccggagttatagctggagccaccgttggtgcagcactgttcgtcgtgctcctctttgccatggtagttgtccttgtgcggcgacgtcggagcaagaagagaagggaggtagaagaggcagaggaggcgagacacgtagggttggccagagatgacgatgatgacgatgacggtgagcccatcgtggagatcgagatgggcatggggccaaggcaaatcccataccaagacctcatcgaggcgacgaacagctttgcggcggaggagaagcttgggcaaggcggcttcggtgccgtgtacaggggatacctgagagagcagggcctcgccgtcgccattaagaggtttgctaaggattcctccaagcaagggaagaaagagtataggtcggagatcaaggtgataagccggttgcgccaccgcaatctggtgcagctcattggctggtgccatggccgcgacgagctcctactcatctatgaactcgtccccaaccgcagcctcgacattcacctccatggcaatggcaccttcctaacatggccgatgaggttagtacctgttctctttaacttcatctaaacttcctttgtgatgttaaattaattggcgtgttaaactcagctaacttggtcttaacttgtcacagggttaagattgttcttgggcttggatcagcactattctatctccatgaggagtgggaacagtgtgtcgtgcaccgtgacatcaagccgagcaatgtcatgctggatgagtaattcaatgccaagctaggcgacttcgggcttgcaaggttcatcgaccatgccgtggggatgcagacgatgaccgccgtctctgggacaccaggctatgttgatcctgaatgcgtgatcaccggtagagcaagcttagagtctgatgtttatagcttcggcattgtcttattggaagtggcatgcggaaggaggccaatgagcctacaagataaccagaagaatggcatcttccggttggtcgagtgggcctgggacctgtacggacaaggagatgttgtctcagcggctgatgagcggctcaacggtgattacgacgtgtcagagatggagcgtgtcatcgttgtggggctttggtgtgcgcatccagacccaagcgcatgaccatctatccgagcagccatggccatgctccagtctagtgggcaattaccggtgttacctgctaagatgcctgtgccaacatatgcgccgccagtggcctcagtggaggggctcttcacatcgtccactggaatgtcgtcctcaagtgcagcacaatcatcatcgacgaccagtggctacatcactcacacctcgagttcctctaacacatccacttcagctggttcaaaggactcgtcttcgttgctcaaacatcaatacttatgatgttcaattcatttgctttgttactaattttgacttgatgcttgaatgggatgtacaactcgtgagccattgattttccatttagagtagtctaattgccaatgtgagtaatgcatgtgcatttatgccatgatttaaattttactcccattttagtttttctagatagatttatcctgccattttctcttcaatgtctgactactataaagtgcataccttgcatgttttaagtgaatatcctagtccttagagggctgaattgtcgaagttggaagaactttaaaatgaaaaaaaaaaccaccaagagaagagaactcttacatacttcacatagtttgcatgttttcacttttcagtgaataacgcaaaggtgtaaacaacatgaactaaatataataagctaaattcaatagagatggaacatggcctctacagactatagacaatagtacaaagactgcttattttcagtagttcttatgcaattgtctcaaatcgtggatatttatgttggatacttcggtggtggaatcaagaacatccaagcaaaattgttaacactacaaaatagtaccagcatagtagttcactcactatgacctgtagattttcagctggttgttttgccctgtttttcagcttttcaaccaaaaggttgttctccccaaatcttaacgaaaattcgggcagcgctctttgtcagcctggcaaaacaaataataataaattagacattcatgcaagaaacatgtcatccaggattgacaactctgctacctcacggatcgatcaagtcaaatttggaaataaaagagttggttatgataggttcagcaatgggtttgctgctgcaaaattctcaacagaatctgatagaacaacccattggaccctactccttccagaagaaaggaaagatctggaaacattatatgatggcacagtagctagtgacccattctctttcacattatgtccttagccatgatcaaacgcgcttggtcaaaccaaccagtaccaggatgattgacagaagagtaacgagaacgaattttgacaaagagaaacagctccagtgatttacgcattcgaaattaaaaactacaatagttacagcaatttttcatctataaaagtccatgcatagcctcttttgaatgtccaagttagctattcaacattgatgcaggattgtgcttacctaaaattaagttgaagcccttacattcttttgttgaagggacatcagaaaacgttaagaggctaaactaataaatacgaagatacccaaccttagaggaaagttagtgttggacaccaaattgggcatttatcacatctaaattatctcacgaaaaaacaatttttttcacattggacaaaacaaaaaaacagcagtactattgtgaccaatcaaccacaagcatttttcacattaagttgaggttatgaggtaacggatgcaaaaccctcatctagtcacctattggaagaggaagctccggtagggacagtcggcggcgatgcactgtcgcagcctagcgtcctccgccgggcggtgcagcatcgtcagagaatccgctctcaccgccggcgtgaagtgcctgacaaggtcccgccattttggaattaggatagttcccttccagacctagctagcagcaacaacacctgcggaggcgggaggcgtggaggagctacaggatacttcgccaaccggaacttgctcatcaccggagatctcggtcggcgcgcggccgacgaccagagctatgcggcagcggcggcgacgcggtagaatacgcttcagttgcggaaagaagaaaaagcttaaaccgaggatggctatagttgggccgtgcaacgtccggataacattttattggggaataagtccaccggaggcgagactttttgagatcccttaaccacaaaaccagaaatgtgtatccctaaactcacacaaaccgtgcactcaaggtcctatggcagtatatatgggtggtttcgctgacgtggcatcctagtcagcaaaaaaaattaaaaaagtacgtggagcccacatgctagctacacatttttttttcttctcttttcttcttcttcttcttcagtaaggaaggccggcgggcggctgccctgcgtggcagtggagcggcgccgagatgcgggcagagcggcaatgagcggcggtgggcgagcagaagagcatgacgacagtgtggccgccgtgcgcgatgttgatgctgttgatgtggtagtagtcggagatggtggacttcatggtggtctcacagaagatgttctcgctgcggcgggcgcccttgccggacttcatgtggaggaggtgcgggcccgccgccgcccatcaccgcttcccccgccgcggcgctcgcctgctgcccgcccatcgccgctccgcccgccgcccgctggcctccctcactgaagaagaagagaagagagaagagagaagagagaaaaaagaagagaagaagaagaaaagataagaaaaaagatgtgcagatgacatgtggcccctacatactttttttaattttttttgctgactaggataccacgtcagcgaaaccacccatatatactgtcataggaccttgagtgcatggtttgtgtgagtttaggctatatatttctggttttgtggttaagggacctcaaaaaaatctcgctgttaagttgagggacctccggtgaacttattccttttattggactaactcaagtcctaaaatgggcttaggccaaagtttttgaagagcgggggagtatgttgggacccccgtgggggtgggacaagtctattttttgtcggagccatgtagctcggaggcaccgttggatctggcatgggaggatgacgatgcagaggaatggggaaggggagagtgaactggggaggcctcaggtgagcattgctgcctccttcttgtggatgagctaatgtggtaaggttgggatgacggatcggtggtggagctcacggaggaggagcaaggcaacagtgcagctctccgatgatcgcaccagtgttgttgtccccatcttcgttgtgaggatggcatctcatccttgcccacgttggctcgagtgctggccatctcgagctcgctacagagggcggtttcagtgatgtggatatggggaaacaacacacggcatcgctcgagacccctatgtcatgggcctattgggtccactaggttttttgtttttaaaatttttcaactcaatgacatgcgggtcccattaagtttttattctattattttagtgccatgtaggatgaacaattccacatagacacatgtgatcttcgctaccgccgttgtgtcatcgccaccgaagcctcggaactcccgaggccgacattgccatcgacgagctcccaagtgccagatccatgtctttgtcatcactgccgaggtcccaagcgccggatccgacgccgttgtcggcatcgctgccagatgtccctacagctcccgaggccagcactgccagggagctcctgagcgccagattcattgttgttgtcatcgctgccgaggttccgagcgctagatttgcctccgctgagtttctgagcgccggatccgccagttcccaagctcctagctcgcacctgccgtcgccgctgccagaagctcatcaacgcctttgcaagcccgtcaccccgctccggccatagtcatcttcgccggcggatctagagggggagaagtagatgcggagaaaagctaagtgagagagggagagagaaggagaggagagtggatcggggtaggggaatggttataaagaagagggttggctagaaagttgtttttgcattcaggtctcttaagtggctcgcatttgataatcgatttcttcatgtgggtctcaaccaaatagcatccaaatatttttatatgcggatgttttcttggcccgcttgaaactaagggcccctttgatttggaggaaaaacataggaattttagaggatttcaattttatcggaaaattttctatgaagccctttaaaacaaatgattgaatcctatccaatcctctgaaatttctatagaatggacaatcctatagagattttggaggaaatttagcaagagcttcaacctcttggtaactttcctttgagtctacatctctcattcaattcctacgtttttcctgcggttcattcaaacggtcattcctgtgtttttcctgcgttttgcaatcctctgttttacacttacattcctatcaaaatcttacgttttttctatttctacgttttctcaatcctacgattcaaaggggccctaaatagggggtgcctcaataaaagtcattttcgtagtagtgaacctttccgtcttcaagtgattttctcttcagtttcctaagtaacccagattatcatgtagattcaaaggcacataaattacagaattcagaaaatgaagcagagtagctttaagattctcactagctaaagctgcttcttaaacctccagctctttaaacagagccattgacttggtgctccaagctagagctcagcatttcggtcttcagtcccatatgaccaacaaacaatcgatcgttgactcaacgcaatctcttctgaccccgacggtcgaaaactatggccggagcacagaaagaagtaattcaatgccaatttggcacaattaatacaagtggaagaacaaatattaccaataaatcaacggcaagattgtgttacaattccttgttagaccgagccggcttctcgagtctctgtttgctagtggtggctggcaccagctgctcgagtgatatcgtggacatcagttgaacaggctaatgggtagtagaggtgatccatccacctgtgtattaattactaaaaccattggattgttacccattttatcctttatttaatgagaaagttcttgaccatttatgtcaaaacgaagtccatgacgaacattattaaataaaaagagattaattatgtggcatcacttgtagtgttgctgttaggctcattgttttgtgagtagcaattcttgttaccatttcttcaaactagttttgatgtcacatgagaatgatattgccaatttatttaagttttaatttttttactatcatccttcagtagcaccactaccaccatatagttgttttgtgatacatctcggtctctcaactcttagaggcatgtggcaatgtttcttgaatgttatcgaaaaagttaagaaaaacaaaagctgacaacgtagattaggtttctatcaataacacacaaaaaaaagcagaccataaaaaatacaattggatttggattcacgcactaagggcaaaacaacatcggtggaagggagaggaggaggacgcgacaaagagccactagcaggttcgccaaagattcctccaagcaagggaagaaagagtatatgtcggagatcaaggtgataagccggttgtgctaccacaatctagtgcagctcatcgggtggtgccatggccgcgacgagctcctactcgtctacgaactcgtccccaaccgcagcctcgacatccagctccatggcaatggcaccttcctgacatggccaatgaggttagtaactgtcctctctaacttcatctcaacttcctttgtgatgttaaattaatcggtgtattaactcagctaagatggttttaacttgtcacagggttaagattgttcttgggcttggatcagcactgttcaatctccatgaggagtgggaacattgcgttgtgcatcgcgacatcaagccgagcaatgtcatactggatgagtctttcaatgccaagctaggcgacttcgggcttgcaaggttcatcgaccatgccatggggatgcagacgatgaccgccgtctttgggacaccaggctatgctgatcctgaatgcgtgatcaccggtagagcaacctcagagtctgatgtttatagctttggctttgtcctattggaagtggcatgcggaaggaggccaatgagcctacaagataaccaaaagaatggcatcttctggttggtcgagtgggcatgggacctgtatggacaaggagatgttgtctcagcggctgatgagcggctcaacggtggttacgacgtgtcggagttggagcatgtcatcattgtggggctttggtgtgtgcatccagacccaagcgcacgaccatctatcagaaccgccatggccatgttccagtctagtgggcaactactggtgttacctgctaagatgcttgtgccaacatatttttagataatagaatttaacattccgacctttgcttaaaaagagctacaaccaattattacaaagtagcactctagaaaagagtgtaggggaggggctcagtggaggggctcttcacatcgtccactaggcgctgccggtgaccttagtggaggggctcttcacatcatccactagaatgtcgtcctcaagtacatgcaacacaatcatcatcaacgaccagtggctacatcactcacacctcgagttcctctaacacatccacttcagctggttcaaaggactcgtcttcgttgctcaaacatcaatacttatgatgttcaattcatttgatttgttactaattttgacttgatgcttgaatggatgtacaacgcatgaaccattgattttccttttagagtagtctaattgccaacgtgagtaatgtatgtgcatttatgccatgatttaaattttactcctattttagtttttctagacagatccattgacttggtgctccaaactagagctcagcactttggtcttcggttccatatgaccaacaacacaaaaatagcaactcgtattgataacaatcgatcgttgactcaacgcaatctcttctgaccccgacggtcgaaaactatggccggaatacagaagaagcaaatcaatgctaatttggcacaattactatacgtggaagaactaaataatactccctccttccctaaattttgacgttgttgatttttttaaatatgtttgaccgttcatcttattcaaaaacttttgtgaaatatgtaaaactatatgtatacataaaaatatatttaacaataaatcaaatcataggaaaagaattaataattacttaaattttttgaataagacgaacgatcaaacatactacctatatattttaatgtatgacaccgttgactttttaaccaacgtttgaccattcgtcttattcaaaaaatttatgtaatcatcatttattttactgtgacttgatttatcatcacatattctttaagcatgacctaaatattttatatttgcataaaaattttgaataagacgaatggtcaaatgttattcgaaaagtcaatggcgtcatacattaaaatacggagggagtatttaaaaaagtaaacggcgtcaaacattttgagatggatggagtataaccaataaatgaatggcaagcgtgtgctacaattctttgttagacgagccggccgtcttctcgagtctctgtgtgctagtggtggcatcagctgctcgagtgagttatcgtggacatcagctaaataggggtgatctgtccacctgtgtattaataattaaaaccattggattgttacccattttaagttcttgaccatttatctcaaaacgaagtacttgacgaaagagagattaattatgtggcatcacttgtagcgttgttgtcagtctcattgtttagtgagtggcaattcttatgaccatttgttcaaactatttttgatgtcacaaggttggagacctatttctggacatcaccttaccgggggaatgagaatgctattgccaatttatttacgtttttaactatcgtgcttgataggcaccactaccacaataacgtttctagcttgaatgtgatcgaaatagttaagaaaaacaaaagctgacaacgtagattcactagaacgggattggatatctctaacgggcttaaagcatcatctctttcgggcagggagcaaaggtcagtaataagaaaatatctcaatcgggcatccggccgtcacggatgacacatctcaatcaagccaacataaaagcccgtcatggatgactctcatctctaacgggcctagattatagcccgtcacggatgactctcatctctaacgggtctagattatagcccgtcacagatgagtataattcaaaaaaaaataaattttgtttttttgttagcctaaggcctttgccctcactagtgtgccttcctggtcggtcaccaatccagactcgtgtgcacccaggatgaattttccagtcggtcacccatcccgtttaacctcacagttctttggagattggcttccgagaaagaaattgtaatttgttggtatgagtattctattaatcctattaagcactgggccaggatgtcacaccctagcatcgcctattcatatacattcattcacataacacaaccacattcacataacatccattttgatcacatatttcaccagcgaatctgagttaattggatcaaatatatatttagcaagtattatcatgagtaggaggcaaatcagacttttaagaaaaaatgaatttcgaattgaattttatgatactaaatgaactcatatgaaaaagctatcaaaaacaaagttgtagaacacattgagatctaccatttttattttggtcatttcaccatccgggtttgattgaactatataaattttgtattttaaaatataagaaattcaaatattttttcgggtagtaaatgatttcaaatggaaaaattgtcaacaacaaagttgtataactcatcaagatctataacttttattttggttatttttctatataacgtctttttaacagtttgaatttgaatttaaaaatatgacaacttcaaataatattttcaaataataaatgatttcaactgaaaaagtcatcaacaacaaagttgtataactcatcaatatctataacttttattttgttcatttttctatacaacatttttttaacagtttgaatttgaatttgaaaatatgacaaactcaaacaacattttcaaatactaaatgatttcaactgaaaaagtcatcaacaacaaagttgtataactcaccaaaatctataacttttattttggtcattttttcatccgacaaagtgatagtaacattgttcacaaaattcacatatctctcatctagttttataaactataatacagatatgtaaattttgtaaacaatcttactaacactttatcggatgaagaaatgttaaaaataaaagttatagatcttgatgagttatacaactttgttgttgatgattttttcagttgaaatcatttagtatttaaaaatgttgtttgaagttgtcatattttcaaatttaaattcaaactgttcaaaaaatgttatatagaaaaatgagcaaaataaaagttatagatcttgatgagttatataactttgttgttgatgaccttttcagttgaaatcattaagtatttgaaaatgttgtttgaagttgtcatattttcaaatttaaattcaaattcaaactgttaaaaatatgttatattgaaaaatgaccaaaataaaagttatctctaacaggcatcaacaaaagcccgacaccgatatgagtcatcggtgacgggctttaaaatcatctcaatcgggccatatttggagcccgtcaccgatgaccctcatctctgacgggctcggtgtctgggcccgattgagatgtgcgaggtcatctcaatcgggcctaaatctttgcccgtcacagatgagtgtcatcggtgacgggctatatgtacttgggcctagagtgagtacatctacaacggtgcaaatttaccgattaagatgacttcgttctgacggtccaagtagtccaggcataattgagcccgtcacagattctaggatcggtactagtgattagttttcaatctacatacatgtaaagtcaaattcatctaaccaaaacaaaaacagaccataaaaaatacaattggatgtgggttaacgcactacaacagatcagcttcctagacagattctctgtgacaaatggggaatccgtcattgatttgtgatgaattcacaaaaagaaaatcattgtaaagttcaccttcagcctatcctagcgacggttggaggtcttccccacgacgaacaagattgtcacgaaatgatggtgatttcgtcgttagcagttgggctatcatatattaaaattgttaggggtatttttgtttctcaatctagagatagatattaatttgacccactttttatgatatcaatcactttaaggagtttataaccggacaaaatttgctctaggtcattctagaattgtgacatttatcctaggataatataattatgcggctcgccgtatgatggtctagttttgcgtctctttgccaagacacactttagcctttgttttgacatatactcttcaaatgaatttctaaaagaagagattgcccgaagacctaccaggcaggcctgagggcagtttcatcttttcaaaagttttctcttcccaattgaagaggataggttaaaagaagtggctatatatctaacttttgacagataactatgtaacacctatgtaaattaaaacttgcgttgtaacacaatcggagaggtggagagcatatgccccctagctggcatggcatcacgatttcgacgcctggtcacagagcactccatcaactttttattcctgatcatgcgcacaaatctccaggccaatccaacggaagaaaatttgaaagtttttcctccacttttcttaacatagtaaaatagtaagttcttttggcaaaagaccacaagtccataaaacaaagtgtattttggcaaaagaccacaatcccgtgacaaccgtaaactatagtgccttagaacaaattttgccttaggctataagccaactaactatatctaaatgtggagcagagagatgaaaaaaagtgttagctctcatgtaagagctagctctacacagtacacagctataagataaacacattaaatatataatgagacaaagaaaggataagaaaagcatagataataaaataacttgtctatttatatatgttaggtctaatactattttaagatggacttacttagcttatgactttgtatcataaggaccaaacgagtattacatagcttaatatccacatcatctgcttacctctttgttttgacgtactcttctttcgtcacgtatttacaggctgttaccctagcgcgagcggatccaaatccgtccaaagtcattggttaagttcgatcaccagcgagtaaatagttccatcaacttcgcttgtatcatcgtgattaaactttctcggataagtatgatattttattaaggttgatgtaagcgatacctatatgatatattgattctatttttaactgcatcactatttagagtcgtattggcttagttaggactttctcggtttttatgcaatgtttcatcggagttctagtcgatgagttatcttgttactacttctaaatgttgtattggcttatactcaaactcgcataatcactagttaaatctctttttatgaactttacccttatactatttcggtttggtctgatctatcaagattgtttttataaagaacagtttattcataattatgcatagtttagttatggccaataatagcacgaattttattgtttgtctgattattatgtgaatctcaattgagcctatagctgattgatcaaaaccctatcatatcggctggcctagccacatcccattggcttactggctaattggcaccttgatcatcgatctattcaaactaactggcacatccttaactcgattgataggaccggcactggacctaagcagatctctcaggtctttgttgttgggaatagtcccacattgcttatctagggggagttgaaccaacttaaaaatggggggagtccttcacctcttgagctagcttttggggtgtagcaaggctttctcctggttgggccaacgtctcccggttttgggccaacaagtggtatcagagccaaacccacaatctctagtgcttgtgcacactcagggtggtgtaagcccaaagcccagtggaccgcgggtgtgaggcccgtatgtgcctgtgtgtggggccggtcagggctaaggggcaccaatgtgtgaccacaatctctagtgcttgtgcacactcagggtggtgtaagcctaaagcccagtggaccgcgggtgtgaggcccgtatgtgcctgtgtgtggggccggtcagggctaaggggcaccaatgtgtgatgggggagattgttgggaatagtcccacattgcttatctagggggagttgaaccaacttaaaagtggggggaacccttcacctcttgagctagctttttgggtgtagcaagactttctccccgttgggccaacgtctcccagttttgggccaacatttgtgtgtgcaacagttagctagcccatgcatcgtagcgcatgagccaactcatgtgtttgaacccccccccctccccccaaagcgcatgatgcaattttttttaaaaaagaattagcaaatccttaaaataatagctaaagtgtgttttgacaaatgatcacaatcaaataaggagtgttatctctcattcaaaaggtagctctacaaatatataggatgaatgcattaaatacataactgagacaaagagagaataagaaaagtagagacttgtctgttacgtactcccttcgtcccaaaataagccaatctcgaactatatatatgtctagattcagtatagtccgatatatgtactttgaggttggcttattttggaatggaggaggtatgttagatctaatgctatttttagatgaacttagttagcttatgactttgtatcataccacatcatctgcttacctgtgttttgtcgtactcttcttttgtcatgtatttactggctggcgcaagcgcgggtccaatccgtccaaaggtaaaaatggcggggggctgatcggttactttaaatccgtactccagactgcattgtcacgtaggaaggctcccgagcattgtctctcatttctccccagctagtcacgccgatcagtactggtagtctatcactagctagctatatcgttgtcacccttgcgcgccgatcgacgccggcggtgatggccggcttttctttgatcagttgcgctgtgggtatcatcttcttctccgtttgctacctgcctgcggctcctgccgccgccttgtccttcaactactccaccttcagctcggacaaccaggaggacttcacattcgaaggcaacgcctccatccacgacgggtgtattgatttcgttgcgaacgggacctggggcaggggctacaggccctacagcaccggacgggtgtcctacaaattgccggtgcggctctgggacgctgccaccggcgaggtggccagcttcaccacaaccttctccttcaacatcacgccgatgaatattagcgacaagggcgatggcatggccttctttctcgtcagctatccatcaaggatgccgctgaccgccgacggcgacactctcggcctcgtgagcaacaaacccgaaaacgctccggccggcggcgaccaattcgtcgccgtcgagtttgacacctacccaaaccccggcttggaccctaacgctaccggtgaccacatcggcatcgacatcaactcagtccgatcgttgacgaccgaacccttgaccaactccagcctcatcggtaacatgaccgccatcgtccactacgatagcagttcgagcatcctgtcggtgaagctgtggataaatgacacgacgaagccgccttacaaccttagctacgaaattgttgatctcaagaaaaaattgccggagaacgtcaccatcggcttctcggcggcaacgggcgcatcagatgagctacaccagctgacttcttggtacttcaactcgagctcgtcgttcgagcataagcatggacgtgccggggttgtagcgggagccaccgtcggcgcgacgttgttcgttgtgctgctcttcactgctgcagctatcctcatacggcgacgtcggatcaaaaacaggaaggaggcagaggatgagcaggacataagctcggacagcgaagacaatgacggcgagcccatcgtggagattgagatggggactgcgccaaggcgattgccatactatgagctcgtcgaggcgaccaagaacttcgcggtggaggagaagctcgggcaaggcggcttcggttcggtgtaccgaggctacctaagagagcagggcctcgccgtcgccattaaacgcttcgccaaagattcctccaagcaagggaggaaggagtataagtcggagatcaaggtgataagccggctgcgccaccgcaatctcgtgcagctcgtcggctggtgccatggacgcaacgagctcctccttgtctatgagctcgtccccaaccgcagtcttgacgtccatctccatggcaatggcaccttccttacttggccaatgaggttattaattatccgtgctaactttctcatctcaactgcttcgatgagtgtcaaatctaattctatttttatcttgcttaattggttgtttccacaggatcaagattgttctcgggctcggatcagcactactctacctccaccaagagtgggaacaatgtgtcgtgcaccgtgacatcaaaccaagcaacgtcatgttggatgaatccttcagtgccaagctaggtgacttcgggctcgcgaggctcatcgaccacaccatcggtataaagacaatgaccgccatgtcaggaacaccgggctaccttgaccctgaatgtgtgatcaccggtagagcgagtgccgagtcctacgtttacagtttcggcattgtcctactggaggtggcatgcgggaggagaccgatgagcctactagacagccagaataacggcgtcttccgactggttgagtgggcctgggatttgtatggcaagggagatgttctcatggccgccgacaagcgtctcgacggcgactacgattctgcggagatggagcgtgtcatcgctctcgggctctggtgcgtgcaccctgacccaagtgtgcgaccgtctatcagagacgccatggccatactccagtcgagtggaggccaactgccagtgctatcggccaagatgcccgtgccaatgtacgcgccgccgatggcctcgtttgacgggctagctgtttgcgtcatctacagggatgtcgtcgtcctcaggtgtgacgcagtcgtcgtccacatcgacgacgagcggccatgctattcacacctcgtgttcctcggtttcctccgattcaaccggttcgaaggactcgtcttcattgctcaagcatcagtgctagtgtttagtgtttgttttttaatttgcttgttcttagtttagagttgatttggtctttggtgttgcctaattgccgatttgagtaatgtatgtgtatttaggccatgatttgagtaatgtatgtgtacttatgccatgaatcttatggcactgtagtttctctagaaagatctgtccggccattttctgttccagcattagaataagtcgagtgagggacatgggcaacgatagtagctactgcagcagcactacaattgaggcgaatcaaacgatcggcccattacaattgaaggggtggtcgccatcctcctcatgggccattgcctacagaacgaattgggttgggacacagccgctaggaaaagcctgatctacatgcctatccccaatgcattaaatcaactttacatcccttatgtttccatcgagtttaaatcgcatctctgaaccgcaatacaagaagtctagacccacaacttgtaaaactaacttaaattaggttcttcggcgatatagataggtgatttcgctgataaatataaaaaaatgcatacctaactctaaggctataaatagacccctccaagagaacatatattgtaagtgagtttcaataaatatatttactttctttgtgtacacttagaaaccactgtttgtcctcttagacaacaccatgaaaattcagaaaatgtgcaatattgtatttttatcaatcctaatttcagaaaaatcctttatcaagaaaatgttggaattaatggatgggccttagcccactcgaagattaattctttggaaaatcacaaaagctcacctcatgagatggcatgcgtgtggagtttagtaccaccttgcttattttaggagaaggggaccttcttaaaagggaggatgccctcctagccacttgaagcatgtgtggtggagagaagagggggaacacacgcgcgcgctcgctcgccgggcagggcaggcggcgcgcgtgcacgacgtacgcgtcgaatggtccgcaaaattggctcctcacccttgcgcagatgcagcctccttttgcagttttgttttgctgcaagaaaattcggatttgttttgttgtaggaaacattccgaaaaatccggtgcgtgaaaacggcgtggagtccagataagttacgcgcgacttatccggttcggttacgcggagtggagatcgtgcgggcgccctgatcaagcgacctatctctatataaaccgagccgctgccttcacgcaacacacgtgaaatcaatctagggtttgcctcctcctctgtgttgtgccgtcgctcgtagactactccatcccgatcgtcagcgtgcaccggcaatcgggagagcaggtctccggaacctctgccttcgacgtcctgcaccgggagaaggcggcaataaggtttttgggaagcgctccgcgcgactgctctctgtttgttcgcgacggctcgccttcctctccgctcgcgtgctgcacgccttcgtcgacgctcgcaacagcgagtagttcctgccgagcaaccggtctttccgccacctcggtacgtgttcgacatgttgcgcatatttgatctgttcatgttttactgcttagtttacatgtgtagatctaatgatgtgttactgctagtatacatctgcaatgttatgatttatttatggaatatattaaatcattatatgcctatattctcaacaatccaaaaaccttattataggcgctgtgattttactatggctggttttgccgatgcactgaggccggataaattcaccggtgtgcactttaagagatggcagatcagggtcgctttgtggctgacagctatgaaatgcttctgggtgagtactggtaaacctgaaggaattcttgctgctgatcagcataagcaattcgagaaagccactactctctttgtgggatgcattcttagcgttcttggcaatcgtctggtcgaggtgtatatgcacatgaccaacgctaaggagttgtgggatgcactgaatactaaattcggtgctactgatgctagcaatgatctgtacatcatggagcagtttcatgactacaggatggctgacaaccgttctgtagtcgaacaggctcatgaggtacaaaccatggctaaggaactcgaactccttaagtgtgtcttacccgacaaatttgtggccgggtgcattattgcgaaactacctctatcttggagaagtttcggtactgcactcaaatacaagagacaggaatactccgttgaggggttgatagtgtctcttgatgttgaggagaaagctcgggaaaaggacgccgcgtctaagggcgacggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtagccaacctagtcatctggctaggaagtgtccacagcgcaaggggatgaaggcacctgcagggcagacttctaagtctgctaatgtgaccattggcaacactggagatggaagcgggtatggtaatttacctacagttttttcagttaatcaatctactaattagtgggttgatactggggctaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgataggaatcttgttagtggctcccgtctgactagagacggatttaagttggtttttgagtctaataaagtagtcgtgtctaaacatggatattttattggtaaaggttatgagtgcggaggcttgttccgtttttccctttctgatttctgcaataagtctgtgaatcatatttgtggcagtgtggatgatgaggctaatgtatggcactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctgaggagagaaacttggcacctctagaactcctacattcagatctttgtgaaatgaatggggtgttgacaaagggtggaaaatgatatttcatgacgttgattgatgatgctactagatttttctatgtgtacttgttgaaaacgaaagacgaggctctagactattttaaaacttataaggcagaagttgaaaatcaacttgacagaaagataaaaagacttaggtctgatcgtggtggagagtttttctcaaacgagtttgacttattctgtgaggaacatggcattatacatgagaggacgcctccctattctcccgagtctaatgggattgccgaaaggaataaccgcacactgactgacttggtgaatgccatgttggacaccgcgggactacctaaggcatggtggggggaggcattgttgacctcgaatcatgtgttaaacagagttcctaacagaaataaggacaaaacaccatatgagatatggattgggagaaaaccatcactttcttacttgcgcacatgggggtgcttggcgaaagtcaatgtactaataacgaagaagcgcaaacttggacctaagactgtggactgtgtctttctgggatatgctcatcacaacattgcctatagatttttaatagttaaatctgaggtaccagacatgcatgttggtacaattatggagtctcgtgatgctaccttctttgagagttttttcccaatgaaggatacacatagtagttctagccaaccctgtgaaataattcccagttcaatcacaccaccagaacaaactgaacatacacatgaacatgtcactgaggaggatgacagtgaagctcctcgaaggagcaaaagacaaaggacggctaagtcttttggtgatgatttcactgtgtacctcgtggatgacactcctaagtcaatttcagaagtatatgcatctcctgatgcagactactggaaggaggctgtccgtagtgaaatggattccattatcgctaatggaacttgggaggtgacagagcgaccctatgggtgtaaacctgtggggtgcaagtgggtgttcaaaaagaagctgaggcctgatggtaccattgaaaagtacaaggctcggcttgttgctaagggctatacttagaaagaaggcgaagatttctttgacacttactcacctgttgtcagattgaccacaattcgtgtgctactttccctagcagcctcacatggtcttctcgttcatcaaatggacgttaagacaacttttcttaatggagagctggatgaggagatctatatggatcaacctgataggtttgtagttgaaggtcaagaagacaaggtgtgcaaattgttgaagtctttgtatggtctgaaacaagctcctaagcaatgccatgagaaatttgatagaacattgacatctgtaggcttcgcagtcaatgaggcagataaatgtgtatactatcgccatggtgggggtgaaggagttattctgtgcttgtatgttgatgacatactgatatttgggacaaactttgaggtgataaatgaggttaaatcattcttgtctcaaaaatttgatatgaaggatttgggagtagctgatgttatcctaaacattaagctaattagaggtgagaatgggattacactcttgcagtcccattatgtggagaagatcttgaatcgttttggctacattgacagtaagccttctccaatatcttatgatcctagcttgttgcttcgcaagaacaagagaattgctaggaatcaattggaatactcccaaatcattggctcgctgatgtacctggctagtgcaactagcctgatatctcctttgctgtgagcaagttgagccggtttacctctaatccaggagatgatcactggcgtgcgcttgagcgagtaatgcgctatctgaaacgtactatggaattggggcttcactattctgggtatcctgcggtactggaaggatatagtgattctaactggatctctgatgtggatgagatcaaagccactagtggatatgtcttcacactaggtggtggtgctgtttcgtggaggtcttgcaagcagaccattttgacgaggtcaaccatggaagcagagctgacgtgtcacaccctgaaaattcaaaatttataaattgttgtttaattggaatttttagaaataattttaaaagcctagaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaaccgctctctctctctccctcggcccaagccggcccagtccgtccgcgcgcgcgccctcgctgccgctgacaggtggggcccacctgtcaggcccgtcgtcttcctccggccgaaaccctagcgcgccgccgccgccgccgctttccaatccggccgttcctttccttctccggtcgaattgattgaggggaaacaatctccgggatctcctctaccttttctcctttggaatctttggctaaatcgttttggaaagcgttggattcgagtttgtctcggattcattcttcccgatctttccttcctcgtcgtcggccgccgtgggcctttgccgccgcctccgagcccctttaaaagcctccccggtgtctcctctacccgccgccacccttgccttcgcctctcgtcgtctgaatcgttctagcgccgtgtgccctagctttgccgtcgccgccgccgctccagccgtgcgccgccgttgtttcagccatcgccgtcgctcgggaagaccgccgtcgtggtcgccaagtcgtcgccgtcctcgtccgccccttcgctgtcgccggagatcgccggagcttcatcgccgccgtcgacccgaaggtttcctccgtttcctcctcgtcgccgtcgccgtccgttgatcttccgccgccgttttggtcaccggtgagttcgccgtgtcgtcctctacgtgctggtggcctccgtttgcgtcctagtgccgccgttcgccggcgagcgtgcgccgcccgagctgtccgctccgccgagcccccgccgctgtcggtgacgtcattgccgacgtcatcggggtcgtccgccgtgagccggtcgtggaccgttcgatctcggccgtccgttttggattggatcgatctcggccgtccgtccgcgtgaaccgccgcccgtgcgcccggtccaccgaaaccctagcccgctgacgcaataaaccttcttttccttttcaaaaataattcattattgcgtcataattcaatttaaaccgatataagtgtccttttcaaaaatatccacatgtactgttcatgcttatttatgtgttgttttggtgattttgctcttttctgtttagattccgtcgtttccggagagtccgttttcgccggagaagaatttgaagagttccaaggccagcaaggcaagtcacacatatcccaaacaaccctttgagcatgttgatcctatttaaagctattgtttcttttcaactattgcatttattttcgaatgtcattgggtggaattaacctattgtttgttatagcccttttgttcttgattactttattccttgataccttgggttataataatttgactggttgaactttatttatattggttcaactagatattagaaataattgcttagccctgcttagaaacattagcacactattgggataactcatgattcactattatttcgtgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatagttcattgcggggcaccagactgagaagtggcggagataagcccacgggggtcgctggggagtccatgccttgtttataaggggtgattatgatctaggaaggtgcactgcagtggattgtgttgtatgcggggtattgtcacaactcctttccgaggtatcgtggtggtattgaggcacatggtgacatgatgtggggttgtgtcttgtgggtacagtggtacacctctgatcagagtaaaactattcgaatagccgtgcccgcggttatgggcgggtctaacaatgtctttcatgattagtttcacacttctcaccatagtaaatgatgctttaactggtaataatttgattagctcctggtttggaatggtatattcctggtttggagatagaactgtgcagccgggatggttgttcagaatggttgggcctatacaacagggtacgttgtatagcgttggattaatattgttttgttacttaactgttttattaaattctcaaaggtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtgtggaggattaggagtagccttggtcaagctgcctgtggagtggagccgtctgcgccgtttatttcattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacatgacggcactggatactgctactgttgaggcagaatggctgcgtgatcttttaatggatctgcctattgttaaaaaaccggtgccggctatccttatgaactgtgacaatcaaacggtaattgtcaaagtgaatagttctaaggataatatgaaatcgtctagaaccgtgaaaagacgattgaagtctgtcaggaaattgagaaactccggggttataacgttggattacatccaaacagctagaaacctggcagatcccttcacgaagggactatcacgaaatgtggagtccagataagttacgcgcgacttatccggttcggttacgcggagtggagatcgtgcgggcgccctgatcaagcgacctatctctatataaaccgagccgccgccttcacgcaacacacgtgaaatcaatctagggtttgcctcctcctctgtgttgcaccgtcgctcgtagactactccatcccgatcgtcagcgtgcaccggcgatcgggagagcaggtctctggaacctctgccttcgacgtcctgcaccaggagaaggcggcaataaggtttttgggaagcgctccgcgcgactgctctctgtttgttcgcgacggctcgccttcctctccactcgcgtgctgcgcgccttcatcgacgctcgcaacagcgagtagttcctgccgagcaaccggtctttccgccacctcggtacgtgttcgacatgttgcgcatatttgatctgttcatgttttactgcttagtttacatgtgtaaatctaatgatgcgttactgctagtatacatctgcaacgttatgatttatttatggaatatattaaatcattatatgcctatattctcaacagaaaaatactaaaaaagtaagacatcataacaagtacaactcagtattattaatttaaagctttatattatttaaaaacaacattatattcagtaatttcgaagtgtatattaacttaaggaaatactagaaagaaagtaagggattaaaagtattagattttattctgtatacctatgatattgtaattaccaatttcaaaaattcaaaactatcggtttcattcttaagcacttaaaagcaaagtataaacacttatgcagaacatacatataatactgttgcaaatatatgtactaaccagtgggtttagttaaggccttgtttagttcccaatttttttccctatagaatagctaatatggtccctaaaatttcgttcctgggtcattttagtccttaatcttttatattattcaaacaagtcctttaaatttgtcacgtgggctgatatagtcctcggtcccacaaaaaattgccacatggacataccatgttaccctcctatgcaaaatctgtatgatttgtccaatttatccttatatatatcataggagaataaaaaaaggaaaaaaagtttatatatatatatatataccccatatatatatatatatatatggggtatatgtaagagaaaaatatacgtcaaaagggtgaaaaaaatggaaaagtatttttttcctatggttatgtctaattcacccttacatttatttttctatgatatacgtaagggtaaattggacaattcatcatagattttgcatgaatgatgacatggcattccatatgatgattttggtggacccaaggattattctaggccttatgacaaagtttaagggtttctttggaccatttaaaaggttagagattaaactgatcttacagagaaactttagggactatagtagctattctccctttttttttcccaaaacatcacattgaatctttggacacatgtatggagcattaaatatagataaaatgaaaaactaattgcacagtttgcatggaaatcgcgagacgaatcttttgagcctaattagtccatgattagccataagtgctatagtaacccacatgtgctaataacggattaattagtattaataaattcatctcgcggtttccaggcgagttatgaaattaatttttttattcttatccaaaacctcttccaatattcagtcaaactttcgatgtggcatccaaaaattttatctatatataacactaacacccagaaagtaaggcaagtggggtaagcgtaagccaaaacaagtcacgtcaaagaacctaagaagcacggcagtaccttcttctgttcatgcagatgcatttatgcatttccaactcgaatgtgtgccactgccagtgccactagcatatatcaaatcaacatattggctcgttcctcgaattcgagacaatcattgtactccaatcgctagaaaacaactttaaacactatttttattataatatatatatatataaacaataacaagtacattttaagactactctctatatatagtcccatatttttaagataaatattttagaaattattatagttgaagattctaaagtttgatctctttcatgtaaaaaacgacaagtattattaccccggatgagtagtataattacttttagagtttaaatttatcttaaaaattatagttatttcttttttttatcttctcatctcaacgaataataacagtctctcattgaatttgtatacctactttctatttttaacaaatcataaacttccaaaatttgtacacctattttctaatttctaccaataaaaaacttccaataatttatttaaaagtatttaagaatacttatattttactactgagagagtagtctgctacccacactacctgcctgaaaataataataataataataaaactgataccaccaccactaccaacatagcccctggtttttaccctcaaattgaaaaacgtggaataacaaggagaatttggtatcattaaattaaggaacaacgtaatttacttacatctccgaacctggtatcgataaattaaaggtggaacattatttttccatgtatttaacccagtaatccgatctaacacatgatcaattaggattactctccgagttaagatctaacgcgaaataactaaagatcatttcctattttgtgagaaattcccaacacaatctttcttttagaattacacagtacaacgcagacactcacaacgcacacgtactcacccatataaacatacgcacgcaaaccctacccctatgagcatcttcgaagactggccggcaaattctggagagattgacgaagtcaccacaggcgcctcgctgtcgacgggtacgtcgcctaccactgaaagcacaacgccgttaaatcctagaaaattcgctcccacggggagtcgaacccaggacctcaggtgctactgagactcttgtaaccattaggctacatgccctttcgcaatcttatttatactagcaacatatactacttatattgtacctaaaagtccccttttttatacattgtttagctatagtcctcctaggctgttcctttcccaactttctcaacttctactctttcgtttttcatacgcacgcttttctaaactgctaaacggtgtgtgtttttgcaaaagttttctatagaaaagttacattaaaaaattatattaattcatttttcaagtttttaagactaatacttaattaatcacgcgctaatggaatacaaccctattatccgtggaactccacctcccgaacgtagccctagtcaactatgcaaaataccatcaagattttagatcttctgtctatggatatttgatcaagaggagcaggtaaattttatacatttttttataagattaggtgaaaaacgacgaaaaaattgcaatcaatccgcaggcctaggccaatgacgtccaaagcttcacctttttttttatatataaaccagcttgatgtatatataaaaaaaggattttatcattcttgaaaatgtatcagaagaaaaagtgaagataccaacaagaaacggaacttacgcttaacttcgtcatttaaaattattaggaaaatagacaaaatatgatacatttcagcaccttccgaggagccagagctgtcagagtcatggtctcatggagcctagttgatttgccaagcaccaacttgttaaattagcagagggagatctcgactggtctctctgagtggcgactggccacctgctgatttgaatactactagtagttttccgtttttggcattggcagtattgtccggccgctgattctgctcacagaccggccatggccgccggcgtcctcatgacaaaaccgttcatggctgctgcggctgctgctctagtcagcttgctcgtcatgctgcgctgcttgcctagcgtcgtcgctaccactgtatctttcaactactccagcttcagcaacgcgagcaagaacatcaccctccagggcagcgcggcgctcgccggcgccgaatggatcgagctcaccaaaggcaaagggaacaacctgtcgagcggcggcaccatgggccggatggtgtacacgccgccggtgcagctatgggacgccgccaccggcgaggttgccagcttcaccacgcgcttctccttcaacatcaccccgaaaaacaagagcaacaagggcgacgggatgaccttcttcctcgtcagctacccgtcgaggatgccgtacatgggctacggcggcgccctcggcctcaccagccagaccttcgacaacgccaccgccggcgaccggttcgtcgccgtcgagttcgacacctacaacaactccttcctagaccccgacgccacctacgaccacatcggcatcgacgtcaacgccctccggtcagtgaagaccgaatccctgcctagctacatcctcatcggcaacatgaccgccatcgtcgactacaacagcaattcgagcatcatgtcggtgaagctatgggcaaatggctcaacgacgccttacaacctcagctccaaggttgatctcaagagcgccttgccggagaaggtcgccgttggcttctcggcggcgacgggttcatcctttgagcagcatcagctgcgttcttggtacttcaacttgacgttggagcagaagcagccaacaggacaacattcgcgtggcggagttgtagcgggagccaccgtcggtgcaattctgttcatcgtgctcctcttcaccatggtagcaatcctcgtacgacgacgtcagagaaagaagatgagggaggaagaggaggacgactcggaaggcgatcccatcgtggagatcgagatggggacggggccgaggcggttcccgtaccacatacttgtcaacgcgacaaagagctttgcggcggaggagaagcttgggcaaggcggtttcggcgcggtgtaccgtggcaatctgagagagctcggcctagacgttgccataaagaggttcgccaaagactcctccaagcaagggaggaaggagtacaagtcggagatcaaggtgataagtcggctgcgtcaccgtaatctcgtgcagctcatcggctggtgccacggccgtgacgagctcctcctcgtctacgagctcgtccccaaccgcagccttgacgtccatctccacggcaatggcaccttcctcacatggccaatgaggtaattaattaactctcattaatactccctccgtcccaaaatatagcaatttttagctatgaatctggattttgggacggaggtagtatatcagaatctatttttttccaatgtgcaatcaacaaatgtcaattgaaattcaactgatcaactagcttggatattatcataggatcaacattgttcttgggcttgggaatgctctgctctacctccatgaggagtgggagcaatgtgtcgtgcaccgtgacatcaaaccgagcaacatcatgctggatgaatctttcaatgcaaagttaggcgactttggtcttgcaaggcttattgaccataacgttggggtacaaacaatgacccacccctcagggacgccaggctatcttgatcctgaatgtgtgatcacaggtaaagcaagcgctgagtctgatgtctatagttttggcgttgttttgttggaagtggcatgtgggaggagaccaatgagcctactggacaaccagaacaatagcctcttccgactggtggaatgggtctgggacctatatggccagggagtcgttctcaaggcagcagacgagcggctcaacaatgactatgatgcaaccagcatggagtgtgtcatggctgttgggctctggtgtgcgcatccggaccgatacgcacgtccatctatcagagctgccatgacggtcctccaatccaatggaccactaccagtgttaccatctaagatgcccgtgccaatatatgcaccgccgatggcctcgtcagaggggcaactttcatcatcgacaggaatgtcatcctcaagtttgacaataacatcaattacacctcgctagggtggcaagttttctcactcataggatatgtatagcaagacaacttttgtcatatctagatttttatccatacccacaagtcgaactacctgcatccctacacctcagttcctttcgcatactttagccggtttgaagggctcatcttcgttaattgctccgtacagtagtattagccatgtttggttcattttacatgttgtacatttacaaattgccgcttgaataggatgtacagctcgtgaggcaattggtttgctctttagagagctgcctaattggcaatatgagtaatgtgttcagtttacatcatgctttcagttttccaaccatttagttattttgtccagaaaacttttccttcaatttcctctccaacaatccaaccaaaccgtccatatctctgaccgtccatatctcttcattaattttctactgaagcagttcttatgcaatcgtctcaaattgtggatatttatgttcagtacatacaccggtgttgattgaacgctgaatcgagaacatcgaagcaaaattgttaacacacaaaaataacaacagccaattgtcagatttaagacataagagattcatgcagcaagcatatcgtccaagattgacatctctgctacttcacagagtgatcaagccaaaatttgaaagagaagagagttggttctgatagggtcagcagtggctttactgctgcaatttcctcaacaaaatctgataggcttttacggtgtttgcattccaaaaaaaggtatagatccaacgctccataatcataggtatcatgtaaaaggtatttaaccattggtattggtgcttaagtactaagggtaaaaatataattttactagtagagaaaaagggtagaattgtctcccaaattagaatcggtaccgcgtaggtactaccatacgaagttaacatttcccctttaccagctttacaggttattatttgcgtattttctcttttgcatggttttatctagatttacgttgtgtttgagttaagtcatttagccagcactagcattacaggttcttaagttgcatcattttatctagagttactccgttctttgatgttctcatttacgtggttttctctatatttatgttgtgttcttataacctgtacatgtcaatcagatcttgcctcctgttcaaatgctcgaccatgccagatcttcttcctcgaccgtgtctcctcatgggtgcgcccgttcgaacactagaaaaacaccataggaggagatctcgtttactatcccacaaaaattccagtcccttatataaggagtttatgaactacatgaataactaatcaactatgtgaataagcataggataactttcagatgcgctagattgagcctagtcatcgaccgggctatcgcattgtcgacgtttgatgtctcgactacggtgtttgggcaatatggagatcgtcggtgctagggtatacgcaagactgaggtaaaagagatggagacagggatttttatacaggttcgggcccctgagctatcaggtaatagccctacatcctgttggccggagccgatgttgctttttattcatgataatcacaccagtacaatgtttggggtagcctatctaactgttgtcgacatggcggtctgacgatctgactcgtagtcgacaacagggtagccttcctcctcgaatccgtgcccggcgagatcagagatagtgctttcgtctctcctgacagtatccggagacaccgtagggtactagccgtgtttatccctgaagtcgatatccggcggcgtgtcttagcgtatgtaggcttctatgttgtggcttctatgtcgattgtgttaggtgttgatcccttcatggtgggtgtatgttgattgtgttggttctccctggcgggtgtccccctgtcctcctaggggggcttgtatttatacccataggtgtccccttgtccaagtagaactagggaaaccaatatggatacaatccgagtagtccttgtcgtttccatgtagaactctggttatctttccttattcagaactccctcgaggttagtttccatataagacatggtatgtggtggatcctgccgagatttagtcaactactattaggtatgtggtatccataaccctgacacgcatctcctcaaccctcaaccatgcagacgcttttttctctgtctccttctagtgaatgttcaaaccctagaacaagaacgaagcgaaaggagagaagaatggagatgcgatctttctgtttattttggtacagatcgaattgatcgctgctaaatcaacagtgtatctgtgatttactttttttcctcacgacgtatcaatctgcataatgatatactgatcgatggatataggtattcaattcacgtataatgcccatgttttactagttaattacgtcatcatattataataactaggaagaaagcccgcgcagatgcgcgggcagttttatgaagacaattttttaaaaaggttatatctcaccatttataagccgagaaatatattgcatactttaatatatttaagtaataaggttatctcctagattaaataaaatcactttgcctctggttacatataaattttcttgttgtcacttcaacctattatcactgtttaaaagccaagtacctattcatagatgaactacgtaatgtatcaataaaataagcctaatatatcattaatacattgaaatatccactacacgtaagtgtttcgtgcctcaccaattttcaaaactatatataaatattgtaaaaataccacttgtacaaattaatagaataacatcaagttatatataaatgcttctctaatgcgtgaagccgattgcagtggcgagactttctttgtccgttgccttgaaacataggtcccatatcgatgtagttgtgcacctccagactaacctggagcacaattttaatgcctaatttactatcacacccttatcgagttgtgcatcggtaagtagtaagttgagcactattggtgactgtggtctccactgggaccgccttaactcccatatgtacatccctgttatacttatagcaacgtagcaaactatgttattcatgcttatgcccttcatgaaaggaaaaagagaagatggaggtgatcaaaagaatgttttttttatgttttgagagtagattcatggtatagagtaggcaccacgtgtttatggtgttaaacattatgcaatttgaaaatgagcgaagttgtaatttgacggtactaaaagagaagatggaggtgatcaaaagaattttttttttaagttttgagtagattcctggtatagagtagacaccatgtgtgtttatggtgttaaatatttatattttgacaaacatctatagtttagcgcttggtttattttcaatacttattgttgataatgacatgagacacctttactaattcgaagaatatatttattttttttaaatttattaataataactaatgcgtgggagtatatgggagttttttattttttttgtatgatactatatacgtatattttttttggttctatctttttttgacacgatggctttattcttttaccgtacgtatgtaggttttattgttccttttcaatcttacgtacttactttttttttggcgaacctattctctctcgtatgtataggtggaaagtattagtattagagatatatatctaatctaatgatctaaataacggatccatcaatttaagtgaaaatcaacggtatagatatagatataatctaatggtctaaaataacgggtccaccaatttaaatgaaaatcgacggtgagattaaacagtgccacgtggcggtttaggagcgtttataagaatgccacgtgtcgtcttgagagtgtttgtaggacgtttaatggacttttagtatataatagatagatagatatattttgttccctaccttgcccctctcttgattaacggtacacattattccatctccaggtacctctaagtacctcgcaaacggtgtaaaaagtctcgaaaagtaattgaaagctcatactgtcagtagagagttcactgtctttttcaacacggtgacggtcgtgcgtgtatgctgcaggctggaactcaggacttaattcggtcttcgatcggttgtactagatgacatcaaagctcaaatttgcggagactctttactccacggccaaaggggagtctttaaagtctttctgcgatccggatcgaattcggatcctctgcggtggaggagaaaattcagaggttgctacagtacccagcattaggagtactgtgggccgtccgatcaagaacggacggatcagaccgttcgctacagtaaaacagtgcattgatgcacagtactttcatccctgtagatacagtaaatcatcactgtagcggtactgttctgtgcattgaaacactgtccccctcacatatcactgtggccacagtgcctctctgcggtaatgcagaggatccgaatccatccggatcactctccatcgatcgatcagtggagttggcacaatatagtttcagataagctgggccattgactgacctctgggctcttgttctgcgtcaaacgactgcatgaggcaaccctgaatatctctcaagtctgaacattacgatttacttacaattatgcatgtttctccgtctctccgatggatcatggagattgtagcagcatcgttaattttggggtattgttcttttcagctcggcatggacaattattgtagtccagctaggaaccgacgctgataaaccgacaattattagttaagtcatcgcaatgatcatttccggtgcgcaatccttttccgtattaaaaaaaaaaatccttccaagttccgacccctgcgaaccaacaagtacagaacaagcaattcaataccaatttggcacagttaaaccatacggaagaactaatagcatttatatgccgtgttaacaccagctgtgttacaatgccttgttagaccaaactgtgttgagtctctctgtgctgctcattgtacttgaggaaaaggtctttattttcttacgtcccttgagttaatccctctcattagagaaatgaaaacgaattatgaaacattaatttcacacctgtcaatccccatctcatgtggattaatcgagcaatgtctttaatgagatgacactcgttttcttacatgccatcaaatagttgtaaaattgtttttataaaaaaatatcataatgcgatatatttgttggattctaccttttcagattgaaaaacaacaaattttgtttcatcttgcatatttgtaaaatgatatcacacatttatctatgttgttgaatcttttaaagatttttctatgaatattgagacaacatatataaaagagtaaaatacacggccggtccttaaagttgagcgcgggtgtcacttaggtccataatcttgtaaattgcacatctaggtccaccatcttgtttaagtgactcattgaggtctaaaagacctctgaccaggttgactggcttacgtggcggtgcagcgtggcaacatatttgcattttgccccctttttgattccccgtgtccgatccaatcccttctttgcgtggcgcacgcaggaacgcgccgacggcaacgtgcgccagcacgcacacctgtggcacccacctgtctcaaccacgctgcgcccgctgacgtgcctcgtacccctctggcagccgctcgccggtgttgcgcagcgcccagagaaaccgcacaccgtcgtcgacgggaaggagaaggagcaggggaaggggaaggcccccgctctagccagccgtgggtgcacgcgacaagtggctgcggcagctgctcaagtcaagcttgccctgccgccatggagctcgcacccgcccagctcgcgccgaactcgccgacgcctcacccacacacgcggccgcggtaggcgacccctcctcccaggcgtggccggcgacacctcccccgcgcgcgccaagctcaccgacgcctctagcaccaacgaccagcgggaagggagaccgatggatctggctgtcagtgaggcgtgagcgccaccggcacgctagctacgaagactgtcacaccctgaaaattcaaaatatataaattgttgtttaattggaatttttagaaataattttaaaaagtcttgaaaagaagatctaatttttaattaataaatttcaatataaaatgggcccagataaaatttccttaaatactttgcttaattctataattcctagatttttctgggatttatttgagctaagaaagtatttttaataaatggaattgcatttaagaaataatttaaattgaaaaaaggttttaaaaagtcttcttttggctttgggccgaaagtcggcccaaaacctctcttctctctcctcggcccagccggcccagtccgccgcagccgcgcgcgccctcgctgtcgctgacaggtggggcccacctgtcagtcgtcgtctacctttggccgccgccgccgaaaccctagtttcgcgccgccgccgtttccttccaaatccggccgcccctttccttctccggccgaatcaatagaggggaaacaatctccgggatctcctctaccttttctcctttggaatcttcggctaaatcggtttggaatgagttggattcgagttcgtctcggattcgttcttcccgatctttccttcctcgtcgccggtcgccgtgggccttcgccgccgcctccgagcccctttaaaaggacccccggtgtttcctctacccgtcgccaccttcgccttcgcctctcgtcgtcggaatcactctagcgccgtgtgccctagcttcgccgtctccgccgccgctccagccgtgctccgccgccgttccagacgtcgccgtcgctcgggaagaccgttgtcgtggtcgccaagtcgtcgccgtcctcgtccgccccttcgccgtcgctggagatcgtcggagcttcgtcgcggtcgacaacccgaaggtttccgccgtttcctcctcgtcgccgtcgtcgttcgttgtttttccgccgccgttttggtcaccggtgtgttcgccgcgtcgtcctctacgtgctggtgccctccgtttgcgtcctcgcgccgccgttcgccggcgagcgtgcgccgcccgagccgtccgctccgccgagccgccgccgctgtcggtgacgtcattgctgacgtcatcggggtcgtccgccgtgagccggtcgtggaccgttcgatctcggccgtccgttttggattggatcaatctcggccgtccgttcgcgtgaaccgccacccgtgcgcccggtccaccgaaaccctagccgctgacgcaataatccctcttttccttttcaaaaataattcattattgcgtcataattcaattttaaccgatttaagtgttttaatccgatttaatcttcaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccgaagagtccgttttcgccggagaagagtttgaagagttccaaggccagcaaggcaagtcacacagatcccaaacaaccctttgagcatgttgatcctatttaaagctgttgtttcttttcaactattgcatttattttcgaatgtcattgggtggaattaacctattgtttgttatagcccttttgttcttgattactttattccttgataccttgggatataatttgactagttgagctttatttatattggttcaactaaatattagatataattgcttagccctgcttagaaaccttagcacatttatgggataacttatgattcactattatttcatgatggcttattgatagttcacgatggtcaatcgtgattagttaattaattaatgtgccaactaaaacctgataatagtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcgttgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagccccttgaccctaggttatgccaaatggttacccatagaagccctctaaaaatattggaaaaagtagaactgttctcctccctttctcttttaattaaaccaaaataatggcacatgcatttcagcaaaatttcataatctcttttaatggttctcattcaaaatttattccagtgttattattactgtacatctattactgtactaatggctcatttaccagcaaaagttttacaatgttgttttatttaatcttgctgcaataaaataaatttagcatgttgattttataactttccttttatttcttttgaaacctgttattcaaaagcacaaaatttgtaaccttgttttcaactatttcaaattatcttgcaagtttggtttaccttatttacttaccttttactttgattttcaaattttattcaagttaatccaaaaacttgtgctgttaattggatagatgtcttaactctctcctttcacttgtctttagatgccgcgctacaagcctgagtacctgtttggtgttgagggttttgtccaggagttgcgtacgatgtcctttgccattggatttgggactgcccctttttatgcccagattcctcatgatcgtcatgaagagaagtgccgagtcaaagtcaccttaaacagcaatagtgaagatgtcccctcagtgatgttcgaagctggaggaagaaactacatccatgcatgtcaggaagtggcaaggatcgccataggagagctccgtgatcgctacagtgatcagttggccgatactgagtatcgctaccatcctcgtcaaccccagggaagtgaccgtggcagttaccttgagactgaaggaattgagaatgatgctaccacaaggcatttggttgagatgttgtgggctatggatgaaagtcgtgcggagactgtgttagcggctcaagatcgtgaagaccggaatcgtggtaagatttgcaagttagaggacaaggtggatcgtttggagaaggaactcgccgcattgaagggagaagcaccgccgcagaaggccaggattcgtctcaccgcaaggaagagagctctatttgtccctcgctatcaattggcgccaaaggttcgtgtggtggagaaagaagttgccccagctcaagcggatcctccggtcatcatcataagtgatgaagaagaagaatccaagcgcacccgttccaagattgagtgggtagcaactcaagatgatgaagacgagccgaacgagcctacaatcgacctccgatgcttggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctatcctaagtagttccccggtttctcttcttgtgccctgttcctgccagatggtgaatactcgcagcaacgggaatggtcccaacaaccccaataacaataacaatggagagaacccaactctggcccaagttcttcctcaacagacacagcttatgaacatgatgatgcagcaattccagaatcagcagaaccaaggaaataaccatgtacctccccagaataagttagcagaatttcttcgtgtgaggccacctgttttctttagtaccactaatcctattgaagctggtgattggctgcatgccatagagaagaagttggatttacttcagtgcactgatccggagaaggtatcttttgcatcacatcagttgcatggctctgcctctgaatggtgggatcacttccgcctgaataggactactgctgaacctatcacttggcttgaattcaccgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattattctgatttccagaaattagtggataaggctatacgtcaggaggacaagtacaattgcatggaacagaggaaacgtcggattgctcacttcaaggcacaacaggggagtaatcagaagccgcgtcttactttaggaccccagtctatgccacagggaggttcttcgtctgttgttcgtccgccgcgtcagttcttcaacaacaatgctggcaataacatccgcaatcaaactccacgtcctgttgcagctccaacacagcaacagcctgccaagagggagcaaggcagcaagcccgtggtgtgtttcaactgtggagacccaggacattatgctgacaagtgtccgaagccccgtcgcgtgtaggttgtccctgcccagagtaactctgctgtaccagcatcaaaggcccgtgtcaatcatgttgctgctgcagaagctcaagattctccagatgtgattttgggtacgttccctgttaactcagttcctgcaacagtacttttcgattcaggtgctacacattcattcttatctatgagttttgcgggaaatcatgggatggaagtagaagatcttagacatcctttgatggttagtaccccaagtaatcaagcactctctttgcaacgtagcccctcggtcagaatagaaattaaaggagtaccatttctggccaatcttatcttgttagaatccaaagaccttgatgtcatcctagggatggactggttagccagacatagaggtgtgatagactgtgccaacagaaaagtaactctcaccagcaatgatggtcgagttgtgactgttcatgcattgtcttctgagtctttaaggtcaagactgaaccagataactttggaagagattcctatagtccgggagtatcccgatgtgttcccagatgatttacctggtatgccgcccaaaagggatatagagttcagaatagatctggtaccaggaacaactccaatccataagagaccttatcgaatggcagccaatgagttggcagaagtcaagaggcaagtggacgatttgcttcagaaaggatacatcagaccgagttcatcaccatggggagctccggttatttttgtggaaaagaaagaccatacccagagaatgtgtgtggactatcgtgcgttaaacgatgtgactatcaagaataagtatccgctgcccagaattgatgatttgtttgatcagcttaaaggtgctaccgttttctccaagatagatcttcgatcagggtatcaccagttgagaatcaaagaggaagatatacctaagacagcttttaccactaggtatggattgttcgaatgtacggttatgtcttttggacttaccaatgcccctgctttcttcatgaacttgatgaataaggtgtttatggaatacctagacaagttcgtagtggtctttatagatgacattcttatctactctcgaaccaaagaagagcatgaagaacatcttcgccttgcattggagaagctacgagagcatcaactgtatgctaagtttagcaagtgtgaattttggttgtctgaagtgaagttccttggtcacgtcatctcagcaggaggagttgccgttgatcctagtaatgtggaacccgtaaccaactggaaacaaccgaagacagtttcagagattcgcagttttctaggcctcgcaggatattaccagaggtttatagagaatttttccaagattgctaagcccatgacacgattgcttcagaaagatgtgaagtacaagtggtcggaagaatgtgagcagagttttcaagagttgaaaaatcgcttaatatcagctcctattttgattttacctgatccaaagaaaggtttccaagtgtattgcgatgcatccaaacttgggttaggttgtgttttgatgcaagatgggaaggtggttgcctatgcatctcgtcagttacgtccgcatgagaagaactaccctactcatgatcttgagttagctgcagtagttcatgcgttgaagatttggcgtcattatcttttcggtactcgtacggagatgtacaccgatcacaagagtttaaagtatatttttactcagccggatctgaacatgagacaacggagatggttggaattaattaaggattatgacatgggaattcattatcacccgggaaaggctaatgttgtagcagacgctcttagcaggaaaggctattgcaatgctaccgaaggacgacagttgccattggaattatgcaaggaatttgaaagattaaatttgggaattgtcagtagaggtttcgttgcagctttagaagcgaagcccactctaattgatcaagtcagagaagcccaaattaatgatccggatattcaagaaatcaagaagaatatgagaagaggaaaagctatcggtttcttggaggatgagcaaggaactgtatggttgggtgaaagaatttgtgttcccgacaacaaagacttaaaagatgcaattctgaaagaagctcatgatactttatactccattcaccctggtagtactaaaatgtaccaggatctcaaggaaagattttggtgggcaagtatgaagcgtgaaatcgcagaatatgtagcagtatgtgatgtttgtcagcgagtcaaggcagaacatcagaaacctgccggtttgctacagcctttgaagattcctgaatggaagtgggaagaaatcggtatggattttatcactggtttacccagaacgtcatcaggccattactctatttgggtaatagtcgacagacttaccaaagtggctcatttcattccggtaaagacaacttattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaattttagtactgcttatcatccgcagacagacggacaaaccgaaagggtgaatcagattttggaagacatgttgagagcttgtgctttagacttcggtggaagttgggataagaatctaccctatgtagaattttcgtacaacaacagttatcaagctagtcttcagatggctccttacgaagcactgtatggtcggaagtgtcgcactccgcttctgtgggagcaaacgggagaacgtcaggttttcgagacggatatcctaagggaagcagaagaaaaggtgaaaatcattcaggaaagattgcgagtggctcagtctcgtcataagagttatgccgacaatcgccgtagagatttgagttttgaagaaggagattatgtgtatcttcgtgtcacgccttttcgaggagttcatcgttttcacaccaaaggaaaattggcaccgcgttttgtgggaccctataagattgtcagtagaagaggagaggttgcttatcagttggagttacctcaatctttggcaggagtccataatgtgttccatgtttcgcaattgaaaaagtgtttaagggtacctaccgaagaagctaatcttgaacagatagaagtccaagaggatctgacctatgttgagaaaccaatccgtatcttggaaataaatgagagaagaaccagaaatcgagttatccgtttttgcaaagtccaatggagtaatcactcggaagaagaatcaacttgggaacgagaagatgaattgaagtcagctcatccacatctgttcgccagttcttccgaatctcgaggacgagattctgtttaaggggggtaggtttgtcacaccctgaaaattcaaaatatataaattgttgtttaattggaatttttagaaataattttaaaaagtcttgaaaagaagatctaatttttaattaataaatttcaacataaaatgggcccagataaaatttccttaaatactttgcttaattctataattcctagatttttctgggatttatttgagctaagaaagtatttttaataaatggaattgcatttaagaaataatttaaattgaaaaaaggttttaaaaagtcttcttttggctttgggccgaaagtcggcccaaaacctctcttctctctcctcggcccagccggcccagtccgccgcagccgcgcgcgccctcgctgtcgctgacaggtggggcccacctgtcagtcgtcgtctacctttggccgccgccgccgaaaccctagtttcgcgccgccgccgtttccttccaaatccggccgcccctttccttctccggccgaatcaatagaggggaaacaatctccgggatctcctctaccttttctcctttggaatcttcggctaaatcggtttggaatgagttggattcgagttcgtctcggattcgttcttcccgatctttccttcctcgtcgccggtcgccgtgggccttcgccgccgcctccgagcccctttaaaaggacccccggtgtttcctctacccgtcgccaccttcgccttcgcctctcgtcgtcggaatcgctctagcgccgtgtgccctagcttcgccgtcgccgccgccgctccagccgtgctccgccgccgttccagacgtcgccgtcgctcgggaagaccgttgtcgtggtcgccaagtcgtcgccgtcctcgtccgccccttcgccgtcgccggagatcgtcggagcttcgtcgccgtcgacaacccgaaggtttccgccgtttcctcctcgtcgccgtcgtcgttcgttgtttttccgccgccgttttggtcaccggtgtgttcgccgcgtcgtcctctacgtgctggtgccctccgtttgcgtcctcgcgccgccgttcgccggcgagcgtgcgccgcccgagccgtccgctccgccgagccgccgccgctgtcggtgacgtcattgccgacgtcatcggggtcgtccgccgtgagccggtcgtggaccgttcgatctcggccgtccgttttggattggatcgatctcggccgtccgttcgcgtgaaccgccgcccatgcgcccggtccaccgaaaccctagccgctgacgcaataatccctcttttccttttcaaaaataattcattattgcgtcataattcaattttaaccgatttaagtgttttaatccgatttaatcttcaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccgaagagtccgttttcgccggagaagagtttgaagagttccaaggccagcaaggcaagtcacacagatcccaaacaaccctttgagcatgttgatcctatttaaagctgttgtttcttttcaactattgcatttattttcgaatgtcattgggtggaattaacctattgtttgttatagcccttttgttcttgattactttattccttgataccttgggatataatttgactagttgagctttatttatattggttcaactaaatattagatataattgcttagccctgcttagaaaccttagcacatttatgggataacttatgattcactattatttcatgatggtttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcgttgcggggcaccagactgagaagtggcggagataagcccacgggggtcgctggggagtccatgccttgtttataagggggtgattatgatccaggaaggtgcactgcagtggattgtgttatgcgaggggtattgtcacaactcctttccgaggtatcgtggtggtattgaggcacatggtgacatgatgtggggttgtgtcttgtgggtacagtggtacacctctgatcagagtaaaactattcgaatagccgtgcccgcggttatgggcgggtctaacaatgtctttcatgattagtctcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaagacagtgacggcgctccgcaagctctcctctagttccctccgtgtcacgcccagaaattcacgaaccagaatttctaagctgaatgtgtattaaacccctgtccaggaccagccagggtacacaaatgacaattgttgacatacatatccacgttttacaaaaatataagagattacaaatgcagcggaaaagataaaagcgagctaagcctgaagacttgactcctgcagcggacgactccattccacaggcatccttgacggcagcgacgaaaccaacctcttcgagacatcttcaactgagaaggacttcaactctggtgtgggggaaaagagagcaagactgagtattacccactgtactcagcaagtcataccggaagaggaggtatgatgcagggtatatccaagggaggctaaaggttcttttgcatgaagctagcatttaaaagcagttgttgaaagcagtaaaacaattgcgttaattaatcaatattaaccaatcactgctcaacgctacaccacgttgagacaggcccaaaccaccacctgaactaaccagttccaaaagataactaggggtgagactaatcacggtgaatctggtcgaccgcccataaccgcgggcacggctattcgaatagttttactctgatcagaggtgtacaactgtacccacaagacacagccccacgacacgttcctgtgcgccgacatgccaccacaacataccggaaagaggccgtgacaggacccttcgcataaccccctctaaccgatcgcaccacaccttagggttcgcccccgtccccagcaggcaacgggcagcccccctttcgtgcctcggtgaatccggaagccgatcaaccggacaccccggccgacccaactccatcacatccaccctcgcctgggtacgtcggctagagaaaagctacactacaagcccagccgttgcccacgctggcttgtggtaagtacgataagttcttccagggcatcccgtgaaccggtccttaattgccatgggcacgactagcaaaaccatgcacccacagcccaccatgacgtgtattttaattaaccaataccattacggtggcaccaaaccaaagctatgccgataatcaaagtctatgctttaatgtgattccctttttgtgtactagtagaactaagcatggctaagcatttcctaaaccaacatctagtcattttaatacccaagttatcaatggcgtaagggaaacaacataaagctgagtaataggacccatcccacatgatattgtaaaacgatgcaatatttaatagaaatacaggacatttgtaaattgggtacaatatgctcaattgtaatgtatgacttgccttgctctcgcactgatgagaccacagcaacgtcttcgagaaaccgcgaatcgacgaaacggccgaaatctacgcgacaaacaaagcacaccagcaaaacatgctataagactactgaaacaggaaacaaaaccatttttaatggattctacacatttttatgaatttactgagacttgaatggacttaatcggagctcggatgaattagttatgatttttagaagattatctgtgtttttactataaaagaaaaacccttaatcaatttattgcgcaataattcctcccagggctgacgtcagcaaggggtggggcggcgccgacatgcgggccccactggacagaggcacaagagagagggagagggggcggctggcaggcgggacccaccgggcggcggctcagggggggagacgcccggtcggctcggctcggcctcaaaccggccgaccggttatggcgagggcggcggcgcgcgagcacggtcgccggcgacggcaaccggcggcgggaggcggcggcggacggcgcaaaggcggcggcggcggcgcgcgcacggaggcagcggcgatagggagctcgggagcggacggcgaaagagggaaaaaggtggagagaggcgcggtggtcggttatatagaggtggggaggctggacgtggccgggagcggcggttccgcggcgacgacgtggagaggtggaggaggagagagagggggagaggattcaaatcgaatcccgtccgtgcgggcgcgcgcatggacgggagagggcagggcgtggggcggcgacgtggggacgtgtgggcgcggagtggggcgcggatgcggaggaagcggcggcgtgggcggcggtttcagcagcggatggtggcggctgccggaggttagggacgaccgacaggtgggccccacctgtcggcgcccgggaggagaggggaggtgggctggacttcggggaggggaggtgaagcgggccggcgcgggagggaatgggccgggctcaagaaaaaggaaaaaggagggaaaagaaaagataaaaaggaaaaaggattttcccagggatttatatattgcacatgctcatttttaattggttaaaattatttccaatgctctgaaaattccgctaaaaatcctgttagcgtattttgacatgtagaatccaagaaaaattccacatgccgaatccgattattatttgcatttattaatttagggtttctctcttgcctttaaacaaataatttcttccaaccatttattaattgaatttttgctagggaaataacttctgggcgcccgtcgccgctccgctcgcaccccgccgccgcgcttgccctccaccgttccgcccgccgcccattcgtcaagaaggatttgaggtccacgacggcgcgacgtcctgatcttcgagctcgtccgccgctcgcttcatcccctctaatactgcgtcgttggcaatcatgcgtcgcttcgtcgaggtccacgatagcggcggcggaggacactgatgttggcgaggcgaggccggagaacgtgacaagcgaggcggtgcagccgtggtgtgcgactaggcgctgcaacagctcagccatcggtatgacatggccggcgaaggggctgacgatgaggatgacgtgcggcggcggtgggcgatgtgacgacggaggcagctgagggatttgggggttctttttggtgcccagggctctactgaatgcaatgtagatggttagcttcggtcaaaccgggtatggaccttaatgagtcacttaaacaagatggtggacctagatgtgcaatttacaagattatggacctaagtgacacccgcgcacaactttaaggaatggtagtgtattttactctatataaaaaaagaggggcgatcctaaacgtagaaaaaaccacctcctcctattatgctatgaattatcttaagaaagataattcatagaaaaaaagctgctcatgagaatatagaaaaacatgctttttctatcttgtggcttctaacacattattttaatttcatagttatattgatgggaatttaggtgaaaaatttctaccgtctagagagccataaattatggaaaatgttgtattactataaactctcccgaacaaggacgaaggagtgcaagcagcttaaaatccacataacttccttaacgcctcgttattttctgattaagttacagatcttacccactactacaaaacattaaataggtgttgccactatagatactgaaagtactaaaaccagcacctataggccttttccaatttccgcgggttgaaattgcaaaaaccggcacctttaagcaattataagtgccggttctaaataagaaccgacacctattctataggtgtcggaccgacacctataatatattataggtgccggttttttaaaaaacgacacccacagaaatctagccgaggcggcatcggatgagccaaccagcgggccccaccacaacgaggcgaggaggagataaggttcgctctcgcgtcatctcgctctcttctctctctccctcccttctctctcatctctatcttctctctctccctcccttctctcccgctaccggcggaggcggcagcggcgaccgcgcccttccctcgctagatctagcgggaggggaggtggcggtggcaggaagggaggcggtagcagggatcttgaggggagcccgtggtggcccgacggccaggggggaggcggcggcaacgccttcccctccgctagatccggctggaggggaggcagcggcgcctccgctccaccagatctggccgggaggggagtcagcaacggctcggcggcggcgggaggggcggcagcagcaagtggcgtggctcacaggcatcggcggcggcgacctcccatctgccaaatccggcgggagggaaggcagcagcggcggcggagccccccctccgccagatccggcggggtaggcagcggcaacgacagtggcgggctcccttgtctcttctaccactggtgagcacccccaaccatctcctttgcttgccggctgtgtcattgttgatgtttgattcgatgattcaataatgtttgatgtttgattcagtgatttaaacttgttgatgaatatttgattgtgtgatgtgtacttgtctttttttttttgatttttgatttttttttttggctttaaagaattggctcgactcaaatcgagccgatcgggcttttttttttttttttgcaaatcgtatacctcaaaggtgtcggttcctaaaccggcacctttgagtcatctcatcagtgccgccttggtggtgctggttgggaaaattggcacctaaggggatttcccaaccggcaccgaaggctctttctgtggtagtgaccctggttttgttagcacgtttttcaatctgctaggtgtatttcgtgcgaaaactttttatacataatttaagttgctttaaaatatcagataaatctattttttaagtgtataataattaaaagccaattaatcatatactaattaatggatttcttgttttcgtgtcctagctacttcatctttagtaaaaacgagcatcaccaaactatgttccccggactggttggagagtggatatattttaaactttcgagaagacgttcccttgttgtttacatatcactcaaaatagttattaaaaaatttaaaagatatattaatatataatatatcagtatttaaaattcaacttttacaagttgtaaaaaaaaagtacagctagttaatgtatattgatagtcattttttttttgcaacatgtagaagttaaatttaaccttgcatgtttgtttggtgatctatcatatattaatatatcttagtgactttttttaaaaaaaaaattaactatctttatataataaaagtccattaaacttcctacaatcactctcaagccgccacgtggcatcctaaaaatactcccgagtcgccacgtggcattctaataaaatagagaaatctgaccatcgattttcacttaaataggtgggcccattattttagatcgttagattatctttaaagaaaaaaaaccccctgccgtccctacctccgtgcaggatgcgtattgtacgctccctatcaccccttctttttttttctctttgtttctttcttctttttttatctttatgaaaaaaaatccctacaaatagacatcgtacgagtaagtccattaaacttcttagaaacgcttttaagccaccatatggctcctacaaacgctcttgagtcgccacgtggcgctctgataaattagagaaatctaagaaattccaataaaaaaaagaaaaacatcgtaccatttattttctctttacacaccattagatctatatatgtaaaaaacaaatgtcacgtacgaccacacctctccctaggtccctcatctcctaacatgtacgtgcatccaaagtacgtatgtctccccacccctctcttcttccttccatttatggtagcaaaattttgtatataaaaaacacaacaactaaataattagaatatcttataatatattcgattttaatttgaactatgtttaccatattttggtatgtacatatataagaaacatatcatttgacataaacccctttatcgcaactaaatagtaataaaatattacaaaaagtaacatatatcatgccattgtaaatgatctcctattatctctcgtgctcactttcttatccatattttctagcgagcagttcagtacataaagaaccaacaaatgctatattaactatctattatatacttaaaaattcattaaactccctacagatcctcttaaactgtcacatggttttctacaaacactcatgagatgccatgtagtgctcaaataaattaaaagttcctagaaattatgataaaaaaatcaaaccattgattttcctttaaataggtagatccaataattataactgctacatctcacaaaaataaatccggtacccccacctccacccctaccgtatgtgagcatgcatgtacgtacgtacctccaccgtcctactcatctctgggatccaattctcatatcctatttttaagataacttttcctattttctacctagcacataatatatagaaaaataataatagctaaatgatcatgactctcaagttacatgtacttttctcagtttatttgactttttgtgttatttataattaaattcaagacccatattgcacatatttactatatataagttagataatactgctatctaactacaaatatttgagcaaaatagcacttcgaaaatgatgaatgaattcaaatgtgtgggtctaaagtccaagttcaatcatcaccaaagaagcttggaaccagaatgcacactctgggcctgaacccgatgaaggcggagctataagacattattagcaaggtggacactgacggcagcggcatcatcgacttctacaagttcctggacctaatagcgcactaaatgattagatgaaggacaaggactaagaggaggggaccagagggagacgttccatgtcttcgacaaggactagaaaacagcttcatctttgccaccgagccccaccacgtcatgtctaatgtatcaagagaggctcactgatgaggaggtcaacaatgatccgcaaggctaatggtgacaggtggatcaccacaaggagtttgtaattaaattcagaacaaaaatataaaacaagcaatttgattaaaatacacaaacaaaaaataaaaaacactaaaactataaaaaaaaaataacaagattccatgtagaatataaaatatcaagagtccctataaaagtataagttataaatatctaaaatttggaataataaaataagtattaaaaaaagagatcaaatacagcacgatatgagattaagcgcaatttaaaatccctaaaaagacaatttagaataaagtaatttgatttgaatacaaagtcgaattaagaatcactcaatcactaaattcagaatacaataaatattttttaaagaatttttctatctttattgattcacatgcataacaaattgcatatatatgaagcaattaaagagagggctagcagaatggtaaaaatatatatttattaccaatgaaagtttatcgagatttcttcacgaaaaagagatataataaatactcaattaacagtagagaatacattactttaattttggatagactagttcttccatgctttgcttgctctcccttgtgaacacagagtacactcctctaaactaccaagtctcacttaagtcgacggcctccacacttcagtgaatccactccccaattaggaagactctacgcactgactcgttgctccaagtcaagctggtatcaccgtgcgcaccgacgccggccggccgcggcggcgatggctggctttccgctgatcacatcagcgatcacttgcgcagtgggcatcatcttcttctccgtttgctacctgcatccggcaccggtcgccgccttgtacttcaactactccaccttcagccaggacgacgggaacaccatcagactcgaaggcgacgcctccttcggcgacgggtggatcgacatcagcgccaacaggtacggccacaggggacacagcaaaggccgggcatcgtacagcgcccggccgatgctcctctggagcagggacaccggcgaggttgccagcttcaccacgcgcttctccttcaacatcaccccgcccaaagaggacggcggcatcgacaacaagggcaccggcatggccttcttcctcgccgcctacccgtccatgctcccgagcggggtcgatgagctcggctacaacatcggtctcaccgaccaaggcccggacgccgtggcgactggcgacagccggttcgtcgcggtggagttcgacaccttcaacaacaccatggtgcacgaccccgacgccacctacgaccacctcggcatcgatgtcaactcagtcgtgtccaacaagaccttgaccttgcccagcttcaccctcgtcgggaacatgaccgccgtcgtcgagtacgacaacgtctccagcatcctggccatgaggctgcacctcggctatgggcttagtggcccccgtcaccggccggattacaaccttagctacaaggttgacctcaagagcgtgctgccggagctggtctccgttggcttctccgcctccacgaccacatcctttgagctgcatcagctgcattcatggtatttcagctcatcgttggaaccaaaggccgcggtgcgtggcagagttgtagcgggagccaccgttggcacggtaatgttcgtcatactcctcttcgccatggtagcagtccttgtacgacaacgtcagagcaagaagagggagacagaggaggcaaagaacggaggcatggatggcagcgacgacgacgatgacgacgacggcgagaccatcgtagagatcgagatggggacggggccaaggcgatttccatactacgaacttgtcgaggcgaccaagagtttcgcggcggaggagaagcttgggcaaggcggtttcggcacagtgtatcggggctacctcagagagcagggcctcgccgtcgccataaagagattcaccaaagattcctccaagcaaggcaggaaggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaacttaattggcgaacatattgtcaaattttactcaggtttacgaacttgctaagtgcacatcgagatctctaaacttggtttagagtatcatctcggtccaaagccgcgtttgaccgtgctcttgcctatgtgacacgccacatagacgatgacatggaattttttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtctccacactactgccactgcaaacagtgtacgcattgactcgatcaatcaacggggagggaacacaacacggcggccatcgatggccggcgttttgcagatcacatcgtcgacgaccaccacgaggtacaatattgtcggcctcatcttcttcttctccgtcttctgcgacgatctctactcgccggctccagtcgccttggccttgaccttcaaccacaccaacttcggcccggacgagcagacgaacatcaggctggaaggcgacgccgccttcagcgccgacttctccttcagcggcgacggcggcgggtgggtcgacatcagcgccaacaggcacggcagcatcgaagacagccgtggcagggtgtcgtacgcccttccggtccctctctgggacgccgccaccggcgaggttgccagcttcaccaccggcttctccttcgtcatcaacccgcccaaacaggacggcggcatcgacaacaagggcgccggcatggccttcttcctcgccggcttcccgtcgaggctccccggctcctacccctacaacctcggcctcaccaaccagaccgccgaccaggtggccgccggcgacgaccggttcgtcgccgtggagttcgacaccttcaacgacaccatcgtgcacgaccccgacgccacctacgaccacctcggcgtcgacgtcaactccgtcgtgtccaagacgaccttgaccttgcccagcttcaccctcgtcgggaacatgaccgccgtcgtcgagtacgacaacgtctccagcatcctggccatgaggctgcacctcggctatgggcttagtggcccccgtcaccggccggattacaaccttagctacaaggttgacctcaagagcgtgttgccggagcaggtcgccgtcggcttctccgccgcgacgtccacatccgtcgagctgcatcagctacgttcatggtacttcagctcgtcgctggaacccaaggccgcaccgccaccggtggcgccgccgtcaccgtcaccaccgcctacctccggttcaggaagtggcggggttgtagcgggagccaccgtcggcgcagcactgttcgtcgtgctcctcttggccatggtagcagtcgtcgtactcgtacgacgacgacatcagaggaagaagatgagggaggcggaggaggcgaacgacgacgacgatgacacggaaggcgatcccatcatggagatcgagaacgggacggggccgaggcggttcgcgtaccatgtgctcgtcaacgcaaccaagagcttcgcggcggaggagaagcttggccagggcggattcggcgcagtgtaccggggctatctaagagagcagggcctcgccgtcgccattaagaggttcatcaaagattcctccaaccaagggaggagggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaacttaattgacgaacatattgtcaaatttaactcaagtgatcagctaacttctattttgtcacagggtcaagattattcttgggctcggatcagccctattctaccttcatgaggagtgggagcaatgtgtcgtacaccgtgacatcaagccaagcaatgtcatgttggatgagtccttcaatgccaaactaggtgacttcggacttgcaaggttcattgatcacatcgtggggatgcagacaatgactgcagtctctgggacaccgggctatgttgatcctgaatgcgtgatcaccggcagagcaagcgcagaatccgacgtttatagcttcggcattgtcctactggaggtggcgtgcgggaggaggccgatgagcttactagacagccagaagaatggtatcttccggttggtcgagtgggcttgggatttgtacggcaagggagacattctcatggccgctgatgagcggctcaacggcgactacgacgcggcggagatggagcgtgtcattgtcatcgggctctggtgcgcacaccctgatccgaacgcgcgtccgtctatcagaaatgccatggctatgctccaatccggtgggcaactgccagtgttgccggctaagatgcccgtgccgatgtacattcctccagtggtctctgtagatgagctcttcacgtcgcctgcagggatgtcatcctcaagtgcgacgcagtcatcaacaacaacggtgagtggctacgcaacccacatctcgacttcttctgacacatccacttcagctggttcgaaggactcgtcttcgttgctcaaacatcagttctagtaatgttcagttcatttgagttgttcttgattttacagtagttgatgcttggatgggatgttcagctcgtcagcgcccgttgatttgatctttagacttttgcttaattgccggtgtgagtaatctggtatttacgccatgctttgaacttttacagtcattttaagtttgtctacaaatatgtatgtataaatgtataatgccacatttctattcattcagattgccgatatacctaacagctcgttctttcgatcgtccgcttgctagaagccagttaatgttctgggcctcaggcccattagtagagtaggcctccatcctccttattgccttcaccatcaggcccatagtacaaagttaggctgggccatagcctgcaggcaaagttgctttaatcaattcctagtgattttgctatatactgtatttattagcaaattttctcccaaaatattgacatgtaaatataatataattatagtgtaactacatcgttagatttgcttcaagattcgtactaacgagagaaaaaaatcacaccgcatacacatctggggattcggtcacatgacctccattttatagaaatagcatattactaagagatttttaaaagttacatacaagttaaattttagttttatgtaaattaaaatgtattgtactatttattttatctaccaaaatttttgaagaaaatttataaacgaatatataggtagtaccattagaggaagctattagcagagaccttgagacattgactggtctctcttgagtagatagatatatatgtactttttttttccagcatcactctcgatcaatcagtggatggctacaataattttagataggatagtgctagtccttgacttatggtctcctgaaagcaactactacttgctactacaatagtttcagtcttcatataggctcctgtagtccttcgacttgcggtttcatgtgcattgcacctagctctactatcaatggtgattggtgatcagatgtgtttgtgttttggatatatatatctagatatcggtgcctaactttatacggtagtataattttttaaaggtagaggacaacaataatttatactatcaattattcaaaggatttttataactttgtgtcgttagaacgaaaccagtgcacgtgcttaaaatcaacatcagcataggctcattatattcctcgaagtctagaaaattaatcaaaccaatgttcatggaggcaatggttaattttcagtcacaattttgagaagtttgggcgcaccataaaaaaaataaaatacaccagcagttcttaaactagttaggaggtttcactcaggtttacgaacttgctaagtgcacatcgagatctctaaacttggtttactgtatcatctcggttcaaagccgcgtttgaccgtggtcttgcctatgtgacacgccacatggacgatgacatggaattcttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtctccacactactgccactgcaaacagtatacgcattgactctattaatcagcgggggagggaacacggtggcgatcgatggccggcgtcttgccggcaaccaccacgacgaacaatattgtcgggctcatcttcttctgtcagatcgtcatctgacagtgctgaggaagatactgaagaagaactgagcttggaagcagagcaggacgatgatgagaagatgcaagctgaagctgaagatgcagagcagggaggagttatggaccatcaacccgcgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgccatatatcttgttgctgttctgtgattgttctagttagattagatcctaacaatctggtatcagagcctcaatttgtctcgaaatcctcttgattttgctgtaaaattccttgcaagggattggaaccgacttcggttggattccgcgaaaaggaaacttgcccttctaggttagcgaaattcggagagtagacaagttcaggcctcggatccaggagtagcgccatggatacggatgggaagcttgatgtgttgctcaagttggtggaggggaacgagaagaagcgggtggaagcggatgagtgtacgagggcggagtaccaagagctcaagaagacggtggaatccagaattcctgtggttgagaagaaggtggaggtgttgagcgaggcgttgctcgagctgaatctcaaggtgaaccgcttggagggatagatgcagaggacagttaaggaagaagttcctcaaggcaaggttgctgatccgaaaccgaccacaccatctggtatgcgagatcttcacctgttttcctctgcttctactttcggaaacaattctaggaagtctgatcaaggaggtgaaattcccatggacattagtgctaacggtccacccatggtttgtccacaattcaatggtgataaccctcagatgtggaaatcaaattgtgagcaatattttgaagtttatggcacacatcctatcaattgggtaaaaattgcaaccctgaatttcgtgggcaatgctgcgttctggatgcaatctgttaggtctcaactgcagggaattacttgggtggggttatgtgaattggtgtgtagcaggtttgctaaagataggcatcaggcactgattcgccaatggattcatatttctcagactgggtcagtgagtgagtatgtggaaaaatttgatgggttaatgcaccaactaatggcctatgattcatcattagttcctgtttattttttcaccaagtttgtggaatgattgaaagatgagataagagtagtggttatggttcagaggccccaggatttagattctgcttgtgccatagccctgctgcaggaggaagctttagaaggtgttaaggccagtcattacaggaggtcagacccaggggttatgctcaaaacaaatagaactggacctattgtgggagttactcagcatactaagaacaatttgaatcaatctgaagacagaaggggcactgaatctgctagagctaaagatgataaggtggctgctctgagggcttataggaggtccaagggactatgctttgtctgtggagaacgatggggtaaagaacataagtgtgcaactacagttcagcttcatgtagtggaacaactgttggcagtgttacaacctgaaattgacagtgattctgataacattgaattgggaacatcaccagaacaacatggcactttattgaccatatctcaacaagctctgtggggaactgaatcaaatcagtctatcaaggtgaatggttgggtgcagggaatggaactgatcatgcttattgactcaggcagcacacattcgtttgtggatgaacaaattgcacttaagttgatgggagctagaaggttgcaacaacccctaactgttagaattgctgatggaggtgtcatgcagtgcactagggaaattgctgactgtcgttggtggatgcagggacagagtttctgcagtaatttccgactgctacccctgggaaattatgatgccatattgggtatggactggctcacaatgcacagcccaatgaaggtagactgggttcaaaaatggatggaattccaatacctgggaagggatgttcgaattcaaggaattactaatcagccagcacagtgttctcatataacacacaaccagttatctggcatgaacaggaagggttcactgttgtattttatccagttacaaaatatggccatacaggagaatagcactatttctgattcagtcaaacctatgttgttagagtttgctgacctctttgaggaaccaactgaattacctccgagaagagcttgtgatcacagcattaacctcattccaggggctaaacccattaatctgagaccttataggcacaatcctgctctcaaggatgaaatagagaggcagatagctgagatgctcaagtctggggtgattcaacccagccaaagtcctttttcttccccagctatacttgtcaagaaaaaagaccacacttggagattggtaatagattacagaaagttgaatgccattacagtcaaaacaaaatatctagttccagtgatggaggaactactggatgaactatctggttcaaaatggtttaccaagctggacttaagatcaggttatcaccaaattagaatggctgagggagaggaacacaaaacagcctttcaaactcattctgggcactatgaatataaggtgatgtcttttggcttgactggggcacctgcaacatttttgggggctatgaatgacactctaaaatatgtacttagaaaattcgtcctggttttctttgacgatatcctgatctatagtccagattttgagtcacatttgactcatgtcagacaagtcttacaactacttcagcaatatcagtggaaggttaaattaagcaaatgttcttttgcttagtcacagttatcttatttgggccacatcatcggtgcaaatggggttgcaactgatccacaaaaggttcaggatatactcaattgggagattcctaccaatgttaagaagttgagaggatttctgggattggctggttattacagaaaatttgtacaaggctttggtctgaaaagtaaacctctgaccaatcttttgaggaagggtgttccttttgtttggagtacagaagcagattcagccttccaggctcttaagacatctctggcctcagctcctgtcttggctttaccaaattttcaaaaaacctttgtggtggaaactgatgctagtgactatggaatcggtgcagtactatcacaggagaagcacccaattgcctatataagcaaagccctgggtcccaggaccagaggtctgtccacttatgaaaaggagtgcctagcaatgatcatggcagttgatcactggaggtcttacctgcaacatgttgagtttataatactcactgatcaccacagtctcatgcacctatcagaccaaagactccacaccccctggcaacataaggccttcacaaagttactgggtttacaatacaagatttgttacagaaaggggagtactaatgctgctgcagatgctctttctagaaaaccacagcaatctgaggaagagttcaatgctatttctcagtgtgttcctcaatggctgatggaagttttgcagagctatgatactgatccacatgctactcagttagttgctgccctgacacttaaccctaattctaagcctcatttttcacttcagcatggagtcttgagatataagggaaatatttggataggcaacagtcctgacttgcaacttaaaatcattaatgagatgcatgccagtccagtaggagggcactctggatttccagtgacttacagaagaatcaaacaattatttgcctggaatggaatgaaatcccaaattaaggaaacacttgccaattgtcaaatttgtgctcaagcaaaaccggatagatcaaggtatccaagactattgcagcctttaccagtccctaaaggtgcttggcagactatatcattggatttcattgaagggcttcccaggtccagtcactacaattgcatcttagtagtagtggacaaattttctaaatactcccacttcatacccttgagacatcctttcactgcaattgatgtagcaaaggccttcatgagtaatgtgtacaaactccatggacttccacaaattatcatctctgacagagataaaatttttacaagccaattgtgggagcagttatttctgagatctggcactaaattacattacagttctgcttatcaccctcaatcagatggacaaacagaacgaggaaatcaatgcctggaaatatatttgaaatgctttgtccagtcagcaccttccaaatggccttcttggttgcatttagctgagtactggtataacaactcataccattcaactattgacagaactccatttgaagccctgtatggatatccacctcgccattttgggatcagcatcagggactgtgacaacagtgagttgataacttggatgcaggatagaaaattgatgcaacagttagttcaacaacatctgcatcgtgcacagcaacaaatgaaactttttgctgataagaaaagaagttttcgacagttccaggtgggtgagtgggtctatctcaagttacagccctatgtgcaaagttcagtggcccccagagcgaatcacaagctggctttcaaatattttggaccatttcaaatcctggagaagttgggtactgttgcttacaaacttcagttgccagccacaagttccattcatccagtctttcatgtatcacttttaaaggaagcaaaggggttccagccatcagtgcatacaccattatctccaacttactctgctgtccagtatcctatagcattactggatcatcgtcttaccaaaaaaggtaaccatactgttcaccaggttctaactcattggtctgacactattccagcacaagctacctgggaggatctgcatgacttgaaggccagatttcctaatgctttggcttggggacaagccaaaactcaaggggaagggattgtcagatcgtcatctgacagtgctgaggaagatactgaagaagaactgagcttggaagcagagcaggacgatgatgagaagatgcaagctgaagctgaagatgcagagcagggaggagttatggaccatcaacccgtgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgccatatatcttgttgctgttctgtgattgttctagttagattagatcctaacatcttcttcttgtccgtcttctgcgacgatctctactcgccggctctagtcgtcgtggccttgaccttcaaccacaccaacttcggcccggacgagcagacgaacatcaggcttgaaggcgacgcggccttcagcgccgacgtctccttcagcggcgacggtggcgggtgggttgacatcagcgccaacaggctcgacggcaacatcgaccacagccgtggcagggtgtcgtacgcccttccggtacctctctgggacgccgccaccggcgaggttgccagcttcaccaccggcttctccttcgtcatcaacccgccaaaagaggacggcggcatcaacaacaagggcgccggcatggccttcttcctcgccggcttcccgtcgaggctcccgtccgccggctcctacgcctacaacctcggcctcaccaaccagactgccgactaggtggccgccggcgacgaccggttcgtcgccatggagttcgacaccttcaacgacaccatcgtgcacgaccccgacgccacctacgaccacctcggcgtcgacgtcaactccgtcgtgtccaagaggatcttgaccttgccaagcttcaccctcgtcgggaacatgaccgccgtcgtcgagtacgacaacgtctccagcatcctggccatgaggctgcacctcggctatgggcttagtggcccccgtcaccggccggattacaaccttagctacaaggttgacctcaagagcgtgttgccggagcaggtcgccgtcggcttctccgccgcgacgtccacatccgtcgagctgcatcagctacgttcatggtacttcagctcgtcgctggaacccaaggccacaccgccaccagtggcgccgccgtcaccgtcaccaccgcctacctccggttcaggaagtggcggggttgtagcgggagccatcgtcggcgcagcactgttcgtcgtgctcctctttgccatggtagcagtcgtcgtactcgtacgacgacgacatcagaggaagaagatgagggaggcggaggaggcgaacgacgacgacgatgacacggaaggcgatcccatcatggagatcgagaacgggatggggccgaggcggttcgcgtaccatgtgctcgtcaacgcaaccaagagcttcgcggcggaggagaagcttggccagggcggattcggcgcagtgtaccggggctatctaagagagcagggcctcgccgtcgccattaagaggttcatcaaagattcctccaaccaagggaggagggagtacaagtcagagatcaaggtcataagccggctgcgccaccgcaatctggttcagctcatcggctggttccatggccgcaacgagctcctcctcgtctacgagctcgtccccaaccgcagccttgacgtccatctctacggcaatggtaccttcctcacatggccaatgaggtaattgatttccctaattcattagaatttttgctaatgtgcaattgacaaatggccatgaactgatcagttattgggtttggatgttgcaggatcaacattgttattgggctcggatccgccctgctctacctccatgaggagtgggagcaatgtgttgtgcaccgtgacatcaagccaagcaatgtcatgctggatgaatccttcaatacgaagctaggtgacttcggcctcgcaaggctcattgaccatgctgatggggtacagacaatgacgcacccctctgggacgcccggctatattgaccccgaatgtgtgatcactggtaaagcaagtgccgaatctgatgtctacagttttggggttgttttattagaagtggtatgtgcaaggagaccaatgagtctactggatgatcaaaataatggtctcttccgactagtcgagtgggtctgggatctatacggccagggagccattcacaacgcagctgacaagcggctcaacaatgactatgatgtggttgagatggagcgtgtcattgctgtcgggctctggtgtgcgcatccagaccgatgccagcggccatcaatcagagctgctatgatggtcctccagtccagtggaccaatgccgatgctaccagccaagatgcccgtggcaacatatgcaccgccggtggcctcatcggaggggcagctctcgtcatcgacgggtatgtcatcatcaagtttgacacaaacagcaatcacacctcgttaggggcataagtttgcccacttgtggtacaaaaataatccatgccattagattataaatgcacttgccttctacttattctcatttcagattgataaactgtaaaccaaatgaattagcatgggtcagccggcggataccttgagcagggatccttttctcagggatgccgctctcggtgaaatctagctagagatttaaattgcaaacaatgtttgactggatttgaatcaatttgaacaaaattcaagaaggacatgctcattgttgatagatgtcatacgataatcggcaaaatggaggcggacaactgcatagaacattacctactaaacttaggttttatccaaatgcatccccatctctgactgacaccaaagtatgtaacctcgaacgatatagaacacatggaacatcatcacaaaaagcatatcagtaattttgtaccacaccactaaaattcagaacaagaggtcacaaaatatattttgatacatggttcgagttgctgctatcattgtcagcatttcgtcaagcaaatagatgaattggaacttccagtgctgtttccagtcttcgttaccatggaagagcgaagtctaatgtttgtttcaagacaaaaaaaaaaggtaaactcaatcagaaaaagaaaaggtagatgaaagagagtacttttatggtacattctactgctagtatatactaccagtatatgaagggtagttttggtattagggaaaaatctgaaaagggctttttggtcatttaaattagagaagtattttcaccgggattaattttccttcggttgtttggatatcatcatccgcgtgataccgcttcttctggatacatctcgcgtcgctgctccttctgcagctccgcctgcccatcgcctcactcaagaactagggttttgggtcgctggaaaagacatgagaggaaaggatgagggaaattgattcgattcccgatggcggcggcgcggcggcgctcgcaagaggaagacatcggcgacgcatgggcggccatggatcagatttgactagtgaggaaacgtgaaatcataaaattacccccacacaattagataaaaagacaaatatacccttttcaatttatactgcagaataattagaagggggatcggatgaattttcgaccgttagattaaatatactggtagtatatactagtagtagaatgtaccataaaaatcctcatgaaagaaggcacctctttcaagttgaaactcctgaaagctataaagagtaaacaagcaccaaaaatggttgctataataattggctgtaactcttttgagtaaaggccgggatgctattttattccattatctaaaaaaatatattttcacatgggaactgaaacacaacagataaatgcgcagctcaaagtcaaatgcaaacaatatgaaacaacaatggtggtgtaaacaacaggaacctcgatataataaaagtggagcatggccactgcctactgtaaacaggatagcctgcaacaatttactactacagagttattcaaatgcaattttctcaaattacggatatttatgttcgacactttggttttgacttcagaatcaaggtcatcgaaagcagaaaaaaaaaacattaacgcacaaaacattagagcacgatagtccacccaaattgtaagatttaagaaatagtcaatcattcagcaagcatgtcacccaggactgatagctctgccacttcacggagtgatcaaactaaatttggaaataaaagagttgattcttatagtgtcagcagtggttctgctgttgcaatttcctcaacaatttctgatcaaaagtgtgaaatcatagtcatgattaatatttgtaatgaataattggctttgcaaaatgatttattcgaagaattggtttgagagtatgtgtgaatgttggtgtgagtgcgtgtgactaatttgggtcaggttgtgatatctgtgcccagaaacggttgttttgtctgattgtgtgcaggtgacttgaggtcagccttggtcaatggtgaggaccgaaactatgctcagggtggagcagaggtctagtgcggtcatgataccatgtgagaaggtgactagagtcaggattcttggtgaacaacttcggtcaacggtggggatctgaaacgctccgcttttcgtgaggcgttaaaaactaactcggcaaaatcctaattgcgaaaattttcgttctctgtgtgagagtctaagttgtgccaaggatcccaatttaatcccgttgttccctctcatcgaaatcaaaaaaatcctccccctcatccaaattcctcttccgattcgagtctttgaaatcaaattctgaaattcaaatccttcctttgaatcctcgccaaatacttctacgaatccagaattattcaaatcccgcctcgaatcctttccttgactccaccctatgttcccgagaacaaatacccaagtattccttttgaatcctttccatgacttctccttgagtttcccctgatacatccctaaaccctcgagtttgaatatcaaatttgaattcgaatccaaaccctaaatctctccaattctatccaaatcagttttctctgtaaaaatctactttacctccctatgtttttggatggaccgattctcctcccccggcccatctcccctcccagcccatcatctccccccctcgcacgtgcgttacacgcatgcgagccgagagagagccgtcgctcgctctctctgtttccctctctctctctctcgttcgatctccctctcctcggcgccgatttcccgccgtcgccgcccaaaacctccaccgccttcgcccattcccgcgcgcacctcgcgaggtggccgaccggcctgtcaccgccgacgccatgcgctgccgccttgccctcgctccatgccaaaccgaccgccgccgtcatcgtcgacgtcatccatgacccccccgccgctccacgccgcacccgtccaagagtgggagaagcagctgctctccctctcctcctcctcactctccctcccctcattatggcaagggaccaagcccctttttccccttctttttccctttcccgaccactgccggcgtcaccacctctgcgccgcttgaccgaccgcgccagcccgcgctccagcggttcgatttccgccgctcgatccaccgccttcgccactcaacgcatccacgccgtcgccgctttcgcaccgcccacgaaaccgccactaccgccagccgagcacttgaccgccaaggtcagttctcccctccccaaaccgacctcgtctccgctataaaaccaagccaccccaaaccccttcctctctcgttttcactcgcctcagtcctcacacccgccgcgccattgccgccgaaccaccgtcgccgccttgttgctgctcgtcccgctctcgccgttgccgtccgttgccgaagcaccggaggagccggtgcgtgggtgacgaggagctccgggcaccacctctccctcccttcttccccggccgcgccctctcggtgccgtgccgcctcggcgtcgcgaacacctcgccgcgacaccgaccgcgccgccaatgctgcctcctcttcgattggtgagctccccaccataatcctcctcctgccgcgcgatgcgccgcgcccgccgccgctcgccatagctcgccacgcgctcttgctctgtcccggaggccgcctctcgtcgccagccaatctcggtgccgctccgtccaatccgacgccggaaacggattccttgaaccccggagatgctcccacccctttgaatcgaaccctcgtcgtctcgtcgtgttttccccttttgatctccggtgattgccgccgccgcaatccaccgtcgtcggctcctctcgcgtcgattcctctcgccgccacgctcccggggatccccatgacctccccctggctgccccaaggccgtcggccttctcctttgtctccgcgccgtgtcgccgcttccgccgccgcctaacgccgccgtgcgtgcgccgccggtgaccatcgggtcccgcgtcaccgcgtgcgcgtcgcaacaccataccggttcggctaagcccgagcccgcgcacccttcgctcttctcgcgcgcggccacgtcggcgtgctggcgagcttggtcgccgccgccagccaccgtcatacctcccctctcaaatccgtgccgttaaacggattccccctgacctcctctagctgccggcggtggccgctcgctccggttcgccgtcgctcgccggaacgcctcgcgcgtcgtcggccgtccgatcccgggcacctcctcctcctcctccttccctttcgcccctgcccgcgtggccgaccacgtggcagccacctcagccccgggcccgcttgactgggtcaagtcgcgcccagtcagcctcctccctccgtcttccctcccatgcgcgcggtccacggcaagccgtgcggctgcacgtgggcccgccgccatccgtccacccggcgcgccgcgcccgaactgcgcgcatccgaaaccctagcgcccgcctccgcgtgcaccctccccaccgtgaacccaaccaccgccatctgggtcccgcgcggtggaccgcgcccaccccgacgggcctccctctctccccgcgcgccctcatgggccgcctcctcgcgcccgcgccggcccatttggtttggccgagccgcgttagcctttgggccgcaccaatgccaccgaaacaagtctaatatacatccctccttgatttcctttttccacccttgttccataaatcaattccttattccaaaattccatgaatcattttccttggtcccggattcaatgactgtcaataatattcttgagaatattatttctataaattccataaatcatctctcctattccagaaactccaattaaactttcaaaattcatatcacccaattcgcaactccgattgactccattccacttccaataattccgtaaattgagctctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccatttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagtttgatttgtgaacgcctaaaatggcctatgtttatgtgaggatttgatccttctatgtggcatgaggtaaccctgggtcggctcgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtttttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagctgattaatcaagtggaatggctctgggagccgagaagtaatgaactgacccgggaggtcggtacattaccaaatgagctgttgaaaaacatctcttaaagtcgaatcgagacgcaagtctcttttcgtcccaaacttagaaagaaataaatcacttagtgatttcaaaatgatttcaaacaaaagatttgcaaaacaaccttgcctctctgccaagcttgcattaaacacctaagttcccgtgacttgctgagtacgaaagtactcacccttgctctatataaatatatatatatagttcctccgccctgaagggaagataaagtgaagtgaagatttgggtttcgtcctggttcccagccgtcgcctgtggtgttgggtgttagaccgttggttccgctgctgctgctgctgttggtgttttcctcgtccgcgtcgtcggttgtattctcgggctgtctgagctgcaacctaagttaaggtaaataagtcctctatttattttaaggattgctatgattcatatttgtcaccatgggtaccagcactatgtcctgggactggtaccgagatcgcggtttcgtaggaagcggttcgcgccgttttccctacgacacgctcctgtcaggtgccgttgtacggcggtatcagattggggtgtgacaggatcgggactaaactcagggaggagttgaggtccagacagtcaaggataccgggtgacgaagttggatacgagatggcacacagtgaatggatatcgtgtgggagagatcttcgcaacgggcttcacgagatatgcgtgcaagtaccggtgttggcgaaggagattggagtgagaaattgaggaagagtatatggtgatatagtacacgtggtactgtagcatgcatatgtgtggtattgatcgatgcatgcaagtgtactgtagtggttggcagtacatggatgcatgtatgcatatacatgtgtgttggctcggtgagtccaaggcaggagcggcgctaaggcaggagaccgaggccgaccgggacttcgtatgagacggacatgtgtccatgtcgggtttgctatgacacggattgactgtagtcggttgtgaggctgcaggctttaggagactaatttggatagagtcatagtttgacgagtggtactcctatttcgagtaggagaattttcatgtataaatagagaggaagcgtgaggcttcccggtatcggttttaggaagctgagtttgagagattagatagggtttcgtgagaaacttttgaggggtgctgtggctgcaccttgtgaacaatatacttaagcaataaagatcatattcaatcatcaaggcattaacgatctattccggtttcgtaagttttacgtttatatttggttttggtattaacttgtgattgttcattttgctgcgattttgttcaagttaattcatccaaaacttttctaatacttcaaagatcagatctggaaagtttcgttgattggttctatttgatgatattttgtcacgtgcaaggaaaaattgcagtggccaaagcaagcaaataatgtgatccctatatgggatgttcagattgcatgcagagcagtacgagctgtgagcagcaaaccacaagagatcggccgggcagctggttgtatccatgcatgcaagcccgcacatacgcacgcatgggcttcaattacacctgcgtacactcgcatacgtgaccgtattttctagcaatacggccgcgtatatacatggaaaaacaaggagatgcgaagctacggtgtattttacgctatacggttaagttagctcatgcttgcccggatcaacaaattaaatttatgaagagataaaatttatctgaatgaattcaacacaatccttgcaagccacgcgcatacgaaagacggccttccgccggactctcaccggcccagcaacggaagagtggcaaggaatatcggaaaccgccatgacgcgctccggcggatgcgcacacgtacgagagttaaattctatcctgtaggcccatcagaaattaacagaaccaatatttgacgtcaggcggatcgaagagataagattaacaaaccgatcgattgatcaagtatatccgcacttctccaccgacctcaggcccctatataaggcgtcgacgtactctcggcagcctggaggccatggacgccgatcaatccataaacacccatcgacacacatgatcatccatctgtccatctcctcctggaagacaactatccaccggcgacctagctatccatcgaccggcaacgagcatcaagatgtgatctcggcggccggcgacctcgtccacagcacccctgtgtccggcaagaggcgcacatgaggaggaacaacgacatcttccttgggcagatcaaacgctgcaggagatcgtactcaaaccttcaggaggagagcaagtctctgtcgctttcttttctctcgtttcaggtgggagatgagcctgtacgcgacgccgccggggttatcgtggctgccatgactatttctgaaccatctccgctgccatcgagactcatccgcccgccgtcatccacattcatcaacatctccatctcatctcagatggactcatccattcatctacaaatcattcaagaagcgacaccaaagaaagtcttaatggccactacaggtaaagctaatttagattggttcctttcttttggttccagtgcctacgtgcatgcatggaggacggccgggtgtgctgccatcgccggagtcgtcgcgtagaccaatctgttgacgctgatcgcaagcctccgtcaagatcgatgccgctcgtcctcaagctctgatgttcgagctgccggtgacgatgaccctgctcattgctgcgatctcgcctagatgttggatgacgttgccttgccgaccgctgcctccactcggcgacgccgtggatgtctgctggccatcttcgacgatgctgccaccttcctcacactcatcgtcaaggcgctcgaggagaaggccggtcggagtgccgctacccggcactgcgacaccaccaacacccatctgccggagaagaccatcgtgatgccactccgcccgacgcgacgcgccggagatcgtcggagcagccgcggatgctgcctagtcacgctgatccagaagctcttgttgagaacaacacaacaacacggacgccgctgagctgcccgcgtccgtgaacaacatatcgtcatcacgccggtggccgcccacgccgtcctgatagagcagcgggaggccatctcgtccaccttattggcaacgcacagacgctcgccatccccgtcaagctgctggtgacactgtccgccgagtgccaccctgtcaaaggctgtcgttgtaccgacgccaagctctaaggacgccgccattgtgatctctactgtgtgaggacgtctcaccgagactcaggcgacgccttcacgctcgtcgcggtttcttcggtcaccatcaacgtctactcaatcatcttcgacggtgctaccaccttcctcacgctcatcatgaagccactcgaggagatcgccattcggagtgctgctgcccggtgcctgcacgccgtcttgccggagcgtaccacggatcgtcggagcacccgcggatcgacgttgccgagctgtcctgatccaggaggtctggacggagccgtcggggacgcccgccgagctgctcttgcacttaagctcgttacaattatcatgcaactgaggcactgccatgtagtgttcgttcttgccgatcaaacactgtcacactgcctgccggagcacgttggattacgccagagtgccattgctaggggcccgtacgccgtcatcaagactggccgtgattctttctcttcatcaagccgaggtcgttgtgccgtttgtccgcgacgctttcacttcatcatgctggagttgttcgtgatgtcacgtgaacatcacgtcggagcaccactgcttggtgcctataaaccatcgtcaagccggagtcgtcgtgccgtccgtccgtgacgtctccttctctctacaccgcatgatgagatgccatctgtctacgatgctttcacttcatcatgccaagatgagatattgtctgtccgtgatgctctccctcttcgtcgagatcaacgacgctgtattggagcgtcgctcgtccacatcaacataaagcaagaatggtgccgtttgtgatgtcagggaaccgttcatgccagatctacaccaataatttcctcgaccgttctgccgacaaggcatttacttctacaaaggtcgccgttgctaccggcaccctcatagagccccttttatgggctcgtcgtcatatcaactggatcaatagtagatccatcatccgaaggatgtgctatataagccacgttcgtccggctgctgtctgcactgacttcttcatcaacaccttcattacaaatccctgttgtataagggacatgacgggtcaggaggtgcccagccatgtttaatccggttgccgtctacacctactttcttcgtcaattcttcattactttgatcacatctagtcagaaggtgcccatccatgtttattcggctcttgtgtgcaccaactgacttcaccaactcatcttacctttaacaccattccgatgttgttgctatgacgtcgagccgtccaagctaggcgattccatgcgtgtcttcttcaaacaatctacaccgacacgtcgttcaagaccgacgaggctagacgacgagggtgcgcgaagccgacgctaaggctatgtcaccaacactggcgcacggaccgacgaggccgtggatgcgttgccggcgcccacatatatatcacacatcttcaccaacattcatcatccatggagaacgtgaagcaaagacgatgagacgaccacaagcagcttaatcgggggttctcctgcaggcctagacctgcggaggtaattaaccaggagcttctcgaggccctaggaaccagaagacaacatcgctgatgtcagatctgtccaacgacaggcaatggcacgtgtattttctattatacatggaaactgtatcttgataattcaattaataaagatcatgtgtttttgtgtctcttttatgtttattttacatttgtgtatttaggtacactggcacgtccgcacttattttctctctaaacatagagggacatattcgtatttttctaccctaaacaggttcttgttagatttgaatttgcttaagttttaggttttgttcagatttgctgaaattttgatagagctgattttcaagggtattttctcttaaaccgtttattagtttacaaatccctccggtggaattgttctttaggttgtttagtgtcaagtttgcaactcgatccaacggttggtttaagagaaatcgtgtttttaccgaagcgctgtcgtgttgttttcaggctgacggttagaccgcgagaggaccagcggtcagaccggtcaagcttcggtcagaccgaccctagtaggtcggatagaccgccaaacgtgtgttccattggcttttgtgggatgtgttttgatctattaagattcgattatttgacttccgttgacgtaatctaacattcacccctctctggtaggcttggttacttatgtttgattctaaaaaagcaatccgttggaccctatccttacaaaagaaagagcagatctggaaacataatatcacaacacagtagcgtgtaatccattctctttcacatttgtccttagccaggatcagatgcgcttttttaaacctatcaggaagatgattgcgaaaacagtgatgagaatgaattttgacagcaacagctccagttatttatacattccaaatctaaagttacaatagtttcagcaatttttcatccccaaaagtccctgcataaccaattctgaatgtccaagttagttattcaacactactgcagaagtgcagaattgagtcaccctaaagtgaggttgaagcccttaaattcctttattgaaaggggaataaaaaacacgccaaggcaataaatatgaagtaattctcacatagacgtcacaacaatccccatccagccatccttgaattctccatttgcagatagactagaacagctagcgcatgagagtatgtgttcaatggttatggttttgtgggtaaatacaaacatataggcaaagggataaatatgctgttctaaatttgtaaattagagtatcatcaacaaaaaaagcaatgcaatgatctccagggctaacaaacttcatcagacagaggacaaagaaggaaatttaacacaaatcaattatctcaggtcaaagaaggcgatttcaacattagacaagacaaaaggaaagcaatactactgtaaccaacaaccactaaggctatgtacatcctttgggtgcagagtaaggctgggaacatgatcctctgacgtagagcaatctaatctacgtcagaggaacctattacgccaggccacggacatactttaagtgcacaggccggaacaatcctttatttatgaaaaaccagacaaccactaccagctttcacattgattaccgacgtaaaggaatgcaaagcacgtgaccttaggagaggccgctccggtaggacgaatcggcggcgatgcacgaccgcagccttgccgccgccaccgcgctgtgcagcggcatcaaagaatccacgctcgccagcgccgctgccaccgccacgaaggacctgaaacagtcaggatctaggtactttgggcgtgacctgcggaggcggggaggagagaccggatgcttcgccgcctggaacgagctcgtaaccggagatctcgactggcgcgcggcggcgcggtagaaagacgccatcttgtttcgtcgtttgctgcggccttcggttgaggaagggaagaacaaaagctcaaaactgggcctgcgtttattgggccataaagggatcgcggtggcgtacatgagacccatttaagttggcccttcttgtggcccatatatacaatgggccagagatacctcgccgccacgggtaaccggaactaactgcggcggcggccgcgggggagcagcagaaactctgaaccagcagcaagctagcttcatgcttcaggcttcaagctttagttgctagcctgctacattgctcctcgttgcaaattgcaaacaggcgatggctgatctgatgcatctgatggcaacgggattagatcactgtagatgatccaaaaaccaatcgtttctctttgtggatttcagattcactagcatcaacttttgccctaatttcctccctccttttgacttgaactgtctccttaatttatcggagacgtttggttctcagctggatgagagtgaaactgatgaaatcatataaaacctattgcttttgcctacaacttttgcccccaggtactgtattactgttctactgttctctcaacagttgatcgatgccatctgcaccgtccaatctagcgtgtgtcaaggatccaaatatccaatatctcttccgcttctaccctcccgtgaccgtgagcagctcgagattagtttcttctcgaccatcgaaccctttcccgctgcttctgttcgccgccgccgtgctccagcgcctagggttttcttcgccgccggcgagtgctccagctcctagggtttcttcaccgccggcgagtgctccagctcccagccctgcgcgtcctcctcgccggacgctgccggtgacgtctgggccaagctaggtgcggccaccctcctcctccccccttcctttttcttgggtttcttccgcctcacgggttcttgattcttgaccttttcgttggtcttgggcccttggccattgcttgcacagcaggtctgtagtgccctccgattccgtgttcccggaggtggagctggccgaggacgacgccgtggtgtgctcccgggtcaccccggatggcggcggggaggtggtcgcgtggtgcaagattaggcgcggcggcgacgtgtcggcggcgacgatttggaatctgaggtatctgttgtgattggtggttggtttatccccttttcgctgctttgctcttctggactgtacatcgtaggcaagatgcgctttttttttttttgcaatcctgttttattggattgggggtacaaatgccattcattgatgatgcatgtttgggcgaaggctataaaatgcagaaaagttcttactgattgcgatggaatgcgagttgttgtcgtttggattatgtgaattgttgcggtgtcgcactatccaaaattaaagaaaggtttcctgtggataaaaaagattcaaatttcctaatgattccaaagtgcctcattttcttatccataagaccataataactcagtttccaaacttttgaacctgattgattttgagtcgtgctgatctgaaatcgatagatgtgagcccctgaagacagggaataggcagagtggccatgggtgagttttttcttttttagggggtggagggaactgtgttgcaaccttccgttaatccttttatcaaattctcgctgatgttagatgcctgtcttgtcatccttgtaatgtatgtttcattcgaccgctatcttacgttaacattatccatgtgccattgagaaagcttggatgcaattattgtcgatggaagagttatccagcaagaagcagttgacatcaaaccggggagtgaaattgttccagggccccagaaagatggtgagacaattatgtattttgagtttggcattttgtgcatagattggttgttatgtttatttagtggtcttgtattttttttaaatagactattttattcctttatgaagccaaatgagtgtttacacatgactctgaatatatgtactcattgagtcatttggaatgtttattgtttcctagacctttctgtttagaaagtgaaacttctatggttgcatgtttgtaattgtgcttctgaaaaatttaccaaattacaaatggttttccttttgtgatttcgttatgttggacaggtgaactgtaccactatgtaatgcatttatgctatccattttcttgcagggtatctgttgtacacctttgatataactggcctgaatgactaggacaaaaataatatcaaggtattttgttgaaatgaatgttgatcaacagcaataacctgggtgcataaaagtcactaacttctatttaaatgacgatgtcagattgtgctaggtattgagaatgcaaagtgcagcatatgcttaaatttgtgggatgatgttgttactgttgcttcatgcctccacaacttctggtacttttgccaattttcctagctacttttgatttatctcaaaattctgattggtgcttattcctgtattccttttaagcaatggctgcttctttgagtggttaagaaggtcttcagctaattcgcgtgataaaagttagagtgctgcctgtccacaatgtaggacgacagtgcaattagttggtgggaatcacttcctacataatattgaagaggtgtgatagttgggtgtgatgacttaactcctcaatactgtttaagtgctacatattgtacagctgagatgtttatttatagttctgcttttgtaggctatactgtaagttttttcatcgctacagcggtctgatgaggagattgcattgttggagtcatatgccccggtcaagacaaatattgtgagttcaaaatcttactaagaaattgttgattcccaccattttctcaatggattgtatcaagtgttgtgccagtctcatatttgccagcactgatatttgtccctgttatctgccataaaatcgaatattgttttaaaatcatcatctttttttcaacttgtaaaccttattttttttcctacaaactttgcccatgttactgtattactgtttaatcaacagctaatcaaggccatctacaccatccgatgtaccacgcggcaacgatccgtcccctcttctgcttctaccctcccgtgagctcgtggttgaaagttacatttgtcatgaatttggattatcattctattttgaagatatccttgattgataaatgcactgccatgtttcagataacattttattctcttatttcccccaattttccttccatttggcaattctcgtggtgttggtttgtctgtactgcactttgacacattatatttaatttacaagacttgccaggtgcctaggattgtctttagtattcaacttttgacaagataatagtggatgaaatgaaaatctgtttacaattagtactggcctcttaataaactaattagtaaaacaaaattccccaaatggtgggctcattccgttagtcgggtacttataattgtagaatttcctttcagtgcaggttgatctagaatcatggttctctctctaagtcctattttgcttatcgaatacttgcctcttaataaactaattagtaaaagaaaattccccaaatggtgggctgattccgttagtcgggtacttataatggcagaatttcctttcagtgcagtttgatctagaatcatggttctctctataggtcctattttgcttgtcgatgatattgttaaatgttgccatggaatgttagcatctgatacatgggcttctcatctatagacatgttgtgcttgtcattacctctaaccatatcatgttatttaatttatatcacatgattgaaaatgcattttagcatgaatgactcataacgatttagaattttctaacttacaattagcaaaccatggcagcacaatatggtatttcaaattttcatttagttgcactacttgagaatgagtttagtggtttggttggattgtctaagtgcaaatgttgctgtcatttgtgggaatcaggaaaatataaaatgccatatataatatcctctatattttagttcatagagagtatagtttccattcactcccaaagaaaatatgggtataatccggagcaaataatctggaagcagatatgaatatggatattttttgctggatatgaatacaaatactatgacgttggcgaaagggcttgtagcctagtggttacaagagcatcagtagcatctgaggtcctgggttcgactccccatgggagcgaattttccagaatttaacggcgttgtgctttcagtagtaggcgacgtacccgtcgacagcgaggctcctgtgtagtcttcgaagatgctcacaggggtagggtttgcgtgcgtgtgtttataggggtaattctaaaaaaaaaagaaaagaaaatactatgacgttgtttccagtggatggggatacaaataaagatgcatgcttattgtttttcaaccacatttgcttaagcaatgattggtctattccagtattactattgttggcccctttggaacatataattgatatgccttttgcatgactcttctcaactaaaatgcattagattgcatcatgtctgtggttcacaatatgttacatatgttatctggaaagaatataattaaatttgctacagttctgtgctattgttatgttatttttgcattgttgcatgtggtgtttgggatccaactaaaactaagttggttattttattatgtaatctcaaccgatatacggaatttatatgttgtgtatattcatggttgttaaattgctacattatgttcagtatatatacagttttttttggcttcaattttatgccgtcctttccagctttcccgccgcaccgcgcggggcaccctctagttatatttgttctctgcacttctgctaggctgcttagctaccactagccttttactacccagctgcagataaactaaaacatgtatatatgaacatgaattccctaaccatataaactaaaacgcctccgatgatcgaaccatatcttggtccatcgatttaagtggaaaccaatgatcagttgttttattttatttattatatttatagaacaattactccctcggttctataatataatgtacaaccactttctttatatgttccataatataaggcatgcattcaattaattatgacatcttcttcattaaattattaattttttaaacaattcactctcacattctctaattctattggatgcatgcattatatttattaggatgatccaaactacaagatgataataactatttctttatctttgggttaatgttggttgtgccttatattttggaacggagggagtaatttattagagtcacgtgacaacttaggtgtattttgtcggaacactactactaatagtctcagtttacttgtagtcaactactgttggttgtagcttggtggcatactctacctacctatcagttgttgatgttactcgcggagtatcgttctttatctttggtgctagatgacatgcatgcatgctcattggatatcagctgattcttatattaggtacattgtgcatgaaatgtcttgtaagcaatatgacttattagcgatcggtggatagtggtttgtatgtagaactcgtatacgtggggattagtgaggacatacgattccacatgtggaggggagtatcgtggtgggtatacctgattttttttctttgagatggagatctaatgggtaaaattagtaggtccaccgatttttttttcctaatttattagaacaccatgtggcggtttacgagcgtttgtaggagaccacatggcggcttgggagtttttgtaggaagttaatttaatgaacttttagtatatgatagatagatatagatgtacgtttacaccaggtcacattttctctgctgtttcctaattggttttactttcatgcctagttaattaattatattagctatagggttaaaccaatctgcatgagcacacagacagtaaagtggaggaggggattagctaacagttgcttgcacaagcaggtggacagaaagacatgcattcgctttaatcacactgctctgaatgtgacatttctgtcatgccgctcatgcatgattagtggccggagtaggagtacacgttactagtggaaggagaaaatcttgttgtcggaggctgccgcgaacgggtcatgtgcacacttaattaccgtgtagtcacgtccaaattccaaaaacatagtaagacgttgaagaggatattgagcaaaattcgcatacattatattaattattatactcacgtcacatgggctggagcctatttatacggaggaggagcaaaggatcggatgaaatcgaccaagatgacgaagatagcaggtgttcttattttagttcttgttatctgtccaactattacttccgctaccgaaacccggggaggtaaatccatccatccatctcatgttttctcacaatctagctgagcttgattctctcttcctaattagtagtaattacttgtgcatgtttgtattgtgttagcgcttctattcctaattaattacttgtgcatgcatgcgctaattaattctgtttgtattgtgttaacaggccgggatgacgaccttagtgacgacaaaatctggacatctctgattgcattccactatcctggattggtggttccgccaatctgcatcgaggacattgcaaagaaatgcgggtggaataatctgacccctgcatgcgtgatggaagagatggacagctgccactaaggcgaccaccggccactctccatcagtctcaggctgacaggctctcagccataataattaataagctgtaataaggggcctaattaatatgtactacttcatgcctctgattttgattgcaagcaccactagccatgcatgcatgtcgtatattctaatagaattaattaatggtaataatataaagctagctagatgtgcctgtgggtttgatttttaatcactaggagtaatagagtagtactcctctatcagaatgtcagggtgcagtcagaaccccttgaatttggacgctacaactagctactacttaattaccgatcgatttggggcaaaaacaactactgtttgccagatcagagagatggtcatccaccatggtgaagaactagcttaacagcggcacaagcacgacctcgtccaagaacccgtgtctagctcgtgtggccggccagccggtcaccatggccgtgcaaatcatatatacaagtcatcgcttgtacaaagttttcattgtttgattaaacaaatctgtacaggacatggtgatacagctggattactcatgatgtacttaaaaaccaacttgcttcaagattgcccatggaacataacatcaaatcacatgccttactttacatttattacctatgaaagtaccttcttgcaatgtttatcagagcataagcccatgttcacatttttacctttgaagtacctccttgtaatgtttatggtagagaaagatccatactatcaaagataagacatatatttttacgtagaaacaatataaatacataattataagtgattgaatttaacatcacatatgctttaaatttctaattaccaggctaattttgcacactccaacatgtccatacatttttcttccaaaacaacttcatgcaggtagcaccctgaactacttctattctcaccctgatcagcactgagatggcctcaggaagtcaggaagcagtgccggcagtagatagggaagccaaacctgccatttgaaattccctggaacttaaggagacagctagtgcacatgaattgcatccaataattaatcagctactacaaaacaatgtgagaattgaagtagaagtacgagaaatataagttaatgaaaggaaactaagtactgtctcacgacatgattcaagataaataagggggataagaaaatcgcaaagaaaaatcggtttggaataaaagattgatttagtagtagcattttgtcaaaacatctttgggcaataggagcatcaccgatttgttatctttctcttttctactgttgcaaatccaacaaagaattgtgaaagcaattataattattttttttttaaaaaaaagatggcgtagagttttctcaaatttttacaagctttacttcacaaagcacatgacttatcagctatagccagaagatcgcatgattgaaactgatttattctagagagtaataggcaatcatagaaccatccatgacatgcaatcggcaaccaacagatgatggtctatcactcctccatatgttcatctccagcatattcgtgtacagcttgtaatgtacagtcaatagtggcaccttttatagcatgtgtacatgccaacctacaaacagaaagatgaaaaggaacattcagcaacgcgcaaaaaaagatccattttttattcatacagtttgaaaacttttgaatttttacctagcataagaatctttttatatgggtcaagctttaaaccaccagtgttatagtactacctatagctaagatataggtatacttcaatagtcctaattaaacttaattcggtaaaaatctacatagaaaaggttgtgtgctaccatctacggaatgtggaaaatcatttagatttcgatacaatggagttctcaagctgctaaataaatgaataaatttgttcaacatatttttcctaaaaaaatgatgcatagagatgaagtgctgattaaattaccaaaaagttggattgtggtcatcactttaaatccaaaattcataatgacttgcttaaatatagttaaaaatcgaatgtcagtatataattaattgattttgttggaagcctttcatgttcctaggaataacgttaaacattatttagtagagtgtgaaaatcatcatttcagctctaatctgattcttgggagtagcatgtgcgtgagtccaaatttcttagtggcaagcacatggcatgttcatttgtatacatatccgcaccagaaaatacatataattgcccacaaattcaaactgtatgtaccatcgctagctgatgagctcacctcgttaacatgtcaatctgcatatcaggcaaataatctacgtcgttataagaaacaagaataaatttatattataagtgacagtaatgagtgcagcttggaaggaggacaggcaggccatagagctggacgcatacttcatcaaacatgtattaattgggcgtttagattttgtttaaagtccaaagctgaattcaccacgcacagcaaaatataaagatcccaaatgttagttctgttgagggtgttcaattcttcggttccacattgcagaagcttagagataataaaagtgaagattcaatcttagacatgatcaaccaaggataacacaatgaatatcaataaaaaatgtattattgtacaaatatgcatgtacaggctccggcctagagatgacaaccagggtttcatttaccgccggggccgcggttatcgcgccccggcggtaagcacggttaccgcacggtaaccgcggtaaccgtgacaaaccgcgacaaaccgtacaaaatttatcaaaaattcaaattatttttcaaatttatttgaatttgacgcggttaccgcggtttaccccttaccgtacccccgcggtaagcgcggtaaccgcggtaaccgcgcggtttaccgcggtaaatgcaaccctgatgacaacacacctgcttatgatccattcatgcagcaatatgcagtgatagaaaaatgtaattttcgaccatgaacatatatatttattactaaataactcttctctctgctacatgatgcctcatactgagcctagtgttggaatgtgcacacatatgggcattacttcgaacaagaggaggacatacggagaggcgagattgaattctcattcagtctgctccacctacttgcagttcctcttaattgtttgtggttctaggaaaattagggaaaagggggcaagaagaacatgagacacatggacaaaatataaatcaagcagcattttcttttttttttaaaaaaaagaaaagagagaagaaaagggagaaccttttacagggacaagagcaagaagccgacgtttgaggcaatggatggggtcaatctgttggcaccggattagtgagttgcatactcgcattaacgttcaaccgtagttgttgtacgatacgatgggccttcatccctgcagttgacacccttgtctctgactgccggcgccggcacgacgtacggcatgaatggtccatctggcttatgcttacctttccaaaagagaaaaaaaaaacaaaagagttgagtttattttatgtatcgtcccacgcagaacaaacttattcacaacggggtttcatcaagcaccttgaccttgtacaggaataaataaatgacgaatgaatacaaatgaagttgtcggctgaggaataaagctgcagagttagaccctagaagcttcaatctcctaagatggagaggaggcaaagccatgataaaggaagatgaaaatcatctggctggaggagcagatgttgagacttgaggccaaggtcagaaatctcggcgaatggtggaggccgtggcaacgtgaaacactgtggacaaccacgccaaatctagagatggaagtaacaaatactctctccgtccctaaatatttgacaccgttgatttttttagcacatgtttgaccgttcgtcttattcaataacttttgtgaaatatgtaaaactatatgtatacataaaagtatatttaacaatgaatcaaatgatagaaaaataattaagaattacttcaattttttaaataactagcaaaaatgcccgtgcgttgcaacgggtaaaaagaatccaatgacaatatacacttttcatgcataaccatattaatgataatgtttatatggatcgttgtagttaccacaattagaaaattggatttttccgccccttgtaccatataatggttttttattatatacggacgacggaaacttttttaactttttaagtaaaattagggattagagattagatctgttcccttttgtgattaggaatttagattgtttatttacttttctagaaataaaaagaaaaaaaagagatcgggagatggggaggagatttttttccacctccgattcgcttttgtttttctgttgccgcgtttttcttttcaggatcgctcttttttttaagttagacggacgacaaaaacatcataaattttttaagtagtaacagaaacgaacggtcaaatatattttaataaatcaacggcgtcaaatatttacctcgccaactgccccgaggcttcctccattgtcacggttcaaatcaatagcagccacaaccttccaatttagcgaatgacgagtgaaacgacggccaacaggcaatgtaacagagcgacagagcggccaccggtcgactccaccacaccagcacacgctctcgtgaaaccctaggctcctctcccgcaggccgcagccatgtcacagcactctgttgtctccatgctcatggccacgagtggccttccctgagaccatgccttcacacgacggtggaagagatgacctggccactacttaggggaggatgtgaggcgcatcatggtccggtgttattgctcggtgcgtggggatagcgcggcgcacatccgctcggctggatggggaatcggtgatttcactgtcgcattgttatcacaaagatatctacatccgtttctagccgttggatgaatagatcgaatggctgataaaagagataggaagttttgtgtaggttctcctaggtgcatctagcaaagagaataactcctcctttttatatatattagtaaagatgagtatgtaggtttattagactaacatcataccacttaatatcactggtagacaaa

SEQ ID NO: 59296 - DNA, 9121 bp, Oryza sativa
  unsure (1)..(9121): unsure at all n locations
caggtttagcttaaggaacccaagtgaaatggtttcttttggtcctctgttcggggaccctcattttaaaaatcaatatttgaagaatgtgattttgtcatcagactgcatttaattttggaactttttttacataaaagccaatatgacctccatattgtacccaaaactcccaaagccttatcttcatcaacttaggtaagaagagcttcagtgcggaagcagaaggcctcgagccaaaagagaagtctgtcaacaagcattttgcacaaggaaagttctcctaagcaatgacacgccaaacgttgtcgccactctatgtttctcatactgatctacatttgttttattttttctgcaaggaaatcaatttcatactatctatgtcaatgctataagcaagaagaaaaattcttcttgagattgaattatatcatcaaataaaggaagctatttaatcagttgaggactagacacgatttatttccgcctttgttccactaatggcaacttggagaactaatttgttattgcaacaattttcattctatatatgtagctgcacaagaattggcaattaatttaattatgaactatttcgttattacttcaacagtttatctaaggtatgattcacaccccctcaaacccctctattctaagaaaataaaaatcaagaaaatatttgtttttcgatctatgtgttggaaaattattgggattttatgtgttggaagaaaattattgtacatattatcttttaattaatgagtagatgatagggttaaaattagagctagtagtcacatttactataaaacttgctctaaggcaagtagcacattccaacgaagttcaatcaaaagaagccaaaccatcgcgccaccgctagtgatgactagaatgacccgtcacaacatgtgcacaatctccgtggtacaatctcaactccagtagtactccagtgctctctggaacctcctagcttgcccgagacagagaaaaaaaagcctcttctctggcccctcttcctccttgattccggtggctcgccgccggtgacgggagggagaggggtcaggctcaatcgcgtctccttcgtatagtagtttagtcgggttagtctcgtagtcgagttagtctcattctgtgtccttcctattcttcgtctttggtcctctatgaagagtccagtgttcccttcttcagatctgaaatcttgtgggtggatcagccagggaggtcagtcttcgcggtgccagacctcgatttcgtcggccctagcgacgcctgattgtggaaaattcagctacagtgccggtggccgaaagtcttcaagctttgactctttgaggtcgctagccatagtttgcggtggatctggatggcttcaaccgattttcgcggcccctttgtccatctgatccttggcgatgtgcccttcctcagcgatgtgctcagccgcgtcgtgtccggtgagggtgggctcacacacacccagatcgtcgtcgtatttggtgggtttggaggtgcagagttagctgagttgttgaagcagttcgtgcttgctgattcctcccatgcgagcatcaagaacattgtctcgaccgacagcatctccatcaatttgctgctgtgcctaaatcagttatccaagcagtagcacaagtcatgggccagcaaggagcacgccatgaatcccctgcatcatacaggcaaccaacaagctacacaacaaggcaaagctggtcccggcaattctgtgcatgctggcaacgaggtctccttctcaatcctcacccatgggatacatcttaagttcgtaagactttatcatcgccaccatctagcttctctaaagcttaaggtcagctgggttttgggtgcatcttccatttcattcctttgcagcagtatccatgtcgagattatcgttcgggttgagcaccgactatctgttagactttggtcggcagggatgttgttagtgttcctcagatttgacgatgactttcatggcaatcattggttgagtccggtgaagccaccaacatatctacgactcaactccaaacctcaattagtgccaaatccgtggaggcagccggagggatcgctggcaggtcaagcgggaagcacgtttgaagaggcccttgggtgcaatcgtcgcggcaatgccgcggatctccaacgattgtattcactactgatgtattagatgatctggaggtttgctttcatcattcaatctttaccttctttcaggaaaatggtccttaacgtttgttgtcaattttttgcaaggcgatgtttcagggaatgttgttcccttccaatgtactctgtttaatatgcaataaaactttatgagtttcaaaaaaaaaaacaacatgtgcacattgtttaagggctgtttggatagctctcatacttgtaaagtgtagcatgacacactttgtgttgccaagaattttttgtcacaattgtgatagtccatggtaaaaaagtagctctatgataagtaggtcagcttatttgtgtctagctatgcgacaagtagactatggtaaaatatggcataacctatttgtggcttaaatcaaacacaaaactttagtcttagtagatcaaacttagtgtctataaggttggcaactaaatttgctacgctttaacttaggtaagccacaattttagtaggtagtgtttggttcatgccacaaatctactttgcctaacccttaggacctgtttggtacagcttcaactcctgaatttagctccatgagttgagtctggagtggagttgtggagctgcctaaacctagctccacaactctagtacattttgagagagctccacccaactccactcccagttttggtggagctgaaactgtttggctgagctccagctccaggagctggagctgtgccaaacaggcccttagtcacctgggccacatgttgtacactatattttcttgtctaactttgtctaaacttagtttgtcattttatttgccacaaaaatgtggcaagactcaatttagtaaccttagtcaaaaaatgtgtgacataattagtcctcaaccaaacaaacccttaattaccaaaaaaaatgcttaagtttgacactcaaccaaatagtcccttaggccttattcggtgcagcagtttggagatagatttttattacacgtaaaacgagaaatcttattagcacatgattaattaagtattaactattatgaaagctttttctgtcaaaaacacactatttaatagtttgaaaaacgtgctaactaaaaacgagcttgaagtttggagttgaggaaatggaaacaaacttcattccatcagtgctaactcttctgagccatacacgagccacatatcatatcagctggacgatatcgctaacgttatccttacatccacgagggaaatgccgcacgtacccagaagcgtactaaagagaatcagaccaacaaaaaggttggcagaagaaaaaaaaaaaaagccattgcagcccacagcccagagcccactggctcggcatggcccacaactcccggaatccgcctcacgtggacggccagaatccccgcgcggtcgcggtccaagattctgaccccccccccccaaaccctccacaatacccacgcgtctccactctaccctctcccactgcaatcgggacccacgtcgcactctaccccacatgtcacccgcactagacaaccacccccaccctttcggcgcgagccggattagacagccgccctcgtgccgcgtgcgccaccgatgacgcagtcactcggctaacacgcgaatccgacggccgggacgcgattagcggctcgcaaagccctaattagatcccctctcctccctcctaaacccatccgtgacgcgaggcagtgcggtgcggattccattctcctcttggcatcacgaggcggcgccgcttggtctagctagtagccacagggagaggtggtagccgcagccgccgccgacgagacctcgccgccggggggagggcaccatgtgtggcatcctcgccgtgctcggcgtcgcagacgtctccctcgccaagcgctcccgcatcatcgagctatcccgccggtagcatgccgccctcgtccccttcccctctctctctctttctctctctctgtctctcgctgtatatctggtccgcgcacgttcgtgtgttcgttctgaatcgagggatggagattttggccgtggatctggaagggttggactcgtcgccgccgtgagatggttgtgctctaggtggcgtcctgtttattcgactatcaaatagctccgttaaaatagttcgtcggaattttgatgattcaacgtggtcgaaaagttcgtcggaatgtttgggggggggggggggtaaatccaacgttgtttttgtttttggttatcaatatgggagcgagctgtggtgcatcattaatgacgggttgttcgatggatggtgactttactggttaggagtgtttatgtcgtgtaagcttgtaaagagataagaatatagatggattatggaaatggagacatggagttctatgtagtgtagctaccgttttggtgagtctaattcctcagagttttcattcggaaatgataacgtatcaacaagttttatttgcacgagatgcctctggcgtgtgctcttgcatggtaatgccgttaaatgatgttgattccaatttgattaaaatgtagtattatatacgtcaactgtaacatgtaacacatgcctccgtgatgtgccccttgtgcttgctgtgacaagtacggggttctgatttaaaattacgacaatggcgatataatgggcttaataatctgtaaaatacggtcagctttgttttgcctggaattctattgttgtgggaagtgtgggcctgctaactcagagttatgctatggattgccaatatgtagaaaatgcatctttctattctactgtagtataatgtggcatgtttttatcactgtagtctgcactctgcaaccacttgatctttaggaactgaatggttacagtttcttgtgtatgtccttatattagagcaaataattttcaacgtagatttaataaatcttctgatagaattagtaccaacttgttgtagactcaaggcatgctgcatttttcataggttgttgtgacggtatgtaattcatagttttcatagatttaataaatcttctgatagaattttttgaactgcttatgcactgactaacccaagttttccaattttcataggttacgtcatagaggccctgattggagtggtatacactgctatcaggattgctatcttgcacaccagcggttggctattgttgatcccacatccggagaccagccgttgtacaatgaggacaaatctgttgttgtgacggtatgtaccttgactgttccattgacccttatgcaccctccgcagattttttttttagtatttcattaacttttaagttttaatatgtgatttgcctcgctattctacttttggtaaatagcatgtttctgaaatattttgtcatgggactttccaaatatgtcccttgagctctttgcatcttataacggtacaatattttaatcatcaaaatgtcttgtaatgaaataaatcaaagatttctttccttattatagtttctgtggaaccacatctgatcttgtagttgacacatccaggtgaatggagagatctataaccatgaagaattgaaagctaacctgaaatctcataaattccaaactgctagcgattgtgaagttattgctcatctggtaagttacatgttctctttgttgcaccttgttattgctcaaatttcatctaagcatcgcctggtatacacttactattccttcgtattgacactttcatattgatctttttcacagtatgaggaatatggggaggaatttgtggatatgttggatgggatgttcgcttttgttcttcttgacacacgtgataaaagcttcattgcagcccgtgatgctattggcatttgtcctttatacatgggctggggtcttgatggtatgtgcactcctgcagtgaatctgttcaccacttcatctagttattgatccttgtgctggaaaccaggaggtttgattccttatttttctacaaaaaattgtggtggtcacaattttccattggtttgtttggttataccactgtttcagtggctagtcagtgcttcaaggctagggttcacattgattcttgctggaaccatttttctctgtttgatcaatgaggagaaaaaacagtgccggatcatttaccatcaattgcctattgtgttgcaaattaaattaaaatggaaaggaccaaacaaaatttgcaaacaacctggcatatgcatagttttagcacaggataatttggaactgtaaccgtctgtccgtgtggattgcatcacttcgagtgagtctgagaaaatgaataatttgtggcattcagtatttcttgcaattttcaatatatctgttgggaatgttgttgattgatattctgtatatgtgcaagcatttacattttgaaaagttaaatgtgatagtcagttgatggaaatcttgatacttgctattcaacaagcaatcgccagctctctcttacttatgttgttgacggtcataggctttaagcctactttatgcgtgtaagaaagaaattaaattgtttggcatgtcctaatctcttggactgtcagataaatataagatactccctccgtcccataatataagggattttgagttttgcttgtaatatttgaccattcgtcttattcaaaaaattttgaaattattaattattttatttgtgacttactttattatctacagtattttaagcacaactttttgtttttaatatttgcaaaaaaaatttgaataagacgagtggtcaaacgttgcaagcaaaaactgaaaatcccttatattgtgggacggagggagtagttcacttaatagttacctattttcttgacaaggttatcaaatctgcccttttagcttgcaaatagaactatagagatcctggtttgatgcctgttgcttcaaagaacattaaggtttttgctactcaccatgatggaacattattccttttggatccgaatatctgatattgggacccttcaagacttttgttgcccaagcccataaaaacacaaaacaagggcaatataatatgtttgaagatgcactttttttctttggtatgtttggttaccaaatctccacgtttagtttgcaggataaaaattctggttttgatatatgttccttctaagaaatttaaggttttcgtcactggtcatgaagtaggattctttttcgatgtaatatcagggtccttgttcaaggtctttgttgcccaagctcataatacagaatgacaatataatatacttgcagagggcaagaggcaccgtttccttccatatgtctggaaatataatttctccttgtcttcgaatcttggctagtgcgatgttagtttagcattattgcctttgtgatttttattagggtatacttggtgtttatttgtaggtgtattgtgttttcaggttcggtttggttttcgtcagagatgaaggcattaagtgatgattgcgagcgattcatatccttcccccctgggcacttgtactccagcaaaacaggtgtgctatttcgcatttgtgacatactgacagtatcgtctaacagttgatgttagaaacactgtttttaggcccagaagacgaaaaaaagaggaaggcagaaatgatcaaaactattataatattgcaaatatcattttgttttgtctatgattactgacttgtcttctaatatccaacctaggtggcctaaggagatggtacaacccaccatggttttctgaaagcattccctccaccccgtacaatcctcttcttctccgacagagctttgagaaggcacgtcccattcccatatctcttacgctgcacaaaatctcttctaaacttttgatatgttgtgtttatgccgctgattaggaaaagcttgttcaaacctcagatggtttttcatacaatagattattttagcatgatatattatactgctctcagattgaccaatgatggttcaccatgttgacctctgtattaatattcaaatagatggcataacatttctgaatggtctatgcatgtttatggtagcataagcaaatgattatatcttacataagatgcaaattctgcaggctattattaagaggctaatgacagatgtgccatttggtgttctcttgtctggtggactggactcttctttggttgcatctgttgtttcgcggcacttggcagaggcaaaagttgccgcacagtggggaaacaaactgcatacattttgcattggtttgaaagtaagtttcttaagcattgagtcctattattgcgaagatttgtgttagcctgtagggtatctttccaatttttacctgttctcctggtgttctgagtattttgaaagaaaatggatttttttttaaaaaaaaggagtgatatgcttagatattgggcacatgatgatctagttcttcaatgttccccttttttgtagggttctcctgatcttagagctgctaaggaagttgcagactaccttggtactgttcatcacgaactccacttcacagtgcaggttctgtatctgttctctgttttttttgcatagtgagaaaaaaaatcttttgaagctctgattcaatattgtaaaaaaaaaatgaaaacaggaaggcattgatgcactggaggaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaagaaggaattccatgaggaaacatgtcggaaggtaattaaggagaatattttcatgattaatcttcttctgcccaaggcagctaaatg

SEQ ID NO: 59297 - DNA, 19849 bp, Oryza sativa
ccatgtggcatgccacatcagcgccacgtaggatactagatgggatgtgtcgatttgggacctagatgatacactttgacaagttctggaacccagatatgcattttgagagtttaagagtttagagacctatatgacataaccctataagtttaaggaccaccaatgcactttactcttaaaactaatctttagcttataatttctcatatagtataaggtttgtagcaacaagggtgtgttttcaactacaccttttcatcttttatttcatcttttccatgcacaagtttcctaaactaataaatggtatgtttttaaaaatatttttatataaatttgctttaaaacatcatattaattcatttttaaatatttagctaattcttactccctccatcccataatataagacgcgtacacattgtaagattcaacatttaaaacatttgaccaaaacctagtataatatgaaatgaattttatttgctaaaaattatgtcattaaattgagatttaaatttactttcatacggagcaatgtacaggaaaaataacagaaggagacacgtacggccgagagagagttggattgtacaggtacaactgtgcatgtaactagatagcaacaggttataaaatacattcttgtttgcataatggaaattcagaaatcaagcaatattgacagatgatcgaccgagatcgggccgggaggcatgaaaagagcagaatcgatcatgtgcgctctgcagatttcattggaatgaagggtcagcgtcaatgtgtcattggagccgtggcccgtagagttgatgcctacaatacgatccacgtacacacgcatgcaacctagtaataaaagcactgatggcgaagactagcttacccgttgcctttcttcctctgttttattagttgatgcatccgtactgcataaaagtctattggtgctggtcggaaatctagacccactccaatgacggcactgatgtggagattcaaaggtaaacggcatcaaatgcatcgagccaatgctttcagccaacaactgaatctcagaaacaacaattccacaattccataggtgaagaaatcaagaacatccacaactgtagagcaaattaagaaaatccacaagtcaggaagaaatcaagaacactgccgctgccgccaaaagtgaggggggcccgctgccaagaaagctcagagatgacgaggtcgtcgttgctttcaccgccgagaagaatgagggaaagaggttcggtggtggaggtggggccaaccactaggaagggtggagtagccgtcgccactgccgccatgctagggagggtggagtagccgccgccgccgtcgccggggagcagcaggcatcacgttggggaggagggagcaattgttgatgccaccatgcctgggaagagggagctaccccaaccagatccccatgcgtgagccgatatcaccagatccgtgcgcgcgagcggccgaagccgctggatccgcacgcgcaagtaaccgtcgtcatcgaggtggaacaagagaggaagcaagaaaacgagagcaaaagagagagtgagaaaggacggacgaaaaggagggagtggataaggtggggggacggagccacggagggaaaaaataggattgactgactcagctcagtcggctcggcacataggtccagttttgaaactataattataggtgctcttttttttaagaaaatcgacacctatagtataagtgccggtttttcttcagaaccgatgcctatagttgcttaatggtgttggttttttgtgtttttagcccgcagaggtgggaaaagatctataggtatcagttttagtatttccggtatctaaagtgccaacatctatgtgccttttgtagtagtgcatgtgtgcgatcagcctacataatagtgcgatatttcatattaatatagtaaaagattacaagagtatagttatgagagaccatgattaagaaaaaaaaatagacagtaagccatgccacatgcctacaatagaatacctcgttgttgagaaaataattacaagagtatagttatgagagaccatgattgagaaaaaaatagacattaagccatgccacacgcctacaatagaataccccgttgttgagaaaacaaatagaagcaccatatcccaactgtgccctcacagagggatacaagtctttttctgcacactttgttctcactcgtacgcactcgggaagaattttccgatcatcggcatccagaaaagaagttgcaacttgttgtatgagtattctattaatcctattaagccctgggccaggatgtcacatcctcaccccccttaagagatcgacgtccttgtcggtcaaccccatacgtcccgcctctgccaggtcgggacctcttacatctggcagcttttataggtcatcgactgtcctcacagaccaacacaagtcttttttgcacactttgtcctcattcgggaagaatttaccaatcggttcacccatcccaaaattgctccaggccaagcacgcttaacctcagagttctttggagatcagtatccagataaaaagctgtaacttgtggtatgagtattctattaatcctattaagctctgggtcgggatatcacaaaataggccttcaaccactcatccaagatgcttgagatgccaaggactttgccatgcccatcctggaaaatcaagatgtggttttcaactgaagaactccaccaaagacatgaggagagataccacaactacgcccctagggggttaatggtgctcttagggcacccacaatggttatctataggctctctataagagatccatgtcagcatattttcctacttggaagagattaaatgaagatagagagcaaagctatctactaacctggagatagtctatagagaaaaacgaggcaatgtattaaagagctatagatacccatgtagacatactattaagttggtttactattaatctagtctattgctgagatgtacatgttttatagatagcaccttactttactattacgggtgctcttaagcgtcgccacgaccggccttgaatagggttagcctttcgcgtggaaatcttgctcccctctcttgtcactgcatccacattgtcaccatcatccaccaccatatgaacggattaggatcgtctgccttcacagcacaggcgtgcagtcagtcctcatccaccgtccaagtcatccgatggctcacggctcgcatggcatgacgcttaatggaaccacctagtggcagcatacgcacctggctacaatggtgttcgccatcgcctgtgtatgcgccgccaccagccaccgacagcgccgagagccacggcttccccaatcccattccctaccaccactttcgtcagggaaaaaacccgtcgcacacatcgacctcctctcgcgtcgctaccgctgaaggccgcgttgaggcccacgctcgctgaagtcgctgcctgggcgccaataagatagtcacctgactgcctgcgaggtcgtcaagcgacatgatttgttcagttgtttcatttacctattttgacagtgaggtggagacgtggagtcaagctaggctatcaattcaacatatatcagcagccttgatcaaaccagctaactaatctgctgctaatctagtgttttgatcgtattatatatgttacagttcatctccttccagaaccagcaacaggggaaatcaacaaccaactaaacctagctagcggtcgtcaagctccacgccggccggccatgtggtgtggttaatccatccatcggcggcctccgacttcgcagcggcaagcctacatagcctcccgcagatggcaagccaaggttttcctccacctcgtcgacgcaccgcgggtcacggcagacacaacattgtgactagtgacaacggtagtgacatgatttgctcgatctaccggtccctgtgggagatgacgccggtgacaaggcaaggaaagattgttggctgggctagacgtcggtgacagaaaggcaaggaagatgatggtttggctgggctagctctcttcaacgcatacaccacgcaaaacgttagatggcatggacagtggatgatggtcaactgcacgcccgtgccttcatcccgtgaaggcagacgatctgaatcccatatgaacaccatcagcacgcggccatcgcaccagtgccccaccactagctggccatcaggaaggaggccctttcctaagaaggaaatggtgtcccatgcgccgcagaactccaacatgccattggcaaagcggccgctagcatcttcatgtaccacccgcgtcgttgctccatgccctcctatcacctcgggtcatttgcctgtgtcgtatcctgcatgctgcctcacactgcagccacctcataggccctgagtgaaaattttggcctcaatgagtccagccaccgcctcacattgcctcactcatctggagtacttcagccattccttgcatcttaggtggctctgatatgactggacggcagaagggaaaccttggcagggctccatcctaccatgcgatgaaacagacaaacaactcttcagggtttcaatgatcattactttaggcaatgggggtaaggcaaaattctggcacgacagatggcttgatggccaattccccaaagagataactctttccctttataagctggtgacgaggaaaaacaaaacagtggcccaagaactaaaaaatcataggtggttaaggccattacggaggatgagctcgacaaccgaagttcgagaattcattctcctatggcatttgatacaacaggtacaaattgatgaggagagggaagacgacctaacatagaaatggattgcaaatggaatctactcagtcaattggatctacagaatccaattcactggaagcatacaggacaatagatctaacttcatttggcgagcaaaaacagaaaacaaatgcaaattctttggatggctcatggttcaaaagaaaatcttgacgtctgacaagctacaacttctaggttgggacaacagcccgacatgctccctctgtgggacaaaatcagaaacaacggtacatctcttcatggactgccccttcgcgaaacaggtatggacaaaaatttggatgaaactaggcttcaacatgcttgcgtcttcttctttcaatggagacataatgggttggtgggaagcatgccggagagaaatgatcaaagaacagagaaggaactttgatggcctattcatctacacgatatgggtatttggcttcaaaggaatgcaagaatttttaatgacgattatggtacggtgtcacatgtggttgattccatcatcaacatgggcaaagtttttgatgaggcgcaaaatggatagatgatagaacgccgacttttgatgttaatggccttgcactgtctcaaagtgttttaatttcctcctgttttcaaacaatagacacctcttggaggtgctcctgtacgtgaccttcttcttctccttttatgaataggctaggcagagctcctgccattatccctaaaaaaaaagaattataatggtatggtttcaactaattggatagcaattttaatttttttaataggacgaatttgtagttgcatggatcaaatttaacttaatatttatgagcacctatatatattatacccatgactccaccattataccaccagcgttttctttctatattgcttattctctactgcagagcattgtttccattattgtgcttggattccgcacgtacgtgaacaggtgtgtacggaaattatctaaattgttaattggttatgaatttttaaagaaaacataatatatattattgaattttatattgctctagagatattagtgagaaattcaatctacagaagtttagataatagattgattaagtccagcctctatatcaaccagagatgtacatagccaatttaccgatagagaaataaaacaacaaatgtaatccaatttactcagctggatgtataggccgggtaaaaaaaatacacatatctaaaaaacaaatgtaactttgatatgtccatatacctttttagttcgatttttttctagatatgtaaatctaaatttgctgcacgtatgtgttctaataccataatttatctatgatgttctatataaaaatataatcacatttatgaaagcagagcacatattttcaaggtctcttaaagtactttgatatccagcagttccaaagcacctccatatattatctttatgtcttgctcagatctgccttacaggtataaaaacgaccacttttatgagcagagaccgcgacgtacgtacgccaccagggaaatcgatcgccggccaggtcccgtgatcccgacgcactacaaatcattgagccccctgctatgtctagcgaaagcaacagtcgacaacaagttgatgcgtgattgaaccaaccatcttcctgtaggagtaagtaggacacagcttcctttcttctaactcgggaaatatgtaaaatatatagtgaaaatcacatgtattgtgaaaatctggatactaccatcagatcaaaaatgaacgtctaaaaattattcacgtcagcaaaagtaaaaaaaaaacttatagatttacctagaaactaccattggattaaaaaaatagacgtatgagatttatccaaatcattagattaaaatttttacgtacagtaaaaaatttgcaagtaaaatttatactcttggtgacgtgataaatctcaaacagtacccaagtttttactatatatgtggcttacaccacatattttcctcttctaactccctgttcttttctgcttctttatcacatcattatcataaattatttgcttcacgtatcaaaaacatgtttttttaaaaagaaatcatacatggcttcggttgtgttctagtgtccagctcccaacttctattccctcgtttttcacgcgcacactttctaaattgctaaatggtgttttttaaaaaaatttctaaaaaagggttgatgtaaaaaaaatcatattaattccatttttcaagttgtctagataatacttaatcatacgcacggaatatgagagagtataattaaattaggaaagatgagtacagaacaattgtttaaagttatttgttaatttatgtcttcaaaatattttatttatccctataatcaattagttcattcctagcaataatccgatttataatatggttcaaacatgcaaaaggagaccacatactagagaatccctctcacaaagatgacgaatttccctgccaccatagaaactgcattaataatgaagactcattaagaatgggtaccgataagtcacacgattttttttttaaaaaaagagctggcccggtttgattcgagccaatgcttggattaaagaaaaaggataaaaataatctcaaattattttccatcaatcaaaatttgttcttcaacatcacattttacgaaatcgagtcacaaattttgacacaaacaaacaattgaatcactgcaatcaaaatctattacacatatcatttgcatgcattagaagagaatagaagaagatgaacaaagaaaaaaacatgtaacaggttatcgtctctaccatagtgaaagaatagatcaccctccctgtctccgttgcagccaaccttgtggaggctagatcagggtgatggtgacgtagaagtgccccgctctccatcattggagcaacctgcactcgccatcctggataagtccatccgccttccatgtcaaacgggcccctacgcacagttctggccaccccaagctcgtggtggctggatatccaccctacctccacatttccctcccttctcctcaacggcgtgtaagagatagtgacgctatggtcagctccaacaacccaagcttaggggaggaggaagagacggcgactacatagcggtgcaatgtcaataaggaggacgtggtgtagcattgctagcagaggaggaagagatgttagcgacacagctaggaaggagacacgtcggtggcggtgaggaggaagcaatggcacagccaagaaggaggtacgatggcggaggaaagagggagtgtgtgagctgggagagagggtttcaaggcgcttaaaataaccgatgacttagtgaatgttcagctctgctctcttgatccatcctattggtgttgctttagttaaaaaaaacggtaccgatattattagtgtccaactttttaaaaagataatcaccgatgagccgttaccagttttatatttaaggctccgcttaagagctgagacatacaagaagaaaccagcatatatgagttatccccgcctattaggagttatgtagtaccctacgtatagagtgtgttcctctcatgtggcctagaggtagcttgctaggtcggtgggaccgtgaaatggacgtgagctaacctttggcagtgcctcggttttgttcattctctcgcactcacggattgtgctggggaagtaaaatgcagggaagagacaaagggcaagagacagctgataggcatgcaggtaggcaggcggtgaaggcaaatccgtcgtgactcgtgaatgcatcgatcctactgttcgatcgggaagaggaagagcgaatacctatgtgtgcctgtgtggtagtgttagcttgcgcctctttcatttttgctttcacatattgaaagatgcatatgaagaatcgatcgaagacatccaagagtctgaatgtctgagtctcgtcttttgggttcagataattgaagttgcatgccacacccttttcgatcatggaaatggaagttgcagcatatgacactcagttcctatatatgacactcaagctgatcggtgacaactgacaagcgaggcagcctgccaagtaatccatcattccacaggctcatgcataagcctcctttgaaaaaaaaaagaattttaggggacttttgaacgattgaattcctatgaaaaaaaatcttatatggtgttatgtttttcctagctattgctgtgtttaaatcctgcatttcaaaggagtccacatagctttcttactttgttgtttctactgctttccatttgtgaaaagagtaaataaaacatgggccatcttggtgacttggagtgatatctgtagtatcgaaatgcaagtggcaccatgcccgtatcagtcacggtcttgagctgatctctgcatgggaaagcatctacagtcatgcaacgacaattgcctattgccacagccatgaaacttcagtcgtcctaacttatcctgtcagaggcagatgcgtccgttaaccctatcaaatcaatatcaaaagcatggactagtcatgggtagtattcctacgtagaagcaaccacaccttgtttattatcagcaagctcatgactgcaagataggattaggcagaaacagaggtgctcgatctaagtaagttgtactatctaacacagtgactgaacatcgtggattgcatgttagccctgagctagaaaaaaagcatttgagtatgacaaatccggtgtcatatggtggtcaaatgatcaactactccctccaatcacaagtgacattttaaaatacgtgtaatcaagaccatagatattattttgagtatttcaaattcaactgttaaaaatggtacggttagatctatcttaaaaatagtttaaaatattataactttgctatttttccaaatctttatactagaaaattcataatcaaacaagtgtcctgatgaccatgtcgatatgtccaaaactgtcacttattagttatttgtttctggggattcttcaccttgtcctgcagctcctcagctttgctagtctcagtgagaaagcatctagtgtgttacttgcactgcttcacatcctctctgttctctgcatagagacaattctgtcatttcaagttacttccaaatctcttgtgccatgtctgcaccgggacatttgctcaaagctgccacccttgtctattgtcctgatctaccagtagagacatgcatgcatgacacgacccaataatttgatatgctgagacatatcctgtctagcaaacgatgacaaaaagatgccaaaatggttagttcaatctgaattccagcagagattaaattgaaggattgtctcaaaaaaaatttgaaggatcttttttgcgctaggaacaggagaaatatatatatacgcacagggaaatctgtgtaagatctgcatgaagagtaagcgaaggtagacgatgaaatcagcatggtcacgactgacgatgagcagaaatcttgggaggaagaattaatgttaggtgacgctgaagagtaatcgagaagaagttcccgatttcgtggttgtggggcttagatgtttgcagtgtagcaacaaaagattgcgtccttcacctcactcgtttgtcgcgcagaagtcgtagcaaaactttagacaattaatccgacgtgatgagccaacggtatctggatagggatatgcacgagggcatcatcaagtatatatatgtctacaactgctgtgacctcctctaatatatgtaagagaaatgtctcttacgtgtattctatgagaatgagtttcacttgtccgggactcacgtccctctaactttacgtctgagaagctccttctctacaactataaatctgcatttcgaggcttctgtggcggagcgtttttttagagcagtccaaagtatctaaactcgatggaggctcacaaactcacagaagaaatttttgcatgttcttgtttcaggggtctcacctacacccactcttccactcctacacttggcggctcaagccatactgccatcagcctatatatatatttagaaaaagtctgttttgaatctcatgactatggtccaagtctaattcatatggctcaaccataaaaccagttatggagactccgttaactattaaaatcaattcattttaaggaggacagtgcggaggaaaggagtgaggacgagagttgagaggtagcttgtggcggtgaggaaatggttgaggaggacccaggtgaggtggcctagaagggtgatgtcaatggcagaatttgtcttggtgccgttagtgtcgacgtgtgatagtaaggagtggaggtggcagcaacaggcagagggatcagagtaagcaacagccatcaggcatctagcgccgacacgataactacaatgctggctaacgggggcgatgaagggaacactagtgagtatagtgagtatggcccatgagaaacgcaacgccgatgaccggtcaaggcggctgagcggtgagtaggggatgaaatagtgccacactcaatattggtggagcggagcggagttgagtcatggtaactatcttttatatagatggatataactttttccttattctgccccatattttcatattttcctttctttcccaactaacttcgttcattaaaaaacagataacttcttcccttcaagcattttcttttcagtttaaaagttaatttattcatattttctcatattttcatatggattcggatgcgcactcggatagtgccacctagaacaaaatctctgttaaaaccattttgggaggaaaaaactagtagagggagccttcagatctgtttttgtagtggagggataaatcaaacttggaaactagttgacgaagggatgagtcattctgcattgaacccagtagaaccgtggactgggtcacattagcaaccttaaagaattggcgacgcatgttgtgcttgcttggtactccggcttacgtaataatgatataataaccgcgctgaattaacgaatctcaaatctcaatcccacgcatcacaacagccaaagtgaccccatcaacgtgagaacgattctagcatacggaacacgtaacacagacgagccctcgtaaaactaattagctgcgcatttttcctaatgcaacagaacttgcacacaaggccaacatgcaacttttatacacagtataatatgtgaatatgaaattaatatgtactttaaaagcattcccaagacacaggaaattaaaacatagtcagcggcattgcacacacggccaggtatctctcagcagtcagaaataataacgatactgaactgcactgcttctgcctcgatttcattttttttttggggtctcccagccacgatgagaccaaactaacaacacctattgttgatcctcaaactcatggccatgatccaaaagatagttggcagccagctcttcatccttgttgcatgcgaagaagacctccaaaacgagctcacggttgaaccccattgcctccagctgtcaagaaagtatacatgaaagtttacaaggaaactcgaaaaccatgctgatgattaaatcaatgaaaaagctgttatttaaggatgccattgtctcaacaaaagaactaataatagaacaggctcatgttaaaagaacagccctaactggttataaaatttaaaatatccattcaatggttataaaacaaaagttcaaatttagaactttcaaaaaggactaatgggtattttgggtaagtttcttgatgtaaatcacaaattggacataagtgtcaacatttggaaactgaggtgtgaaaatttcagaagcagcgaattgtctttcattagaaaatccaaaatagcatataaagcaaacatacccgctgaatggcctcccgttcctctggagtaactgtaagtgcctgtggcatagcggctgctagttgacctagtatgtttctgatttaccagagcgtataaaatgtaatgtaaatattgtatgtgtatcaattagaatataatacatgttttgtagttctcttggttcttaccccccagcagcgccgctatcaggagattcattcaccagacggagaaattcagcctgattttcctgaatcaaccgcaagatttgcggattctgcttcccaagctcttgaagcattggctgtgaatcaacagaattgctcaagtcacataaaatagcatatgcactggcattttaatgtctacaaagaaaaagaaaagcaacaagaagcttatgagttgatttatattagcacctgcaagatttggggattagcctggaccaatgcaagcagcgcttggaactgagcagaaacaagtaaatagctgttagggcaatgcattattttaacaagtataaaagttacaccaacatataataatacctgtggaagttgtcgcaatgcatcaagggcaccagcaccggcaccggcaccagcagcagcaccaggatttgacccagcacttggaatgccctaaacatattttaaaaatcatgttttcaaaacaaacacaatagcaagcaaatagaaacaaaattccaggaaatacagcagtttctgtgaaaccactggtttaataaagcaaaagcaactttgcttttgttccacacagactttaactcaaaacatccaagcaacatataggaaaactacaaatatgggtgacagttactggtaatatcagctctaccaacacccatgaggaatacgcgtaaccagctaaccagaatttgaacccagaatatggatacattggactatgcattgtcaaaagtcaaaacaggtgctgaactgcttgtatgtatatgtgccagtgcaaaataccatggatgtatggaactaacaattcaaaagcatataatacgatgccggatgtcctgaaattgtcttacccaagaacatcagtgctaatgttttcaagaatattcttgacaaactgatgatgacagcttcctaataagatgttaactggtctgcctcgatccttagacttacaagcagtccagaagttggaaacattttggtttcttataaaactaacctccaaatataaaggtagcaatttacatttacacatacctgggggaataggtttagaggattcgcattaggtcctgaggcaccaccagctggctgcacaggcggtggaggtgcagcctgagcctgagatggaacctgtggatttccctgttgaacagcagcaggtgctcgagccacaggttgtgggggctccacattctcaggaattccctaacagatgaaccagagtacaacatcaatagttgaattttatgcacagtaaaattaacattggattataatttggttacaaacaatgtaagaaaattggattgaactctcttgttctatataaattttaaaactgctgggcgttgcccttgctgaattctctttaaaaacataagttctttaaatgagttttccaattccccatcagcatagaaatgtgcatttgtgaaaagaaattatcaaacgtggaacttacagaatacagatagtcaatagctctctcagggttgttatatgcagcacgcaaagcacggacaaccatgtcacgttcccaggtgccaccacccatgtcaagaatttgttggattgtctgttctaggttgctacctgaaacaagatttgatgcagcctgactgtagacatccgcatcacttctgtttatcataacaataaaagggaaacattaatatgacattaaaagaggaatcatcacagtggacgtgaaacaaaaccaaatccaggagctttgtaagtttcaagattacagatgaatcgagcaagctgagcaccatatgtgtttatgccaaatatacacaactacgtagtcttaactttaattcataaatcttaccaacaaaaaataatatggacagtaccaaaacgttctggttataaacaaatcagttgtgttctatttttttgaccaggacaatcagtcatgtgatgttctaaacatgatacctatacaatgtgaattgctgaatctttaaaattccataaatacacttgtaaaactattctactgtttagtatagtgttatctattatagttgcagtgcaagttacaaatatgtagtaaagacaaatacgggcttgtttggtttgaaaccctaccaaaatattggtagtaccaaaccttgggcacattttggcactaccaaattttttatagtacagatttggctccactctattgatttggcaaaatttggctccaatccaaaatgctaacatgtactattcaaaactaccaaagaattggtagggaaagaattggcaccaaaccaaaatggccctacattaaatgcctacagaagtcaaagccacagtccagaaacattgtgtatagtgtatgactgtaccacacactagcttatggtatgcctaatttttttagcattctttaattgtctattagtttacaacatgctggagaaacatttcaggatgccacattgaaactcatcgagtgataaatttctacaccatggagttacaggaacattaatggaactattcctaaaactggatcattgtttatagaaactaatctagacatgacaacagatgatgtggaagaaaatagaatgcagcagttaacagaatcctgttccatatacatctttgcacaagtgaagtacaaaatataagttcattcaaggccagaatcgaattgtctcgtgcaaaattcctatcaaatttattgtgttccaaacaaacacagggacctaataaaaaattgaaataatggatccaaaagggagcttacgatgcggtcacagcagcagctggagtggcagcagcagctggagtggcagaagcaactggaggctgtgcacttggaggtgccctacgaatgacatgataataaataaggaaaacaatatttgacattatacaaattagaggaatagatataactcacggttcaggtgtaacaacaggtgcttgtggaggtggtgttcttgcaactgaggcaactggagttgctggttgagactagtgcaaataaacagtaaggaattttcaggtcatgaacgaaacaaagacactcaaaagttatgcagaaataacaaaattacatgatgaacatattcaattgcttttgaacctaaaatcagctaaagctaaaacaaaaacaaaatgacaaattatacctttccataatcagaaaataagattactttctttacagctctctaagctcttgttggttctagtcattaatcacatgaattggagatgtgcaacaatttacgaattaacaaatggaaaaattaccaggaaaataacaaattttcaaacaagagatgaaggtgcataacagaacagaatatatttatcccaaatactggataccaaaaaaaaaagagaggagtgcaggttgaatccctaactaattagataaaactttttcatatgaacagagacacgcagagattattgacagaattatatatgccaataaaattacctggctcacaggtgcctttgaagcagttgaagctccacttgatgatgctttggcctgaaattttatacatattcaacaagtgattaatattcacagaaaaatgaataattaaaagagcttcaaactacacttccaccgttaatttcagcagaatttaaaatgttaacataagatcatcagaggtcaaaggctcaaagagcagtcgagatatcatttagaactcaggcaaatcatggaatgttcttcacctaaacatgttaattttagcctcctggacataacacaaacggctgttaaaactaaaaaaaaaaaggtaattacttcctgtaattagagggtgtatttaacagcaataaatatcatgcaaagcttgcacccgtattttgcatatcaatgatttgttcgggtttgatgacacaacacaaagtttgggctctgattttggctatcggatgggaagaataccccaatcacacaaaagtttgcatcccatacatttagcaattcattcagttataacattacaatttaaagaaatatctagtatgaaactgcagcattaaccaaaaaaaatacatatattcactaataatgtacacataatagcacgattataaaaagctacaaggcccagcttaagggaaacaaagccacagtattcaaaatatggcatgattttactgcaaattatcaagaatactctggtctgcaaatacccttattgtctagctgtaaataataatttagaagggtagttactgctaaacaatcaaatgccattaaacaagatcatcacataccttagacagcattataacaaggaagctgttctcagcaactttgttgccttccaaagttgtatcatccttgagaattttcccttggtgtatgagcatctgctgatccgccgggtacacattctgcccctgagtactctcaatgattctcttcacctcagccacctgcaaaacagagctagctgtaagtataaggcacaaatagtcccatatccaagcatacacacattaaacattgcagcatcaaccacattgacaacagccaggttctaatttccaaaaccatctcctacagatgccgagttcgaatttctaccaaaaaaacatctacacatgtaacttaaaccgatcagttcacaacaagccgaattagtagcacacgactcagattacaaccctaataacaaactccgagcgcccaaaaaaaaaaccgatccgaagctccgcatcgcgtcgtctactactctactctaaaccctagattcagatcaaaaccacacccgcgcaaggcgcccgatccccccgaaccaaaccctatcccaaaatcgcacccaaacgccccccgaatcgagcggattcccggagaattccctcgaaatcgcgcggattgggggagagagaaggagaggggggaagggggaagggatcgtaccgacgcctcggggctcgcctcgatctcgaagttggtgcccttcagggtcttcacgaacagcttcatgtcggcgacgtcgccttctcccacctcggcgatatccctatccccgactctgccttcgcgagggtttggactttctcctcccggttcgctcgcggcggcgacgacgacgacgaggagagcgcacggggcgagtagtggtaaagtttataggggcgagagaggaaacgaaaaaaaaaaatctcttagtcccccaatatctcccggacatcacggggcccgatcctaacccctctcacttacgagtgggacccactgggatatggacccacctggcagtgggtggtacgggtaggcggacggggtggggagggagacgagcagcgttcggtgggcggatccggtgcggcgtgcacgcgtgtggcgtctggtggttgggggttgggatacatgtgtatgggtagttgaagcggtggtgcgtggggttgtgcggcgtaggggatccgaggagatacttcgcagcggaggaatggatagatgccgggtgggaaaaggttgttggggttggagagcgagagcgagagatggagagagaaagtggttttcccccggagaaggcgtaaaatctgggtgcgccggcggaggagctcctccggtgagaacctgttttttttttaaaaaaaaaggagtatatgcattttactacgggatcgcctggagacgtcgtccattctggttagcaagggttgctatggaaactttgagcaaatagcctttgcctcttctcctccctgagaagtgagaatatactgaaataatgtcaccggtggtaatggcatcacccaccagctttatcagctatcgcacgcgatggtgaacatgatccccgtctgaaacatgatagtagttttagttggaggaacttttctgcctcacattttagtgtacactgtgtacttacaaggatgtgtttgtatgcagatactcttaagagcaccatattagtttttattttgcacaaatttatgaaggtgtaatgaggagaaagaatacattcatattgcatatcgaaatttagagattacggttatgcatatttttgtcaactttgaatgaagattttgtaataggattgatgtctcagtaagttgtatcccttctttttggtggcggagtggttatttatattccatttcatcttatggtagctacctttttggaatataaaccaataattatataataattggttgtagcttcggttgtagtgaatgtcggatttcatccattatctaaaagtcacttctctagcaggtttaactctctgggctcctttcaaacatgtgattttgataacgcaagaacataaaaaaatgtataaataggatgttgtataggattctaaaccataaaaataccagaagtagatttcataaaactacgtatacttcgatcaaactatcataaaactatatttaagatgttgatcacaaaactatatatttagcgtaaaatttctcacaaaactatatatttaagatggagtgtcacaaaaataaagaataagtagcaattttgattatcataaaactaaaggtttgggcaatttaatcacaacactataattttatagctccaatataacgatagtgctaggatttaagttctagaatatgtagttttgtgataacttcaatattaaatatatagcttgtgataattttgtcattaaatctgtagttttgtgatttatctgtaatttttgcaataagttaatcaaaatatgtagttttataaaatttattcaaatactaggggtagtgtatctgagtaatttacaggaaatctaacactggacctttgtggaactaaagagagagagtgaaagttcgttggacttctcaaaggaaatgaaaacatgagataggaccacaattaccaaaccagacggtg

SEQ ID NO: 59298 - DNA, 964 bp, Oryza sativa
cagcggtggcaacggtcgagtgggtgggtggcggcgcgtcgtctcctcactctttgtccagtctccagttcacgagagagagaacgcgcgtctctcgctgggagagagagagagagagagagagagggggggggggggggcggcggccgggatctgagggaacacgagtttttcaactcgcggagcggcggggatgtgcagcgttgtgtgcttgaggggaggtagtgggttggggttgggctttgatgttgttatgggctttgtggcctgtgggctacgcgaacttggcagtgggggcatgaataagttcactttagatctcttaatttgtcgctgaatctgaaattcatgcttgaatgcaaaaaccaggtatagcgtatttcccatcttacaataccgtgcaaacaagttccctcggtagtattgtgctcggttttaactgacgtgactcctttggctaagtcttcgtctcacatgatattgacgtggcgcttacgtggcaattggatcccgaaaaaataattaaaaccatgggacatacatttcatcctcgcttgtggggccacatgggccacaccaatttttattattttgtgtgtagctgacatgcgggggaatggtgacagtagtggcgatatatagagaaacagacaaggagagtaatggtgatatggaatcaaacaattcatagttttggtgatatattttaaaaggacatgactacgttgaaaccgcaagttatattgtcttgaccagagattcatcttagagctggttgcctactagtataccaaattatacatatctttttttctttttacagttttttattttaaattacttatacccgatatataatccaattataccattgtgttcattgcaattaaatctttacaacaggattttacattactatgttttgatgaaagaaatgtctatgttgtaaattacttttattata

SEQ ID NO: 59299 - DNA, 1081 bp, Oryza sativa
cgtgtgctctctgcaaagcaccaggtggagtggagggatgtgtggtgttttgggtttcggctggagccgtcgcccatcaggttctcctcgtgggcatgagctttcgttcacaggtggtgtaccagtgttggtgtagccgcagtcagagtgggtgatcgccgagatggggtctatttggttgtctgctgattgagaatgtgcatactgcagctggttgaaaccgtcagataccagagcgacatgcgtgtttatcttgcctttaggctttgatactgatgaaatgtgagtctgatcctagagatagcataacctgcatgtggtcgtttgtagcgtggcctgcaggaggtcgtttgtagcagctgggataccacgggcaagggacgagctgttggctttttgcaaacgtgtagtacatccattcacggtagagccagttaggccagttaggttcagtatagagagattcacatcagtccttgatgtggactagcttcatgagttgtgaaactctagagttgtaataaacagtggtgtgctgatggatctagatggcatattgatgatcgaatacaattatacagcagtagatatatattttgagttgcctttgctacgtattgtgattctggtagtgtattcatcctgccaatgattcctcataatacccccaaaaattgtagggatacagaatctgcagtgacatgctgattgaatggtgaaaaatcaagtttttttgattatttcattattgcagcaagcagcatatctgtgtttatattgcactgagcgaaggaagctgtatacatttgtttccccttgaaaaggaatggagtctataattgaaacatctagatagctatccaatatgaatcctgttctacatctagcctatagtttcggtctcttagtttggaattacattaataagataagatttttgagcttcaacctaccataataagcctatagtttcggtctcttagccttgctgaactttatcttacaattcttctatggggtggggattttcaagagaactgtattgaatagcaagttcaacttcaacataccgtaaatccaa

SEQ ID NO: 59300 - DNA, 694 bp, Oryza sativa
ccgcattccatgaaatgttggcaagtggtggtatccatgtttcaaatggtaaacaatatgcgctaactgatgtcattgatgccatcaaatgtgcttttggggcctcaccgcaaattgtttgcaagaagggctcagttgaagaactgaggttatgctttgacaaagatttgaaggttagctctcctttttgttcttcgaacaacttcctacagtttgtatcatgaaaattatgctgcttttagaatgaacgaccaacagcatgcacattttgaaattatgttcctacaggcctgcagtttcatttgctaaaactcaagcatttaccaacctcaaacatgctacatctttctatatgtatgcctaatagtgaaaacaaaaaacttgatcactgttgaaacaccactaaactgtacggaattcaaggtgattatatgcatcatatagtgttttctgcttgtgtttcttcatgcccctattaaggaatgttttatctgttgtgttgaaatttctaaacatgtgctgcataaattttgactggtgagtatttttcccaaactagctacccatgtgaatattttccccaaaagttgggaatgtgcgcagtcctgcacgtgttatttggcaatgtctcacatggtcacatgttgcatatgctgtacaataaaatactataatctttctttttcaaagaaaa

SEQ ID NO: 59301 - DNA, 9208 bp, Oryza sativa
ctgattcctgcccgcttaggctatcaggcatagctcgggcaagacagtatcgggtcgtgtctagggtccgacttgtgctcttgctttgcttaagtttgatgcggcctttgccatccctctagtggacaaagcacctagtcagcatacttcttgacattaagaaatgcattttattccctcatccgagcctagatatgaggggataataaaccaccatcctaaaatgacacttaattataagtgaaccctatatattttaaactatatggcatattttttgaaagctaggcccgaccgtgtgttgtcaccaatgtgaccatgcaaaccacagtgctggataggccaagggctgcaagggagctgatatatatttttagaacatgaaagctttattgaactctgtaaattacatcaaggtggtgcaattgtcctaagaacacctgttgggggggggcgtatgtgtggtgacgtggacaaactaggtcaacgataagcaaatattggtcatgagttggatagaaagaattgcgtagataccacctccatcaaagatataaccatgcctagtttgaacctacaataagcacacatggcaacttcgtgggtacaacccgaaattatcgagtctccaaacctagataactcccttggagttcaacgatccgcaatttcattatgtctatcattaatatgcatacactaaaaatgccctaaactaaaagcagcagtttaacaacaaataattccattccaactggaaatgggataaattcccgtgtgcaacaccacggatcaacttagtaccatttccatgtttgcatagcaaaataacctactaatggagttttgaagtgtgctcaacgttttaaaaagataacgacaaaaataattaatcattactaaatcatttcttcaaaaaaatttgaacctgaattagcatggcatcatcactattcaaatggtttcaatattgatcattggccacaattattgaccataggaaaatactgaagaactatagatttgcagtcgcaactaagaaacatgtttaatataaataaataaataaagagtatcaaaacatttgccagctagcatcaccaataatttgtttagatacctatgtttggtcgaagtataactatagccttagccatagccatagccttaggcttttcatcatcattgtcactttcagtttcactgtcatcttcagttttgacacctaaacattgaatagaatagtgtgagcattacaaaatgttagttagctgtagttttggaagaaaaaaatcaaatacatttgcaatatttcaaaaatgaaacagaactttaattgtgagcgttacaaaatgttagttcaatgtagttttgcatgaaaagaatcaaatacagttgcattatttcagaaattaaacaaaactttgtgagcattacaaaatgttacttacaatctactagctaaagtctaaggatgcacacagcatgaaaggagtgcgcataaagtttaaaaaggataacaacaaaaatatttaagctcgactaaatcatttcttcgaaaaattctgaacttgcattagcatggcatcatcactgttcaaatggttccgatattgatagtcggccacaattattgaccataggaaaatactgaagtgctgaagatttgcagtcacaacaaaaaacatgattaagataaaaaataaaggttaccataaaattttctagctagcatcaccaacaattttcatagatacctttgtttgttcgaagcatagctctaaccatagccttagccttttcatcttcattatcactttcagcttcactctcacattcagttttaacacctaaacattgaatagtgtgagcatttattggaaaatacgagaaaaaaattatcggaaactcatcatattacctgcaccactagctatggcgcctttgttccatagttcacgataatattcttaagccttgtcatacgttttcatcacaagatggccctgcctggggctgctaccactggctcctccctgcctggggctgctaccactggctcctccatccaccctatcggatatcaccatcccaccattctttatgccaactcgcagcaactcaagctgacctgcaatatatcgcatcatatatattccatcatgcatgtatgttaataactaggtgaagaatccatgttgaacaatattgcattacttcctcataggctacatgaatttgatattcacttcctatatataacctaaaattcaaagaaaagattttctaaaaccgaatttccataaattttgtctgtattttcttttataattacgtgtactttctttcctgttgaactccttccagattgttgggttttctggtgcaaagaggattattagaacgatcaaaagtgatacagaattaggagcttcaacttgttacattacatgatattttagcacatacaagaatattgaactagcaaaatatctcgttgtttctttttttttcatggtaacacatttgactagagtttgttctcatcaacacattgtggtttagtctaaaaggaaaggagttgcttgcaattatttgtttgtgtgtactgatatgtgttggaacataaagtgaattaaccatctttcccccatcagctttaagcttttggattgaactgattagtgcatcaatgctagatacttaaggggcctcgcgtgaggaagaatgttagaatataaagtgaattgcctatctttccccatcagcttaagcttttggggttgaactggtcgatgcatataactcaaagtgtgcatacgcatacatgcataaatccacttctatgattctatatttgtaaaacaaaataaagtaaaaaattctgcgtaacagcctctcctgggcacttctgaagagcaacttgaagctttaagcttcatttttcatgaaaggtccagcctttgaaaattttaattcaattattgaaaggctgctgagctgacatggttttactgatggacaccatgcacgagagagagatgggaggccggaggggagttggcagcggctgctagcgctgtagaaaatggtagagcagagcagcggcacaattaaaaagcaaccaatgatatacggagcttgggaatacctaagctgaagcctagaggcggctgagcaagtgatcggtgagaaactctgtagtagtacttaaagactcccgtatgtacttcagcagaccagcatggaagcttgacaaataccgcctgtttcatatttcttgaccttttttatagctaacatggtctctaaaaatatatcttttattttaacacataaaagacaagtaaatatttaattttattgagacagtgttttcaaactagagttattagttattgatagtcaaagtttaattgttcgatctcaaccttatttcaaaggttaagaattatgaaatcgaaggaaatactttgatcccaatccgtcccatgatataaggtgtttgaagttccacaatataagacatgatcaaacttggcatattctacaaaactaatctttgacttttagattctgattatacgataatgttttagcaactaagttcacatgaaagtaaattcaaatgctaatttaattatatgagtaaagtgcatatagggagtagataatttggctatttctagctaactttgaaataaaaatgtttgtaccaacaatagcatatggttcctatatatgactacctctacacacatggcatgcaagatctgtaaggtcaaaatgatatggaaaaatttgcgaaaggggacatcctggtttgacagttttagctgcgtcgtagaagcaaaactttgggaaaacatattctcaaagtatggctcttaactgatggacactgtgcctattttttattatatttcttttattgagaagagaaaggaggccagaaaggagtagctaaaacatgcatggaaactcaggagttctcttgcgatcagaattgcttcaccgaggcacatgatacatgtgacctgtgaccatcatactattagaggtcatatgcttttgattttatattgaattacaaaattaccataactatctcctcaaaattacatagatttaatgggatttaagctatgtgaacagaaatatcacttgcgcaaaacatgtggctaagctggtataaacatcaacaattgattggagttaattaatctcgtttattttgcattttagatcttttgtttgaaacaaattcaacttaaaataagactgaacgcaactatataaatattaatatgttatactaaatatattttcagggtatatgtaacatggacacgtggtctccatgtgttcaaacatgtgctaactgctaatcactttttcagtagcgcacattcagctaagtgttaactcattttgagtgaaaaataatcacaaatatctgaaatttcgatagacactagttaagcataacagaactattatcggtactgaaattttgtatgttttttttcgtttctatttgattgtcttctgaagtaaagaaccaaccaattcagtgtcctggtagcacaatgtcaagaatcaactcatgcttaatcaccagcgtttatatagaccagatctcctgttttcatgcgtgaaacttcactgtataatgtggtaacactgctacagaacccttatgggtaccggttgggaatctggtttccagtcggtaccaatttggcggcaccaataccgaaccgcatgggatactcctatcgtccaacaagattatttagatttccactattattttactataaaattaattaataatgcacttgcaagaatttctaccaaagtgctaaaatctacatccaaaatgctaaaatctagcaactagtgaaaacacatgcatcaataaaagaaacggagatagaatatagagaaattaaccttaaataaaaaatttaaggcaaaacctcccctcctctagctagacgagtagaatagaggcgccactagctctgtctactcctggccagcttgaggtaagtaggaggtatttatactgcacacaataggtgctggttcttaggacaaaaccggtacctattttctattataggtactggttctatgttaaaaacagacccaatacccccaagcaaaaatcagcacctataagtgggcccaccttccgaaagtattggtggaccgttagtggggcccacttataaatgatggttctgtcataagaaccggtgcctacacctccctgcatataggtgctgatttttctaaatgaaccgttacctataggtgggcccacaagtgccaatgtgccggccggaccaactataggtgtcggtttttggttaataatcgacacatatgcttgttggcgaaaaatccgtgttcagccgatggtgccaaaactgtgttaacacggactaagtcgatgaacacaatagcctgggagatatgcttagctccagtgcaagtccaaaatattgatgagatgcgggcgtgccagtcagtttgatcctgtagctgataagatatgcaaataacagatcaaatagccgatcggctgacaagccgatggagtaattccagccgatgccgataccagccgatgccgataccagccgatgtcgatagggttttgaacaattggctatatatccaatgtatattctgatacttgagtaaaaaatgatataattaaagacaatcggcgggtgataatcaatataattcgacaatataatctagtagaaactaatcggctaataatgatacgatagaacaagtgtcgatccaaaggttaaagcatatattggctggaaatccgatgttataaaattcaagagattaattagataaacagtgaaatctttgttgcgatcggctaaaactaacttgtatacaatccttgtaagctgattgtttgtatttcttaacgatattactagaaatataattcccagcaatggcgtagaaataattcctggtatattatggttaagtttatccacaagcgcacggatataccattgtagcattccacccaagagtattccaagggtatcgtatttgtttaatcccgtgggaagattatagtagagagaaccgtactaataatttatatgttacttgtaataatcatagtctaagcaggggttaatataatccatagggtaggatgacatacaagcattgaactactcattctcatactaaattatctaagctaagtggaaagaaagtagaaaagaatctattcctatacatctagtatacatattatacatacattctagttatatgattaactagctaatgccctctttccgatgccctcctagtacttcgagaagccacccctaactgttgagttccttacgacagcccgtcatgaccatacaaccggagctaaatacgttcaccaggaaattaacttaggactatatacacgcgtggaggaattcccgtactgagctatcaccatcagcggctgtcggtgatatgggcctgggggtatcacgtttagagggaggaggccttccccaagcccgcgtggcttcccctgaggggggtcgagcccggggtggagcggcggctgccccctcccagcttggggtcggggctgcgccccaagcccacgtggctcccctctaggagggtcaagcccggggtggagcggcggctacccctcccaacttggggtcgagcccggggtggagcggcggctgccccctcccagcttagggtcggggccgcccccaagcccacgtggctccccctgagggggatcgagccctgggtggagcggcggctaccccctcccaacttggggtcgggttgccccgacccgctccccgtatcagcccacgtgtacagggttaggtgggcacacctaacgcccacctaaccgcatttaaagtggtccttgcagccatgctatggcacgccgcatttaatgcggcatgttgcacatctgacaggtctgtgaccgatttgtggctagtctatgaccggtcgaatgaccgatgggacggcggctgtgtacccccaccctgtcagtgtgccaggcggcatgcggcgtgctctgtcccgtcacatcataatgagaggctttttagtctctcatcatagccagagtcggtttatccgctctggtcaaacaggagcccagaagtcttcatctcttaaatggcaactgacaggggcaccccctgtgtcaggcggcaagatttgacgggccacatcatcaagacgacgtgcgcttggcttcccaaatcaagatacaagacatggatttaatgcaaagattgtaatacttctccactaagttaggttgttgggcccatgtggtaaccccttaaggtataaaaggaggtctaggcctacttaaggagggggatggacagattgaggggaggatgagccattttagactctagagcagcttctgcccctcatgatcaacaccttctactccaacaaggagatcttataatttctcccacaatcagcatagcacaggagtagggtattacgcttctcagcgggcggaacctgtataaaccccttttgtctcatcgtcttggaggggcctaaccccctcaagatcacacagtttcgctctccaagccctcgaatctcacccgctacccccggccgaaccaaaaaaggggggcctcacggttccctggtggaggagttcaccttccgacaacggcccacctctcatccgcagcatataaccccaaataatgattcccgataatttagacaccacgcctaaactaccagatactactctaatatcatcgttatgacatagagtaattacaatagcaaacattatacccgtacctatgcatctcctaaataagctagcagtataatcagtataacattaacataaagtaaagttggtattcatatactcggaaagtattttaataccagaattgtataaggaagaatattctaaataaagtacaaatcttacaaaagagaaaaggagagctactagagccatacctgaactcttccgaagacttccagacttcgatttctattctattcctactcactagcttgagaatactaaactaaacttgagagaaatgagaaagctcttgcttgaagtgtgtgttgaaatggagggagtgagagccttttatagcttgagtatgacggttatgacggttggaaaaggtcggtaatactctccaaccgtcactgtggatcaatcccagccgtccatcaaaaccctgcatcgaacgaagccgcggtgggttcggccgaaccatgggctgggctggcttggctcaatttcggcaggtggcctcctcttttgctcccatacgcagacttgtgaattttggcccaattggtcatgtcatttctacattgttggtccattcattgataagtctgattctcgacattgttcgattgattgatcgtctgatttgatgtcgattctcctccactttatggttattctcttcaaaaggttagtaatcctaatattagtgaaatattattattctaacataaatatgcattgcaagcataactagttctcctctattttggtagtattgacggtcgaaattgatcgctaacgaccgtcaacaccgatgcaacatccatataactcatcggctaaaaccccgatgaaactcttattataatcaacgacatgttatgttttatgattctaaacatgactagagatgatgcatcgcaaagtatgcaaagaagcataaagtctaaacaatcaaacctttgagtaattttcagggtggtagatacattagctaatctaatctagcaagataatttagccgatactagcataaaccctataacaaatctcagccgatacaagtaaattacaatgctaaactagattgactaagatatatgataaataggttggcaaatatgtcaaccgaatcagagcaatccaagaggttgaagcgatgcagccttgaacaacgccaatgtagccaatacaattgccatggccggtggaacgtaagacttaccctttccccggagatcgaaagccgatgcaaccccgcgtcaggtgccaagttccgctgtgataagtaaaaacctcggaaaagaaagtggcgatgcgccgagagtagttgtattaatctgtggagatagtttacattga

SEQ ID NO: 59302 - DNA, 4100 bp, Oryza sativa
atatatatatatatatatatatatatatgttacttcgcatttatcctaatacatcttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttataattagacttagtatgtataattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaggggaaccaggaggaggaggctagtggtagtcaaccctccgttggacagaagagggcacgcgggcaacgaggtgcagcgaagaagcttgagggtcggcacatcataacggaagtgcaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagagaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacttgtcccgttgatgacatcactcagcggacaccatgtgagctgcatattcctttcaagaacttatcaataaaggtaagatttagccattccgctagttgttgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggtggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctacccacacaagggcaacgaagaaggcgaaagttgacgctgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcgaaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtatgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccctcatttggtccgcggcaaatggacagaaagacttaggcggaagttcaaatttcctgtgagtacacatgctctacatttatatttctccgattcaaatacatacaagtgtat

SEQ ID NO: 59303 - DNA, 11392 bp, Oryza sativa
taattcatttgtatcaaatattttgatagaaatctgggtaattaaacaatacatttattgtagatttatttcctcctgttttggctggatatagcctcacgataagtacttccttcttgagatatgaatcacatgggcattagctggcaagctattaattatttatatcaaatctttttagataactatgaccaattaagaagtacattaattttagattttcactgctatgtttgcatgctacacagtaaatggtatccttttccccaatatgaacatatatattcaacaacttctcttattaaggactcatttttactgaccgcgcatattttccagcaaagctcaaccttcaagcctgatagaagctcttttgctgccctgattgaaaatcgcaaaaggttaatccagattaaccatagaaggtactaccaaaatccccactggcatgaatccactgccagaattcttcaaacttttttccttatttttatgatatatggacaaaaaaggatattggtgatgaactaatcttcagcactactttatctttttgcttccaatgtttgttttgcatttcttgtcgtagttgaaagactccatgagtgaaaagaatttaaatttgttttaaaatttttaagttgactatatgtggggaaatttgttttgggtaggattagaaggaatggattcatatatttttgttacgaacaattggtcaactatataattcaaaagagtaaattgtacgggcggtccttaaacttgtaggggtatgtcatataggtcgctaaactctcaaaatgcatatccaagtaccagaacttgtcatagtgtgtaatataggtcacaaatcgctacaaccccttcaggatcctacgcagcgttgacgtggcatgccacatgtacatgacatggcattattttgactgacaaatgggacccatttaaaattttccctttttctttttttcttctcttttcccctttcttctccttcatctatcatccgtgcagaaaaaaggaaaaaacagaagaatgagaagaaaacaaaaaagaaaaagaaaagaaaaaaaagaaaaggatacgtcacgtccatgtggcattgccacatcagcgtcacgtagtatcctagaggggatgtgtcaatttgggacctagataataaactttgacaagttctgggacctggatatgcatttcgagagtttaggggcctatatgatataaccctacatgtttaaggactgctaatgcattttactctaaatcaaaatgtttgaaacttaacaaccccgtaaggtataaaacaaaatatactgaggcaaatattatcttgtgacttggaggaattaaacaataaatttactgtgatatttcccacttgttttgtttggatacaacgtcatgaaagattgtacgcctctttatcaaattccttctcctgacatgactaatttattattttttcaaacctttagataaatcatattattaaggattatatgtaattatacagagtcatgatagataaacttctttgactacttccttcttcagatatgatttagttaggaagtaatgaggcaagctattaagtattttaagtatcaaatcttttcatagaaatctgagtatttaagcagtacattagttgtacatttgtctttagcttacatgttattaatttatttgtatcaaatattttcatagaaatctgggtaattaagcagtacatttatgattgatttatttcctcctgttttggctggatatagcctaacgataagtacttccttcttgagatatgaatctcatgggcattagctggcaagctattaattcatttatatcaaatctttttagataacaatgaccaattaagaagtacattagatcttgattttcactgctatgtttgcatgctacatggtaaatagtatccttttccccaatatgaacatatatattcaacaacttctctttctgaggacttttttttgctggtcacatattttccaccaaagcttgcaaccttcaagcttgacggaagctcttctgctgctctgattgaaaatcgcaaaaggttgctccaaattaaccacacaaggtactaccaaaatcccctctggcatgaatccactgttagaattcatcaaactttttttcttatttttatgatatatggacaaaaatggatataggtgatgaactaatcttcaccactactttttctttttgcttccaatgtttgttttgcatctcttctcgtagttgaaagactccatgagtgaaaagaatttaaatttgagttttaaaatttgtaacttgactatatgtggggaaatttgttttgggtaggattagagggaatggattcatatatttttgttacaaacaattggtcaactatataaatcaaaatgtttgaaactttacaacgctgtaaggtataaagcaaaatataccgaggcaaatattatcttgtgacttggaggaattaaactataaatttaatgtgatatttccacttgttttgtttggatacaatgtcatgaaagattgtacgcctctttatcaaattccttctcatgacatgactaatttattattttttcaaacctttagataaatcatataattaagggttataagtaattatacagagtcatgatagataaacttctttgacaacttctttcttcagatatgatttagttaggaagtaacaaggcaagctattaagtattttatgtatcaaatcttttcattgcaatctaagtatttaagcagtacattagttgtacatttgtctttagctggcatgttattaattcatttgtatcaaatattttcatagaaatctgggtaattaagcagtaaatttttatagatttatttcctcctgttttggctagatatagcctcacgataagtacttccttcttgagatatgaatcacatggacattagctggaaagctattaattatttatctcaaatctttttagataactatgaccaattatgaagtacattaattctagattttcactgctatgtttgcatgctgcacagtaaatggtatcctttcccccaatatgaacatatatattcaacaacttctcttattaaggactcatttttattggccgcgcatattttccactaaagctcaacctgcaagcctgatagaagctcttctgctgctctgattgaaaatcgcaaaaggttgctccagactaaccacagaaggtactaccaaattccctctcgcatatccactgccaaaattcatcaaactttttctctaatatagcttttgttcttcgttacttttttttttgaaagtttattttgcttttcttactggtggtaaccggaagccacggagcgagaggaatttaaattcgaattttaaactttgtaatttgtgtatatgtggagtaactagttttagttttgggtacgatcagttggaatgaattggtatattcttgtcacaaaaaaggtcaactctataaaatcaaagtttttgaaactagacaacccggtaaaacagaatcaaatcttttcataggacttcaagaaattaagaaataaattaattgtggtatttgcttcatgttttgtttggatacatcataaaaaaaatatttctctttatcaaatttcttctcctgatatgaatattttattatttttcaaatcctttgttagaaatcttagtaattaaggatcacattaattataagtaattacatagcctcgtgatagtattgatagctaaatgtctttagcttgttccttcttgatatatgaatacactagcaattagcacgaattctgttaagtcttctaatatcaaatcttttcataaaaggctgagtaattgggatataatattattaattcgtttatatcaaatcttttcatagaaacctgggcaattaagcagtacatttattacagatttgtttccttctgttttggttggatacaacctcataataaataaaccgctttaagtacttccttcttgagatatgtatgaatcacttagcagctatcaattcatttatatcaaatatttttactcaaatctgaccaattaagaagtacattaattctagatttttgcactattttttggatgctagtacataattaatggtatcctccccccataagaatatatattttcaacttctcttaatgatgacttttgttttactgaccacaaattttcttccaaagctcagaaccatcaagcctgatgcaagctctcgtgttgctctgatcgaaaaactgcaaagatcgctcgagattaaccacaaaaggtacaaccaaatcccctctgacatgaatcccagcgaaaattcatcaaacttttgcaatcctttttatgatatgtgggcaaaaggagcatgtaagtgatgaactaaccttcattacttaatttttttccttcaaaagtttgttttgcttttattactagtagtagcccagaagtcagggagtgaaagtaatttaaatttgagtttttcaaccttttaattggctatacgtgaggaaatttgttttgggtaagatgaggtggaataaattgatatatttttgtttgagacaaatggtcaactctatataatcaacattttcgaaactagacaaccccatcgggtaaaatgaaattcactctggcaaatcttttcataggacttggagaagttaaacaattaattagttaattgtggtatttgccgccagttttcatttgataaaacatcatgaaaaattatacctctttatcatattccttctccttgtatgattaattttttatttttcaaatctttcgatagaaatctaagtaattaaggattacattaattataagtaccaataaagcctcatgatagataaacattttttaactaattccttcttcatatatgaattaattggcaagtaccatgcatgctattaagtcttttaatatcaaatctttcgtagaaatctgggtaatgaagcagtacatttattatagatttgttttctcctgttttggctagatgcaacatcatgataaataaataaatttaataagtgcttccttcttgagatgtgaagcagttggccattagcatgcatgctattaattcatttataccaaatctttttacctaaatctgaccatttaataagtacattaactctagattttcactgctatgtttggatgcttacataactaatggtatcattttcccctatattactgatcacacatgttttcctccaaagcttagaaccttcaagcctgacagaaactctgatcggaaaaccgcaaagtcgcaccagattaaccacagagggtacaaccaaaccctctctgccatgaatccataggccacagccagaattcatcaaactttcgctcgcatttttatgatatatggacaatagaaaacgcatgtaaatgatgatcactaatcttcgttactttcttttttgttgcttccaaagtttgtttcgctttttgttactggaagcagtcagaagccatggacgcgtccaagaaatccgtcatgacgaaggaggagcaacaactgtcgccagcagcaagcccagcggcagcagtcatgacagccgaggctgatgccatcaacgaggaacaagacaaggctgctgctgctacaaccgcagatcacactgctcctcctcctcctcctcctgctgctgctgctgttgcagatcacgctggggagatggacatggctagtggcagcggcgttgctcacctggcaccaccggcggtggcgccggcgccgcggtcttctctcgctatggcggtctcggggctggcggaccatgtcctggagcgcatggtgaaggtgctgatgaggaagtgccacccgccgcaggcgttgtacccgctgattggcaagtcgccactgcggccgccatggtggccgacggggcgcgagcagtggtggccggagctcggcgccggcgccgtcgtcccgccgtacaggcctgcgccgctgctgtccaaggcggagaaggaggtggccgtggtcgccatggtgaagaacctcgtgccggacttcgagcgcctcttcatggccgtgcgaatggcgcccagcgtcaccagcaggatcaccgacgccgaggcgagggcgtgggacgacggcgtcgccggggagcgcgagacgtacatggcgcggcacccgcaccgcacgacgccgaccagggcgtggaagctcatggattccctcaagccggaggcggtgaggatgaagctcaaggcgcccaagccgaagccgcaggtcaccatcaaagtcgaggacgccgcgcctttcctcactgtctccgctgccgctgaccccgccgccgtcgaggccgccatgggggccatcgaagccatgagaaacagcagcaaggatccagatgctccgtactatcccatgccatctccacttcatgggcataatgaagttggtccaaatgattacccaggtatgaatatgatacgaaattatttgatatttcaccaatatgttttgttccatatatgtgctgctgaattctgaatcacttttgatagttctaataatcctcttttgcaccagaaaacccagcaatctggaaggagttcaacaggaaagaaggtatgtgtaattataaaagaaaataaagataaaattcatggaaattcggtttaaaaaattctttactttcaattttaagttacacattagtcatcacggattctgcacctagttattaacatgcatgcatggtggtacatgtatgatgcgatatattgtaggtcagcttgacttgttgcgagttggcaaaaagaatgaccggatggcgatatccgatagggtggatggaggagccagtggtagcggccccaggaagggctatcttgtgatgaaaacgtacaaaaaggctcaagaatattatcgcgaactacggaacaaaggcgccatggctagtggtgcaggtagtatgatgagttttcgataattttttctcttgtctaaaatacaatagaacatatagaaaatagtatggttggctaccgagaggagtgaaccgcctaggcagataagggtcagggttgttagctggcttaaccagctgagtgcacataggccaacgattgatcaccctcaattatttcaaacaaaaaccacacgttgaaagagtttttttattgattgatgatcgtagatctttgcgtatgtcgacaccacttcctacgccttgctagatatatagtaccgtattgttggcttttagctgtattattttttttgtcggtcactccttgcatgtcgtgtgcatccttagatgatgttagctggtaggttggaaataacattttgtaatgctcacataattttgtttaatttgtcaaataatgcaactgtatctatttttttcattcaaaactacaactaactaacattttatgaggctcacaattaaacttttgcttattttttgaaataatgcaaatgatttgattttttttatccaaaaatataactaactaacagtttatagtgctcacactattcaatgtttaggtgttaaaattgaagatgacagtgaaaccgagagtgacaatgaagatgagaaggcaaatgagaaggctaaggctaaggccaaggctagagctgtgtatcaacaaaataaaggtatccaagaaaattattggtgatgctagctggcaaatgtcatggtacctttttatttttattttaaacatgtttcttgtgattgcattcctatggtcaataattgtggcggatgatcaatatcggaaccatttgaaccgtgatggttccaatctaattcaggttcattttttttaataaatgatttaatagtgcttatatatttttgttgttatcctttaaactttgtgaacagtccttagatgttttgtctatccttagacattagctagtaggtaggaagtaacattttggaatgctcacaatttttcaaatttgagaaataatgcaactgtatttgatttttttttacccaaaactacatctaactaacattttgtactgctcgcagttaaagttttgtttaatttttgaaatattgcaattgtatttgattttttcatccaaaactacagctaactaacattgtttaatgctcacattattcaatgtttaggtgttaaaactgaagatcagagtgaaacagaaagtgataatgaagatgaacaggcaaaggttatggcaaaagctaaggctagagttatacctcgaccaaacaaaggtatctaagaaaattatcggtgatgctagccggaaaatgttatgatattcttttttttatattaaacatgcctcttagttgcgactgcaaatctttagtacttcagtattttcatatggtcaataattgtgcccaatgatcgaaatcagaaccatttgaaattgatgatgccatgctaattcaggttcaaaacttttttgacgaaatgatttagtcatgcttaaatatttttgttgttatcctttttaaactttgtgcacacttcaaaactccattagtaggttattttgccatgcatacatggaaatggtactgagttgatccgttgtattgcacacgggaatttatcccatttctagcatgaatggaattatttgttgttaaactactgcattcagtttagggcatttttagtgtatgcacattaatgataaactaaatgaaattgcggatccttgaactccaagggagttatctaggtttggagactcaataattttgggttgtacccacgaagttctcttgtgcgcttgttgtagattcaaactagggatggttatatatttgatggaggtggtatctacaccattctttccagccaactcatgactataatttgttttccattaacccagtttgtccgcgcacctcacataccctcccccccccaataggtgttcttaggacaattataatttactaagttgaataaggcttccatgttctaaaaatatatatcagcccccttgcaatccctggcctatccagcagtatggtttgcaagatcacgttggtgacaacacatggtcgggcacaactttcagaagacatgcctatagttaaaaatatagtgttcacttataagtgtcattttagcatggtgttttgttatcccctcatatctgggcacggatgagggaagaaaatgcatttctaaatgtcaagtatgttgactaggtgcttcgtccactatagggatggcaagggctaggtcaagcttaggcagagcaagagcataggtccgaccctagacctggcccgataccgtcttgcctgagctatgcctgatagcctcagcgggcatgaaagacacgccaatgctgagtgggcacctgaaactcaatgagtcacaatcgggcatctgctccttcaccgccactagggtggggctagcatcccccatggagtaaggaaacacaacaccacaaccaatggtaaacaaggactggaaattttccctcaattaaactattcattgtcacccacgtgaccgggccaagatgccaagtagaaaatagaggtgtattgcgatatgtgggttctcatcttttgtccatgcatctaattgccacggcacgatgctgatccgcgcctacgttgccgtctgctgagctactagtgagttctcattaggacattgtcctcctaagccatgcctccacaccacacctccccccttctcccggcgtgcagagttattaagtacgacacttttttggtatgttcattgcacattaccgtattcgatccaatgttgcatccagcaaacacacatgtacaacattacacagtttccatggtaaatcgtatttgcacgtaaagaaccagcagtgaagctagctcctgggctggtcgggcgaccaccggctccatcgccgacttttgcactatttttccattagaaacacatgtaaatatttatcgatcaataggaaacactcttcatcacctgagcttgatgacgtcattggctcctccactgcaaagaacatacttggctagatgaagataaaagcaaatagctgcactccagaaaaacatatttgatcctttccttttgtacaaacagaggactcaggaacatatggcaacttggtatatatagcgggtatggtcgatgatggaatcatccttttttttaagtcaaagaaagactttccattgtcaaattggagacatctagcaattctacactccaaaaagtccagaggtttcccaaaggacggtaagatgggcccttccttccccgagtgaacaactcaaacttccctctcccctaagtgatagcagtgctagtttgataacagatcttgtctattagcctgaggagggagtcttatgagtgaagcatgaaacaatatggtaaggttgagtggaccgaccgagatctaaaatactatggttaggaacaacttgacttatctcaacaagtggtttaattagctcttctttcacaaaacacaaatccttttggtatgaggctctatgagcttatcatttgtactcttatccatccattttaactccttttatcgactggagaagcatagcttccttacacgcgcatgacataggatacgtgaaaacagatatttgtactagcgatcagccgatcatcaggagaggaacctctacatcccacgtttcttcaaatgcattctacagtatatttagggaaactatgagtcattgagagagaccacatttgtaccaatcaaatgcacttgtggtgcactaacattccgttttggtctcgtacactccttatgttaaaatgtcacctagacctcctttggccgcatcattcctctcaaccaaaactgtaaatcaagcccactaacccccgtaccatataaaagctatgattttaaccatgaaaaattgatagatccaatagcgttggaggtagtttgatttgatggagtgatgacttatgcagcaagcattgtcgactaggcgaattgtggacgcacctacagagtaggtggctgggcgctgacagagcagatgccctattggcactcattgggtttcaggtgcccactaagcatgggcgtgtgcactgattcatgctcgctgaggctattaggcatagctcgagcaagaaagtatcaggttgtgtctagggtcagacttgtgctcttgctctgcttaagcttgacatgggctttgccatccctatagtggacgaagcacctagtcatgaatcaaaaatgtaaaccaaaactgtaaatcaagcccactgacccccgaaccatgtaaaagctatgattttaaccataaaaaattgatagatcca

SEQ ID NO: 59304 - DNA, 17107 bp, Oryza sativa
cgtgtaccctgtctaggatctatttggcatagccaatagattgaaacaattcaagggatacttttatcccatgccaagttggtatggccttaacccacttatatttccataccaaattgcagagatcaaaacatttaagggatgcttgatggaatggaaatctagaaaaaaaatagaaaaataacatgataaaaataattggacactgaactttttttttcttctaaatttaactttttttgaatttgaaacccattctaaatagcaaatgttcaaatattttaggagtactgatacaatgaaaataactaaaattttaaataacatataatagaaaatagaatttttggcattatgttggaaacaaaatctaacataatttcagttcgaagtatacaactctaaactacaacttgagagcgataaaagtctcattttttaatatattttctgatttagaaaaacttttactgctaaaccatagtttcatactgcaatactatataattacaattaaatcattatttcaacatattcagctcatttaattagatcatgtaatcgtattagccatatttttaatagaaaatatcttcaattgatatatcctaaaattcaaaaaaacatatatagtgcaaaaaaagatgctaaatattaaaaaaataaatgcattatgtacaaatgcattatgtagaagtgatatatagtttcatatatatatttcttataaaaccaaatttgcacagttttaagtaattttagtttagaatttatacgccagcgatgtttactagcattcaaaaaaacaccacacaaattattgaaaaattaaacatgtttacaatagagtaatcataaaaattcctaatcaaatttctaacccagttaaataagatgcccgcgcatatgcgcgggctaccttcctagttatatactaaaagtccattaaactttctacaaacgctcttaagccaccacgtggcactcctacaaacgctcttaagccaccacgtggcactatctaatctcaccgtcgattttcacttaaattagtagactcgttattttacaccattagattagatctattatttaaaaataataacttcctcatatattatataacatagaaacgttaatataacatagaaacgttactgttcagccatagagtttatatacgatacagaacgttacgtacgtattgaaaataaaacaataaaactttcccaatgttacggtatttatttaaaatatgattttctacagtataaagataaaatatatttacttcacaaatataaatatatttagtcaaattaagatctattataaatatccaatcaatgttctttaaaacatcttataaatctatctattatctatcaactatatatatactaaaagtacgttaaacatacgacgaatgcatttacgctgctacgtgtctctctaataaattagagaaatcctagaaatttatttatatactaaaagtgcattaaacatcctgcaaaaactattacgccgtcacgccgtgctataataaattagagaaatcctagaaattcagagaaaaaagaaaggcatatgatcctttaatttttacttaaattggaggacccgttatttaaaatattagtttagatctattaaaaatcccatgctgctaatctctatctggaaaaaaaacataatgtgcgtacgtcgtacgatcgtctccatcctaaaaaaataaaacttaaatacctacaccatatacgataaataaaacagataaagccaaataaataaaagaaaacatgcacacgtacatagaatcggaaagaaatactaatcgtgaaaaatcacactgatgtgttgtcaacatcctttaaactattattttattaaaaataacactacacagatatgcacattaaacttaatctctgatagataaaatgtcaaagcaaccgtctgacaaaacctaacattgtgttttaagtacatctgttttgggttatttaattttggagatcagattctcaaaatatttggatttgttcaaaacttttttattcttatttgatgagtgagaagcacaaataatagatagatgagaaaaattaaattaaattttagacagtggttttgcgataataaaactacagaatttagctttggtttttaagtggatcattttatgtttattttgggtgacattgagattttaagtatctgaaattttttttattgctatttgaggagagagaagcatacatcatagatagatgtaaataaacaaataaacaaataagaattaggcagttattttgctacaatacaatccttaattcatcatgagaattatgattatccatgtatgttttttctttgccaagtagtattggcaaacatgaacaatccagtaaaacacgtataaaactataaattctatatactgagtataattgatggacgaatgttatacacctctgaacccaattttgtcaattctttacctcaaatcaactcaaaacttaaaaataatactgtttttgccacctcttcctttctgtatatatctgtccttcaatgttgggtgtattacttgctatgccatcataaatattgtagagacatgtaaatggttgagttaaggtggtgtcctaaaaggccaccataaccaatgtaactaaaatgacatacttaccaatgcaatcatttgtgagtgtgccaatagtgaattgagtgttaaaattgtactttaagatggtctttaagggcacagttacatcgatgcgaaacccgtgtttcaaggcattatgtaagaaagccttagttggctgctacggtcgacttcatctgttagaaaatcattcatgaatatttttaacggtgttatcgtattatctggtagatatgatatttttagacaatttatacatagatgtgaaaataagttatgcacactgggttatgcagtgtagatgatatttttagcgtataaataatgtatcatttattttagtggtacaaatacagtttcttttattaaaagtgcacctaactttcaaaaacaatgatagtaagtagtggtgacaaaagacgagtttatatatgaccaggacaaagggatttttacttaaatctaataaacattctatcacatttagtaatctataccatctattttacggcaaatatatttgttttttttatttagggtaatctatattcccttacaggatatatgtattaatgtatatactaagatatgatttattttagcattctttttcttgaacaacaaataagatgcccgtgtatatgtgggggtttcttttccgatttatattctgaaaatatcctccattttatattttgtccttacattggttgaaacatagcctatgatacatgcatgcgcgcgcgaatgcgcgggctaccttcctagttagtataataattagtgctaatctaaatggtgcatgtatggagctcatggttagtttctaatgtatggatacatacggtggagcccggatgcctatccgtgctggctgggccttggctccgtcgctggtacagagaatgaggttcaaattagttactactttcgtcccctaaaatatagtaatcagaatatttcctaatacgacaatatatagacaggagatctaccccgattcataatattaagatgtgtcatattctacaaatggagaaaacaactcatgggacatgtatgtgatgacaataaataaactatggccatgtttactttatgtgccaaaatatttttgaagtatatggacacacatttaagtattaaacgtagactaataacaaaataaattacagatttcacctataaactgtaagacaaatttattaagcctaattaatccgtcattatagcaaatgtttactatagtatcacattgtcaaatcatggtgtaattaggctcaaaagattcgtctcacaatttacatgcaaactgcgcaattagtttttttttcatatttaatgctccatacatatgtctaaacatttgatgtgatggaatttttgaaagtcggaaggaaacactgcctatgatgtaggcccccacctagctaggttaagagctgatgtgaaagggatcgatccctaggttaagagctaatgtgaaagggatcggagtgaggttgaacctgccgacatctctgccaatatggtcactctcagtgagagagtttcattctcactaaatagtgtcatgtcaatatttatatgacgtctcttaaaaaaatatttatatgacgtggcaagtaattaataaaaaagagatgaaatgaatttcatctcgatgaaactatttatacaccgttttcaatgtgacttgtttctacatgtgttgcctatgaaacaacaaaaataaaacagtatattgtgttagctatttcaaccatcaattaaatgtcttactacctccgtcccaaaataagtgcagccgtagatatccgtgtccaacgtttgaccgtccgtcttatttgaaaaatttatgaaaaatttaaaaatatttagtcacacataaagtactattcatgttttatcatgtaatagcaacaaaaatactaatcataaaaaaattttaaataagacaaacggtcaaatgttaaacgtgaatagtgcaaaactgcacttattttgggacggatggagtattctttatatgacactcttttttttttactgaactttatatgacactcttagaaacataaaaataaaacgtcccactaggaatgacgttaggccatttttcacatagagttccaagagtgacacgtgcatcaaacaaagaggttcggattaataaataaaacaaacgcttctaacgcatttcgtgatttcatatgctactcataacatttagttgttgaattgtgttgttaaaagagttgataccagtacgatttcatttttaatttcaaggcacgaaatgaaatgattctgttgctgtgggttttattttgtttctaagcattcctaatggataaatgcatatatatgtagtttcatttcttgatttttaggttgagattcctaacagattcaagttgatgaacaaaactaatatatccaatgcacaattttatttcgtggtttgatatgtcgtccatagtattttattattgaattgtatcatgaaactatttggttataatagggttttatttctgttttcaagacacatgagataaaatgaatagggttccattctgtttcgaaggcataggtaagtatgtaaaacaagttttttaaaataaaactcatttcttctcacttgtaaatttcttggcatgtcattagtttagcctatgtgatatcttatttaataacatcgaaactcttgttaaacatgcattggaaatgacctaggtattaaaatttcacctaaatgaaactcattcattttctttatattttttcagtttagccttatcgtttaataagattgaaactcttacgcaacctgtcctgaaactggccttaggttaggtgctaaggagactattagagagagaaagttgagagttcttttaagactatagagaggagagttgacgttgtccttcaataaacatccatgtggacaggagtctgactttctccatagctgtgccaattttatatgttcggtgtacgtgaatatagaagagagggaagcgagagaggacacttgacttcgcccaatgagaaacatcggcatgccgattttgtgacgaggttcggtgttgacgagaataggagggagggagaaaaaagaaacacacatgtagatggatcggactttttatatcttacccttttttaaaaaaatcttattttacaaatatactcttaaaaaaattgttctagaaatgaacatttttctcgatgctagaattattggtctgagattcaatgtctcggtgccaataacattgacatcgatatcctcgcttcttgctaaagctaagtcaccgatacgaaggatcggtgcaaatgacattagtgctaaagatctatttgtaagaaaaaatatttgaattttaaccttttctgaaattcttttataaataaatccttagtgtcagttagtagcagagccaagcctgatcagcatgggctagtggcctagtgcccagtctccgccaaacgaacgcgtgactttccagttagaacattaggcaaaacagtgattacccttgctagattatttggcaaaccagtaaagaatgcatgacagcatgagtgctcgaactagattatctaggcaaactatcgaagcaattaagggcaaagcatcacaattcatgtattaacatatagcccactaattaagtaatacataattattgtccaatcaatctaatctattgatcaaaatggtttttctcttctaaaccacaatttgatagcgttaacttggctttcattaatgatggatagcccatagagttgtatgaatatgtgtgttcattagaattgcccagattttagaaaatatatagatccgccactgctgccagtgttattgtaactaaaaaggattaaaatataaaaaatgcagggtaagtgaagataattaaacaattaactgttagtgtgtagtgttgtttccaaagggcgatttttgttgaaataagacatttatctcaaagttgatacaactatcattagattgcacagccaaagcaaagtttttgggtgaatacacactaataactatcagtttgcatactagattgtgttagattaaataagctggaccaatttaatcctaataaattctatgtgcccataattaatgttaaggaattaatatcacgttgaaaatcaacgtggagggatctcaacttaaatagactgctattggagagcaattgttgagcggttaaggtggtggtggggctgccacacgcatgcgcgcgagccgggccagggcaagggctggctgctctatttcccaaacattatgttttaactaaagatgtaactgatggatgcactcgttactccaacaacgaaacgttatggtttgattgaagacataaccaatggaggtgctcgttactctagcaacagatggggaattcaatcggattgattcgggcgctctcattactccagcaacggacatttcaatctcgacttgattcctcctggaacattactctcttgtacactatataactcccaccttctcgttactccagcaacggaacgttatgttttgattgaagatataaccgacggaggcgcttgttactgcaacaatagacggagaattcaatcagattgattcgagcactcccgttactccaccaacagacagagaattcaatctcgatttgattcctcccggaatattactctctcatgcactacataactcccacctctagaatagacatagtacacacaaatgcccagtacatcttctctctcgaactctgattctcttgttgggaaaatcttgttttctctgttcctacgcttcttgtgtgtctctggttccgatcacctacgcacacaggacaatcaattttttggggagcgcattctagagcgactgctctcatcctcttcctcttcatctactctgcactgctagttcttcttcctatcaaaaggcagcaatggtggaggtggcggcatcgggaccgggcaccggcacatgcgagaacagcaacaccaacgtagacaacaacaccaacaatgcctcatctagtaccggagcattctccaagtaaccatgttaaccatgttattagatgatacttattttgttattgccatgttctgtttagcactatcactagatcattctacacatatgtcatgtcatgttcagtatgatgtttttctgaaaattaaaatatactgactaaatttccaccacatgcgcttgagtgaaacaacctctagctaccttctccgatattgctaacttgccgctgcaaccaaaaacctgtaaacccgatttttttggaggatagcccaaagtatggacccggtagcaaaatattacggctgccactagcaggactagcaggttttcgaattcctccctgacacatgacgaggttgaaccatatgatatggagaacattgcgtgagcagaccggcatagccctatgtatgtacctgatcacgtgacctagaacttgaattaattattctttttcaaccatatattcaacttaatgacacgaaatactattaggccaactatatggaaggtggttgattccaccggacagtgaaattctaccatgacaaactgattacgtttagctttgacggccattaatttttcagcccccaacctgattacagaaataacgattcatctagtgtcagctaaccgacgtgagagacttacgcttagttcacaatcgctatgttttttcaaacaaatttgtcaatactctgaccataaaagttctttataacttaataaattataagtggaaaattgctaatagtacaacagagtcaataatctgaaaagagaaaggtattacgtcgtttgctctgttcaactaaaaccaaatcatactaaggtacgtcgttcggagcgtcacattttcacgtccagttgtctgccaatatcgagcagcaggcacggagcaaattttcgacaagttgaataaaactgcgggtgcaaaacagcggccggccttatgctgaattatttgacgttattgcaacgacagatttttttttaatttagtcattattgccggccggtctaactcaatataggttattttatatattcaagttggtttcattattactgtccctgatgctacaagtgtagaagaaaactgtgcacagtgaaattacactcttagaaccaaagccaagtatcttttattttactttcgataacatagttcctatagattttaacaaagttcatttatattatcgtgtagaatattttctatttcgtattttagttggataccataaaaaaagtggtggagacttgtgccatacatcaattcttttatttatcattttagactgtccataggtggaagatgttataaataaaagaaaagcagtggcgagcagattgcctgaagccttaaaactgagtataagcacattgcgcttcaaacaagagtttacaaaaataaatttcagaagactcgggtacatctaaggtgcaaaagactataggtattttagcatgtgccatataatcccgaggattataatactagtgttttataaaaaccacataatttacgtgtactgtgtgacataacttattggttattttatatatcttagatcataatattgatggttttctgcaatttacttttttttgaaatgattatattgctcctcgcacattcgtaactgctggcttattattgaaaacaaaattattaagctaaaaaaattccatctataaaaatttgaatcagacaaaattgtttgacacaaaattggaaaaccaaatttaaaattgaaattggaggggaaattacacaaatcagtacttctccgcttcttagaatacaaaaagtagtattcttttaataattaacttcaaccaaattgagatgaacataccttttagaatttcatcgaatttgtttaagattcatttcaggatttattaattttttgtttcaaattttggggccaaataattgtacacccttctatttatacccaaaacatgattgtccataatcacgaatccaacaagcattacagaatcctaattacttaggaaatctctcaaactagggaatttctatacaactccaaactccaatattttcaaacatgaactccaattttcatgccgtgacaaattcatcccaaattaaaaaccattatctaaatggaaaaaagaatttattaaaaactaaaaagaaattagaaacaacaaaatacgtacaagaaaattttaaaatttaaatgtagcttgcagtattttcattaaattatccatagtccaatacgtcctcgtgttttacttgaatttttattccaatacgtcctcgtgttttacttgaatttttagagcaccaaaaataattattacacaataaaaacaacgtacagagttttctaagcatagaaactgaaaataaatcatccctcctccttgtgccatgtctagcccagtcttccatcttccctcctttcatgcggcctgcttcggcctccctttctctgggcctcctccacatcatggcccatcccgcctctcgtccccagcccacctgcactgcctccctccctccgcgcctgggccgcctcgcctcccggcccagccgccggtcgtcttcctcctctggccgaccgttcctctctcgctccttccttccttcctcctccattgaagccgccgccaatccgccccttcctgtggccggctctccctccccgacctataaaacggagcctcctccctcccctcgctccattttgccacctcccaaattcctagctgcctccctgtctccaccgcgccacccgagctccggcaacccctgccgccatgctcgttcgccgtcagacgttgtcggttccttccccggcaccgcgacgtcaacctcctcgccggcctctctgcctccctgcccgaagctcgttggatccgcgccctcgccggctcccgtgcctccaaccctctgccaggccattgctcctcgccggagtaccgcccggcctcgccgccactcccgtttgcggttgcatgttcctccttggctgccacctcccgagcccttttgggcgccggaacactgtcgacgccaagttcgtccatccttcaccgtgtcagctgtcctagtagcctaccaaagatccctgatgcgtccataatggactctagcatgatacttggcccaacgggcctaaagatggtgacataacacccggacagattctggatgcccattgtttcgatgattttcattgacttcaaaggggttttaatatgagactagattcattagaaaggcggtctagttagctttccatacttgtacagaacgtcgaaaatagagttcagatgagataagggtgatgattttagtgcgggctgctccagtatttttgagatggacttgaatttgatatgagatagacctccatcttgacttgaacgcccatcttgaccttctccatctcctagtctctagttctctccatagttcctaatcatatttaaatcattatgtaataattagtcctcaaaatcatataaaagaaatacctaggaacgagctcacatgtaatttcaattgttgggcatgagctctagtgattagatcttgcatagcaacttgaggaatattgtgtgtatccaaattgttgatgtctccatcatcatccccctcatgaagtagagtcgtcctcgacccaagcttatcttcttctctcaaatatagctccaaatcgaaaatgttaaatgtgggactaacctcaaactttagaggcaattcaagtttatatgtattatcatttatcttttccgatattctaaaaggcccactggctctagacgccaagtacaggaccgctggttagataactctacattgaaatgtcatttttgggagttaaattgctaatagtgttgaatgatgaatatattaatttgaaagcacgtaaagtttttatgagagcttcggaagttagagaagcatgttgattgaaacaatacaagcaatatgattttacatgccaatttgacctccctttatagtatgtctgattgtggcaacatttatttaactgtaaaattattgtagtgaaccagcgccgctacggctgggaaggaaaccagaggtgcatcgctgtcagcactggcgtcctgtccctgcatcatttgtccgcatcgcgtgcctgcagcctgttagagatagaggtttgttacatagagttgttacgtgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatatggtatcagagccaatcatgcacgcgtgagatcgcatctaccaaaaatggcgagttcctccaattccaccaccaatccactctccggccaagttgtcccagagaagctcacaaggaataatttccttctatggaagacacagatccttcccatcattcgcggtgcccgcatggaggggtacctcaccggcgcgactcgcgctccgtcggcagcgatcgacgtcaaggaaggcgacaaggtcatcaccaagatcaatccagcctatgaggaatgggttgtcgtcgatcaacaggtgcttggatttctccttgcatctgtatcaaaggacatactcacccaagtcgtcaatctggaaacggcggctgcgacatggagagtgatcacaacgatgctctcctcacaatcccgtgcgcgtgctctgaacacgcagcttgcactgttgacgacccgcaagggcgatctcagtgtcacggagtacatcggcaagatgaagacgctagctgacgagatgtcatccgccggcaagcccctcgatgacgaggagatgatgtcgtacatcctcgccggactcgacgacgattatgagcccgtcgtctccactcttgtcggcaaggcggaggctgtaccagtcgccgaaatctacacccagctcctgagttttgagagccgagccaagctgcgacagcaggctaatggttcctccgtcaacagcgcacgacgaggaggcaagggaggcggcggcggcttcagcaacaacgtcaacaccggcaacaccagcacgtttcgcggccgtggcggtggtcgcggcgatcgcggaggccgggggcgaggaaacggtggcggcgcgcgcttctccaacaaaccgcgccccacctgtcagctatgtggcaagattggacatgtggtggcagactgctggtacaggtatgatgaaaatttcattccagattcaaaaacagcagctgcggcttcctatggtgtagatacaaattggtacatggacaccagagccactgaccacatcacaggagaactggacaagctgacaacccatgagaagtacaacggcaaagaacagattcacacggcaagcggtgcaggtatggacattaagcatattggtcattctattattcatacccccatacgcaatattcagttgaaaaatatccttcatgttcctaaagctaaaaagaaccttatctctgctcatcgtttagccgttgataatcatgcctttgttgaagttcatcctcgtttctttgccattaaggatcaggtcacgaagaatcttcttcttagaggaccgtgccgcaatggactgtacccgttgccaacatcttcattcgccacatccaagcaagtccttggagccatcaagcccacaatgtcaaggtggcatagccgtctaggtcatccttctctagctattgttcaaaaagttgttagtaggaataatctcccatgtttaggagatgtcaatgagtcaggagtctgtaatgcctgtcaacaggccaagagtcaccagctaccctatccaaaatcctttagtgtgtcaaataatcctctagaacttgtgttttcagatgtgtggggacctgctcctacttctattgggggcagaaagtactatgtcagttttatagatgatttcagtaaatttacttggatctatttgcttaagagtaaagctgaagtttttcttaagtttcaagaatttcaacaacgagttgagcgccttttcaatcgcaaaatcatctctatgcaaactgactgggggggagagtatgaaaaattgcactctttcttcactaagattggtatctcacatcatgtttcatgtccctatgcacatcaacagaatggttctgcagaacgcaaacatagacacatagtagaggttgggttggctctcctttctcatgcttcaatgcctctgaaattttgggatgaggcgttcctagctgctgcctatctcataaaccgcacacctagtaaggtcattcagtatactactcctttagagcgcctccttgatcaaaagcctaactattctgctcttagaacctttggttgtgcttgttggcccaatctccgtccttacaacaaacacaaacttcagtttcgctccaaacaatgcgcttttcttgggtatagcaacatccacaaaggttttcagtgtcttgatatatcaactggcagagtttacatctctagagatgttgtatttgatgaaaatatttttccctttgaaaggttacatgcaaacgctggagcaaggctgagatccgaaattcttttgcttccttcctccttatatcaaaatattgcaactaatggggttgaacataatgaccgcatgcctaatgtccctgagcaatctaatgtgcctgttgagcatgtgacagatcaggagatacaattcggagaaggttcagaaaatacagcacaaaatgatcacagttctgcagcaaatattgaaggagatgcaccggatctggatgccacagaagatcctgaggacatttttcctggcagcagcgatcccgagggaggatttcagccctcacctgtgcacacgcctgcactgtcttttcccgacgatgaagaaatcggcgaaaccggtggcttgacgtctctgcagcagggggagcagtcgcatgcagccacgtcgtcaagcagccatcatgatggggggagcggcagccctctgaccggcggatcgtctgcacccgacacagccgtggctgagcccgcacggccggtcactcgtcttcagcgaggtataagaaaacagaaggtttataccgatggtactgtaaggtatggcatgctgacaactacaggagaacctcaaaacctagatgaagctttgactgataaaaactggaaagatgctatggatgctgagtttactgctttattagaaaataaaacttggcacctaattccacctagtcatggtaaaaatgttatagactgcaagtgggtctacaaaattaagagaaagtctgatggtagtctggatagatataaagctcgtctagtagccaaggggtttaaacaacgctatggtattgattatgaggacactttcagtcctgtggttaaagcagctactatcagaactgtcttgtctattgctgtttccaggggatggtgccttcgccaactagatgtgcaaaatgcttttctgcatggataccttgaagaagaggtatatatgaggcaacctcctggttatgaaaataagagtaagcccaactacatttgcaagttagacaaagcactttatgggttgaagcaagctcctcgagcttggtattcaaggttaagtactaagttgattagccttggcttccaagcttccaaagctgatacatcattgttcttttataacaaaggaggtgttacaatttttgtacttatctatgttgatgatataattgtggctagttctagacagaaggcagtatctgctttgctggcagatttgagtcaagaatttgcactcaaagatttgggggatctgcattacttccttggaatagaggtcagtacggcaggtgatgatattttactgaaacaagaaaaatatgcctatgatttgttgaaaagagcaagtatgctagattgtaaacctgttagtactcctctgtctgtatcagaaaaactgtcagctcatagtggaactgctctaggagaaacagatgcaactagatatagaagtatagttggagctcttcagtatctgactttgactaggcctgatatttcatttgcagtaaataaggtctgtcagtttttacatagtccaactatagatcattggatggcagtgaagaggattttaagatatgtgaaattctcagttgatcttggtcttaagataagtcgttcatcatccactcttgttagtgctttttcagatgctgattgggcaggatcaattgatgacagaagatcaactggaggttttgctgtgtttctggggtcgaatttggtttcctggagtgcaagaaaacaggctacagtatcaagatcaagtacagaagctgaatacaaagctgttgcaaatgcaacggcagaggtaatgtgggttcaggctctacttaaagagctaggaatagattcacctgaaactgcatgtatgtggtgtgataatctgggagctacttacttggctgttaatcctgtgtttcatgcacgaactaaacatattgagatagactatcattttgtcagagaaagggttgccagaaagcaattagaaatcaagtttatatcttcaggtgatcaagttacagatgggtttactaaacctctcggtgctccacaacttaggaatttcagatacaatcttaacttagataagttatgattgagggggagtgttagagatagaggtttgttacatagagttgttacatgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatacagccatcccagtaagatcccgttaatcatgattcacttggggggaggcaaagcaggaggaagatgatgccaaatttgcattcattttaatagatgttgataatttgtttcacctctctgctggaaaagtttaagaagcattcaatgtttaagaattaattttcttttgaaaagaatcagataattaactacgagcaaagaattcagcaaacttcatgtcttcatcttaacaagccagcccaaagtttttagatttaattgatcaagatttcattctgtttttgtttttaaattcactgaaatatttgtttttggttgtatgcatatatattaggttcagtttagtagaacaatcctatatgcctggagtttcgaactttcgatggcgacatggcgtgtttgcagtcca

SEQ ID NO: 59305 - DNA, 15717 bp, Oryza sativa
cctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaagtcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggtgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacaatgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttatccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaacaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgcagaataacatgaacatatcaaatatgcgcaacatattgaacacgtaccgaggtgatgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgtaccggatttttcggaacgtttccaaaacaaaaacgaatccgaatttgcagcaaaacaaaactgcaaaaggaggctgcatctgcgcaagggtgctgcatctgcgcaagggtgaggagccaatttttcggaccattcgacgcgtacgtcgtgcacgcgcgccgcctgccctgccctgccaggccaggcgagcgagcgcgcgcgtgtgtttcccctcttctctccaccacacatgcttcaagtggctaggagagcatcctcccttttaaggaggtccccctctcctagaataagcaaggtggtactaaactccacatgcatgccatctcatgaggtgggcttttgtgattttccaaagaattaatcttcgagtgggctaaggcccattcattaattccaacacacttcccagagtctttccaccgtgcatcttcggagacgtcctagcgacagctgcaaaaacaaaggtttgatcctcttttccctcaacggttcaaacgaaataacaactcccagtgggcatagtcgacggtgaacatggaagatagacgcgatatcaatgcattccgagtgatgagaaggaactaaaggtaccctttctaaaccaacacctttgatgttccacatatccaaaaagtcgagaagccccccatcacccttgagatcggtcaacaacaaaaaacacagaatcaacattcaagaacaaaatcaacatccacatatcaaaaataaaatccaagaacacagaggggaggacaccgaaggagagaaggccactgccactactgctcattgtgggtgaagtccactcttgagcgccgcatgatgggagggcagcaccattcgttgagggagtcgccgtgccagggacaattgagggagccgctgccggcatcaagtggtccgtccctgagctcacagcgatggatccaaccgcccccgtgctcgtggcggcagatttggccacccccttgctcacaacaacaaacccagcggagaggaggagggacggcgtttgtggcagagatgaggggcggtggtggcaacgtagataggagtggtggcagtaaccaagagagagacggagaggctcagagagagtggcgagagagagagagagagggagagagaggctggactctagagacagagtcatccatatataaaaatccaggtcggctcgattgtcggcttgactacctgaggagtgttggttttctaaaagattacccggttgaagcattagcttgctttagatggtatacgggcggcaatggaatgggttcacatgcccattatagcggataccagattaccggtaatataatccagatgtggcagttagccttgtgaaggactgctccggccagatatattcacaggcaacggtgattactgaagtaattaataagcacaatgcagtgttaaattttactaaataaagagcgaaccaaatagagttggcggatccagcatgggggcggcggggtctcgagccctccattactggcgtgaagactatgagagaccccacaaagaccccactaaaattttttaccatgggagggggactgtaactctatctagtttgcttagaccccactactatttatttctagatccgccactcttcatatttttgctcagcaatgtgcacggcaacatatatggaatggcgtttctgtgctcccgaaggaaccccattctcttccaaactgttcagattcttacccagaagataaattttgctacggaacacctcaaattttagataatttgctgatagatatggtaaaaacgtgttatggctgaaagacaccataaaaaactgataatttgctagagaatactttcgattcaattgaagagagaattcttttcaaagacgagaatgcccctagggccaaaagcttctgagttgaggctggagtgaaaatggaatatgatgtacgcttgcgatgtacttaaggtgatcacaaatttaaagttgcataatttctaaactttcactctaacatcatgtgttaaagcatgtggtcctaagggtattcttgtttttcttaagaatttatctccagcaaagtgttctacaagaatttatgtgcagcaaattgttctccaacaaattactattttttgggtttttttttcagctatcacatatttttgtgatgtctacaagcatattatagaaatttcgggcatcatgtaacaaaatttgcctacccaaaatataagaaaaggaaatatcctggggaaatgagctatgtgttgaaaactcatgaaaaccatactttaatattttgtaaattcatgaaaaaatattagagataggtgtaaataagaaataaattctcactaaatgttaagtccaaactcaacttcatttgagagaaagaaatgacaaacttcatatgaatataactcacaaaataaattagaagctagaaattaagaaacctaacttccccaaactttatatgagtagaactcacaaaataaactagaagctagaaattaagaaacctaacttccccagatttttatgagctgtttatcataatcgcaacttctcaaacaagatcttaagctcaactaagatagattttttaagagtgaattcagaaaactattgatacatcgaccaaactatatatcatgaaactatagttttaagaggtatatcacaaaactatagatttaataatcaatttgttacaaatttacaatttattttaaggtgatgttctaaggtagatttatgtgctataatatcggtgcagaaaaactgaaaacgaggagagagcgagagaagagctgggggcagctataaaaaaaatgtatatttaacttgtactcatatataactattcaaaaaaatgtgcacgacatagttggctagcgccacgagcgagactgcaatcaataggttgcgaggctgattctttctttagctagtgcatgtgttagacaatttcttttaccaaccccggacgaatgtcaatgcaatccgactgttagaagggaaattcactgtttaatttctagcgattccagaagagtttggtgctgcaaaattcgcagcttttctgatcttctttctcctttatttattgatctcctcaagtgggagtttgttacatactacaaacttttcttctttttcttttttgtttcatattacacacaaacatgaccgattaaaacgcacgatgcaacaaacgcgctatcccacgtcgtggcacatccgacttcggtcagaaaacgagctgaagaaacgcttaattcttggcttcactgaatataattccggtaaccccggattatatccaattaaccactacatgaaacaaaattaattaacttaattcacatgagaggtggcgtgcaacagcatcgcatcaacggtcatccccgggccgaacgccatcatcactcccaactccggccattcacccgccgccgccgcctccttgcgctgccggcgcagctcgtccagcgcgaagatcaccgtagcgccagacatgttcccgtagtcgctgagcacacggcggctcgccgccagcttgccgggctcgaggccgagcgccgcgtcgacctggtccatgatcgtcgacgagcccgggtgcaccgcccagaacaggtcgttccacccgccgccgccgtcgccgccgagaagtgggccgaacatgtccaggaggcaccgctcgacgttgtccccgatgagccccgggacctgccgcccgaggacgccgtccaagcggcgctccgtgaaccgcatgttcagggcgtggtccgactccgggatgatcgtctgcgccgccgacactatctcgaacagcgggcgctcgacgtcgtcggcgtcggcgccgacaatgacggcggccgcgccgtcgccgaacaggccctggacgaggagcgtcctgaagcagccctcgtcgggcccggtgaagtacatgagggtgagctcggcggcgacgacgaggacgcgcgcgccgcggctgttctcggcgaggtccttggcgaggcggagcgcggcgcagccggcgaagcagccgttgaggtggagcatggtgcggcgcacggaggggcggaggccgaggagcgggacgaggcggaagtcgacacccgggacgtgggcgccggagttggtggtgacgacgaggtgggtgatgtcggcggccgggcggccccactcggcgatcgccttcttggcggcctccgccgccagctccggcacggcgtccgcggcgatgtccagccgcgcgtcgagcgacggcgcgtcgcggtccacgaactccgggtgtgcggacagcatctcctccgtgtggtgcaggtaccgcctctgcacgcccatttcctgacctgcgaccgaccatggacagcatgctctcgcattgtcactactcactaaacttgcaaaaacatatactacatccgccctaatactttgaattttaatttgtagatttttttttataatttgtagtttgtaagagttctaatttgtatatattttttataatttgtaatttgtaaaagttgaattttaacatgtatatttatcgactgatacatcacatgctaatacatctttttttttgcaaatttattttgtaaccatttgggtgatatatgtaaacaacgagtggacgtgtgaacgttttctcgagggtttaaaatccattctcggtggaggttgtatatgcaaaattaatatatcgactgagaagagttggatagtagaaggagagaggctgtcgtgtgtttacacgtacagatacgcttgaacttgtccttgagggcagtgaggtggtcgctgttggtgacgcggaagtagaagtcggggaactcctcctgggtaacgcagttgggagggttggcggtgccgatggcgagcacggcggcgagcccgtcggcgcgctgcgaccgccgcatttcgccgagcgggtataaggcgcttcccatggtcgtcgtcggtgccatgcaaacaattaaatcactgcaactaattcttcgatctcgatcgatctccgcccgccttgcttggcacgtctcgcacttttgttttgcagaccacctcacacacttatggtgtttatatagcagtgcgctggatatatgacccactgcttgtttgtcagttgccagatttttcaaaacatctacgtgtgctgttttgtgtatctatctattatctatatatctatctatctataagatatatcttaaggctgcgttcggcagctgccgattaagagaagacttatctcttcactttccgagtaattaaacggtgtgtttaattttcttcaaaaattttcaataagagttgctttaacaaatcatatcaatctatttttaaattttaaaatagttaatactcaattgatcatatgttaatggctcacctcattttgtatatctcaatcttctcttttcatctcctttcaaacacattaaagtccattaaacatcctataaacgctccacgtgacacttctacaaacgctttcagaccatcatgtgacgctctaataaattagagaaaatcatatatattctgagaaaaaaatctatccatttagttccactcaaattagtggatccgttattttgaaccactagattacgtctattaaaaattaattccgtcctaattgatttcccgtgtaagtaagagataaaatacctacgcatagcttcacatgaaaataaacctaaaacacattaccccttgaacttcttagtattaaaaatcaaccaaatctaaatagatagccacatataatgtcaaattacccgtagcaaagcatgtgcattcaactagtttacatttacatttatatgctcctaattgtcttataattaagtgccttatatatgtcgccttccactttggcgtgcagtgtaaagtttagttctgacttgattaattaggcaatttcaatattaccaatcaataattgtatgttatacttgcattggtttaaaaccgcataaattttagtgaaattcaaagttcatcttggagtcctcgtttagtttttttatttaataactcaaattcaaaattaacgattctagctagatgtacactagatgtagattgaattgttatgattcgattagggcacattatttttctagttacgttgtttaaattatcaaatgtttctcttttagaacattagtatcaaataactacgacatgttctttcttagcagataatggataatccggctttgacttaagaacaagctacccccacttcctatgaagttttcaactgaatcaacagtaaatatgcatactaatgaaaaagatgacaagaaggagaaacattattaggaggcttcctattggtgaatcttcatccaatgttagtgaagatttgcatgaccattttctccaaactctggcgtacaatacatatatgagttccttgtttttatcacacttttatagttgggcccaaaactgcagccaataaatataaaagtacttgcatataagatttaaaagtagctctgtcaaacaccatatcactcatggtaaaccaaagaacctaacataaaatatatggatctactaaaataagctttatggttcttacgtcaacggcactaagctaactcccccaaaatgtgaaacattatttggtggattcaagccaaaataaatacggaccaatctccaaagaaatttagcaaagtgacaatcaaagaatatatgttggacagtttcaatatgcatacaaaagcaacatttttttagtactagcccaatttagtcttgctaaattatccctgtttaagatatcccctttaattaagcaaatatcacataaatatttttattttaagaggaatcccattttgttcttctcaatatatataaccattgttgattgcagctaagtacataggatggatagagaacataccattttgatgaagattccatcaaaatatatctttatcctcatttagattaatatcccaaatcattggttcattgatgtacttggctagtgcaacgaggcctgatatctcatttgctgtaagtaagctgagccggtttgtctcaaattcgggagatgatcattggcaggctctggaaagagtaatgcgctatttaaagggcactatgagctatggaattcactataccgggtactcaaaaatactggaagggtatagtgactcaaactggatatctgatgctgatgagataaaggccacaagtggatatatgttcacacttggaggtggcgctgtttgctagaaatcttgcaagcagaccatcttaacgaggtcaacaatggaagtagaacttacaacactagatactacgacaattcaggccgagtagcttcgtaaactcctgatggatttgccggtggttgaaaaaccagtgccagctatcctaatgaactgtgataatcaaacaatagttattaaagtgaacagtttaaatgacaacatgaagtcatctaggcatatcaaaagaagactgaaatctgtcagaaagcagaaaaactccggagtgatagcattggactatgtccaaacggctaaaaatctggcagatcagtttaccaaggggctaccatgtaatgtgatagacagtgcattgagggaaatgggcttgatacccacctaaggtcacacaatagtggaaacctgtccattgtgatcggaaatcccgtgaatttggatggcgaaacaaactattgtgtggctgagagaagagacccttaaaaatggctcattttcatgatgtacttctcttctattctgcatggtaggatggcttatgccttaatgtggtccaagtggcttttctaagcagagatgttgacctgcagaacatctcaaaaggaacacacctatatgagttcgactgctagccacagtctatgagatttgggcgatctctagatactcatgaaagggccttgagtttgacttatatgctccaaaaagaggggatgcaaacggcaacccagtaccaatcaagggtttgagtgaaacctgatcacacaagactaacaattcaaggcatagtccattgtttagttgtggtctgatgtagctcattttctaggtggaagttcaacttaacagtctctaccaaaacattggtatatcaaacaggttcaactttgagaacatttcttatgagccatgaaatttggtggggattattagaataaatgggctaggccctaattttctattaaatctcaaggccccataataaatgttaaggataataataccaccctgagaattaaaagaggagtatctcaacttaaatagggagttattggaggctcgctgttgaccggttgaggtggggattagaaagccacacgcgcacgcgcgcgcgccgagccaagccgagccagccggggcgaggctgtgggcgaggcgtggcgtggcatgcgttgcgtctctctctctctcctttttgcaacggaccggaatccaatcccgcgagattgcctctgtaatggatagttgattcaatgcgattgattgcatcgttactgcggcaacgggcggattcctctcctgcgctattaggaaatagagcaccccgatcagatctcaaggcttagtttccaaacgctggttcttcctcctcgcgcctgtgctgcttctgtttttcccggttctgatcgcttgcgcacacgagagatcgggacgaggagggcctctaaaaccacacattcgcctaagatctgcaccgggtaggcgggtgatcaggtttgcacgactgctcttcttctgttcgtcgtctgttcatctgcatcaccatgtctggagttgtcgcacctagagatggcacacctggagcgggagccggagctggcgccccgatcgacaataccaacggaggcagttctgccacataatccagcggagggactttcacagggtataactctctaccgctatttctgtttttgttacttctgttagtcgcaatgctattgcgttctctacatgatgatgatgcttattctatcttaagcacgctcctggttatgtttaattttatcactagatcacctcacattgttcatgccatgattattgtcttaatattttggattaaaatatgccgatatatgactatatttccaacagttacatgattacatccttacaaaatataagaatttacatgttattaagcagatattaaggttttaaaaacactttaacactccttatatggatggttaggggtgggaaaatggtaaagatatatatatatatatatatataggtcatggttaatgggaccctttactctaaacaatgccacatgcaatcagttatattttaatatgttttaaatgctataagtgcttacctttagcatcaagcatgtggtttccccgccgtcgtgcagctaaagatatatacacatgcatgacgccatcgtgcgtgaaatttcttggtacagactcgcggtggcggatttatgaatttttttttagcctgcacaaacctaatgatagaaaataaattaacaagcaaatacaaatacatatagcattttatcatgaatagaagtaaattggctatcatcatttatatactaaaagtccattaaacttcctacaaacgctctcaagccgccacatggcctcctacaaacactcctatgtcgccacgtggcattttataatctcaccgtcgattttcttttaaattggtggacccgttaattttaagcgttagatctcccttagagaaaaatcatccccactatttttgagaaaaattaccgtatttgctttaactaatagatagaaaaaaaaagagaataccataataggacaagaggccagtgaggatcgggcagggtacatacgttctttttttttctttttctggtggcatacgttctattttttttcctggtggcatacatacgttactacgttagtatttttttcgcctttttttttggcaaacaatactttttttgctttacacattcggcaaacagtactattactacgatacgatacgtacatgtacgggagtttaggggggaagtgttaatagatataaaatcacatgttaccaatttaagggaaaatcgatggtttgattttttttctcataatttttaatatttattttaatttagagatatgacatgtagtgacctacaagcatttatacgagcgccacgtgccggtttaaaagcgttcgtgggaagttcaatggacttatatatactaaaagacaattaaacttcatatagacgctcatataaacgctcatacatcgtcacgtgacattctataatcacaccgtcaattttcttttaaattggtggacccgttaattttaaccattagatctccatctcaaagaaaataaatctggtatccccactactaacaccttacatacatgaggtaaaaaaaagctgtacatactctttccaccctccgaatctcccctcctctcctattttctagctaacttatcctattttataattaacactcaatatatcaaaaaaataattcagacatctaaataatcataaccctcaagttacaattttattctcattttttgttaattgttgtgttatttataattaaatataaaattcaaaatccatattgatcatattttgttatctaaatattagatcatgcaaccattctaactacaaatgtctaggcctaatggtacacctataaacgcttctaagtcatttgccacatgacactattaaattaaaaaaaatctataagtgtgacaaatgaaaacaaaacatctaaccatcagtttacacttgaatcaatggatgcactatcttatatggttagatctatctttaaaaggaaatcccaaaactccgtcccaaccgtttgtcccgttcctctctccctaccattcattatctgttatttttatctccatagcaactaaatcgaaaattatctttacgagaaaaaaaacacacccacaaatggactccgtctaacaagtctagcgagcttttcctttgccatgtgcttctcttctctttctccttaagctagcacttatagaaacaacctaattagaatttaaaataatcgtaaatttttaaatcttatattcaatttatgacatttttaaactattgtaagtttcaattaaatcaataatttaatacattgtggacccatctattcaccttgaaacctccaataaataaaataaaataccaaaatttctaattaaaaattaaaatatcccaccttatgtttttaatagcagtcaacccattatttataccatgctaaatagctaatggccttcttccaactccttctgttttagattacaagtcattttaaattttgtctatgtcaaattacttgaattagtttataaaaacatagtaacattttcaacacaaaacaattatattataaaaaacatattcaattttgaattcaataaaaataatttggtgttgtaaatattgatatatttttcgtcaacaatggaagtagttaatttctcttaacattcaaataggggctatttacagatacttagatgcgcttttatgaataaatgatcttttttagagataaatagacgttcctaagatcatcatcacatctaaattatacatattatatctgatgtcactaatagattagagtaaaagcttttaattatatcttttttcttgtcataacgtgtaccctgtctaggatctatttgtcatagacaatagattgaaaacaatcaagggatacttttatcccatgccaagttgtatggccttaacccacttatatttccataccaaattgcagagatcaaaacatttaagggatgcttgatggaatggaaatctagaaaaaaaatagaaaaataacatgataaaaataattgaacactgaactttttttttcttctaaatttaactttttttgaatttgaaacccattctaaatagcaatgttcaaatattttaggagtactgatacaatgaaaataactaaaattttaaataacatataatagaaaatagaatttttggcattatgttggaaacaaaatctaacataatttcagttcgaagtatacaactctaaactacaacttgagagcgataaaagtctcattttttaatatattttctgatttagaaaaacttttactgctaaacc

SEQ ID NO: 59306 - DNA, 4585 bp, Oryza sativa
ctgacaaaagaacctcaagccaacagcatgggaacaccatttccttgcactgtgaattcagcttgatcaacttccccaaagctctcaagaaattaagaagcctttgttcatctaaatgaataagaagatgttgagaaagagaagaaaactgctcgtccatcaaaaattcatcaactaactgccatgcatctctggaattctcctcatacatcaagtaaacgaattgatctacaaaatattctgtgtcaatttgcagtatttcaccgtctttgacggaatcagcaagctcttcagaagaccagaagtctgggacatactccaggaaattttccacagtccgcagaacatcgagatcacgaaaataatggggcttagtagcaacaacagcaggagactgcccatgcttgcctttccactcaagctcttcccaacaaatatcacgattcacaaatgcaaattgagaaagtgccctagcacccttcttatgtgtcaattcaccagtaaccgcaaagtgaccaaaccactgcattatctgctttggattccctgtagaacataataaatggaatgtcactatgtcagaaagaatagatgctcatgctcctgccagtatcaaaccagtctttctgggttgcaacagagacacagaaaactcaatatgctttgtatatttgattcagggcttactacagctgcacagcacaaaaagttacatggatgtttagcatgttttcagtacacaaaggcactcaccctacaatctctctgacaaattacactaaataagatcatacaatcatatatgcaagtatgcgagagccaactcatgtcagtcagtccaagttgagacctagatcacagccaaaaaatggttctatacctaaaacacaaatagaaaaaggcaggaacaaagcatgatgttactgtagtggaaacaccatttcatcttcttctagtgtatggcacatttgtattaatctaagaatgtgttaaactacttgcatgagtgagggactgaggggcgggccactagttactacccattatgtgaagaagtaattcaaactgagtgtacgcaattatgcataattccatatcttgtattgccaacaagccaaacaggcttaatatttttatgcaactgtaatagaggaacaaatgtcatatttctaggtaaatccctaaacagatatatctcaactagagtatgttctggatactgaacagtgagtcgcagcaagaaaaaggaatataaaacagatatatgtgagcagcagtagaaaaattcagagcatcgagttcttagtgtaattccttaccttggaagaagtcctctagcatctggcatttctttgctataatagaacctgcttttttgggctttttgtcaaaaatcatccgcagcaagcgggcagcgacatcccgtttggaatttttcatccccaagagattgagaaacaggtcccgctggccatatgggtcgagcaaatgaatggatgagaccgtactgcagagccacatccgagcctcatacccacctccagactttataaccgacctgattataggctccaccttgccaagaagagatcgccttgcttttacagcatctgtatcaacactaccaccatctgtggtcccttgaaaaaagagttgaaccatcttccaagagagattttctacctcctgaaattgaaagttgcaaattgcaataacaatgtttcacattctccagtcctcattgaagtaacgcatataggtaacactaaaaccttagattgccaagtaaaattcaacatggatttaacttagccgagatttgatcccaacacctatttatctgttgaaacgtcataggtaattttaatcggaaaccctaaactgaaatgcaaaatttaaaagttcctggctaggaaatagaaaccgaagcacaacaggtaccaactgagacctctacggcagcggggcaggttagcgtctctcacgattcacgaacacctccaggccgaccaagtcatggaggaggaggcgaggcggagatgggaggcgaggcggaagagcagcaaagaggaagggggcgacaaggaaaggccccctgcccgaggacggcgggaggatgtggcgtgaggaggaaggcggcggcggtggcggcggcggatcgagcaggcgaggagaggaaagcctcacaactcccccgagcaccacgatctctctccagctccaagaggactccgtgattgcgaccaaattctcgaccaatttgatgaacagattaggagcgcgacgcttaccagctgggcgcggcgggggttcccagttcccactagggcacgacgaggaagagaggcggtagtatgctcgttgcggtgagcggcggcggcggcggcggcggcggagcaccgagcagcgcggcgcggaggatcggaaagaatgaggcggtgacggtgaaattggagaaatttgccacccaattcacatactttttttttctcgattcatactatcattagtaaatttcagaaaactaaatgttttatgttttatggttgaagttacagaaaaacacacatattttaacacttactccctccgtcccataatataagggattttaagttttttgcttgcaacgtttgaccactcgtcttattcataaaattttgaaattattatttattttatttgtgacttactttattatctacagtactttgagcacaacttttcgttttttatatttgtaaaaaaaattgaataagacgagtggttaaacgtggcaaacaaaaacttaaaatctcttatattgtatgacggagggaatagtaattaagtacatatatttttttggtagttttttttttcacaaaaccacaatatcaatgaatggattcacctgtgagatgacgtggttattttacctaggatgaggacgtggcatcctattaatttcatgagatggctggtaataggatgcatgtcattgtcctatgtggaacaaccaagtcgacgtggcatcctattaatttcatgagatggctggtaataggatgcatgtcattgtcctatgtggaacaaccaagtcatctcacgggtgaatctatttattgatagtgtggttttgtgaaactacactaccaaaatatatgtacttaaatgccaaatgtcaaagcgtgtgtagttttctgcaacttggaccataaaacatgtagttttgtgaaatttactctacagtcatactccctccataaaaaaaccaaactagtactgaacgtgacatattatagtacaataaatctagatatacctatgtctagatttgtagtactaggatatgtcacatccagtattaggttggttttttatacgacggagggagtacgtcttttgaaatgggaaaatctaaggcctttctggttttctggttttagtgttaacgagagactgtataggtaccttaacaatatagtaccagtccatcaagcaactagaaaatatattcctatctgtttcaaataaaaatttatccttaaactactcattcgatacacgatccgattacatggttgtgttcagaattaaatctttataacaagctcacacatgattatgttttgatgaaaaaatacaaattacttttataatattctaaattacttttagatttcactaaattacttcttagacatataaaggtaaatttaataaatcctaaaagtagaagtaacttaaaaaaagaaagttactttgtcacgacattaaaattagatccgttatggaggtaaaaatatgagtatatccagaaaattaatttaatcagtacaaattatgcaattcactaaaaatgataataaaataacaactcacaacattatgattatatgaggtaatttaatcaaatcggaaagtaatttatatatatgataaaagtaacttacatatataataaaagtaatttacaacatagacatttctttcatcaaaacatagtaatgtaaaatcctgttgtaaagatttaattgcaatgaacacaatggtataattggattatatatcgggtataagtaatttaaaataaaaaactgtaaaaagaaaaaaagatatgtataatttggtatactagtaggcaaccagctctaagatgaatctctggtcaagacaatataacttgcggtttcaacgtagtcatgtccttttaaaatatatcaccaaaactatgaattgtttgattccatatcaccattactctccttgtctgtttctctatatatcgccactactgtcaccattcccccgcatgtcagctacacacaaaataataaaaattggtgtggcccatgtggccccacaagcgaggatgaaatgtatgtcccatggttttaattattttttcgggatccaattgccacgtaagcgccacgtcaatatcatgtgagacgaagacttagccaaaggagtcacgtcagttaaaaccgagcacaatactaccgagggaacttgtttgcacggtattgtaagatgggaaatacgctatacctggtttttgcattcaagcatgaatttcagattcagcgacaaattaagagat

SEQ ID NO: 59307 - DNA, 7176 bp, Oryza sativa
gtggatcccggtttttcttaatgtaatctccattacagatggacaaatcgttgaaatgccataaagcgcgaaccaacatccatgatacgaaaaccaaaatcagaatgaggaagaaaaagatatcgtgatgtaagtcaatgattccttgcatcataggtgttgcagcgtcttgagatcctaattgccatggttccgcagcattacaaagagcgattgtgaggaatcgacattctaatgaacgaagaatcattggaatttcccatcttttttagctctgctcctagaaaggagactgatcttgacgtcggcgttggtttttccaacgaaaaacgagaacatactttcacgaacttctaatccaaaatgctagttgccttgtaacgcatacactggagcgtttgtcccatcgacgaaggccaatgagactactatacgcgttttccgaggagcaacatgatactttctttgccaggaccgactttcccacttggatgtactcatgatgggtgacgtttccacgtcttaacgttgagttgaaacctgaaaacaatattcaactccatgccttcaagagcataaatgggtaacagccagaaatacatgaagaatcacttctttcgagaatgtgcctaagcacgtgtttcattaagaagatacatgaagaatcacataccagcaaaaatgtcttcacttaaatttataccacaggaagccttgctaatgcctcctcttgtaatgttaaaaatcctgtcgaacacatcaggatgtccatagtgaaatcgtaccctgcacagagaatgaagtatgtcagatacacagcatttagactacaagtctgatgccttctgccctctcagacagtactgccacactttatcccgtcaacatgcttaaacttgaaaagcttcaatgcagaaaaaagtttcaagcaatgtagattattgatctaatctgtaacaccttatttacttgtaatctcagacacatgttcatgtgcattttcaagggcagaaagaatatccttaaagggtcatctcgcaatctttttctaggccaattctggatcatcttctggaatcgtataactgtcaaaagtgagtgactgttcatcggaactgttatagtccgaatactcataaggttgggtcgacgcctgccgtccttacattctatttaggattaggaataggtgtaatcagacctgcttttgacatatctatcctatccttatttgggtaccatatgcactcgaaagcgttagcacgcgcatccgttttcttgctccttggcttcaaacaatcgattgaatctggattcctttgcttatccttcctggctatagtctctcttgtgccttcggcagttcagttaaagatttctgtatcagtagtttgtttccccatttgctaaacaattatttggttatgccattttgggcgtagtaccggtattagagatcaggaaagtagttgggagagctcatgagactctttttgtgaaattcataagtctcaattccccaaaaactcgagttccttttggatttccttcttgattaatgacaaccgtcatcatatcgtattatcataccgttgtcacgtttgagttctttacatgtacgtacaattactgctcaactatatactaataaagaataaatatatagttggtattacgcttgtctgaaaactttgcaatcattggtattatgagaaccaaaattatgccacttgcaatatctcctcttgcctagttcctcagctgatggaattacatgaccagcagcgaagttgaatttgtttttcccgaagcaacaaatcgaaaatcttatcaaccttggtgatatcaaaatcaaaattttcctctttcccagaacttctcacccattgacatggcacaaccttcttgctcctgacccactcggctgctgctactccggattcatcctcttcatcggaaccatacatgtaagtgtatatgtggttgatctttttgaaatttttcttcgcctctgcaaacctttgttcgtgtagggttaccttctgtgcaagatgagataagctttcaaactattattactatgagatattattactatgaaggataaccaaagatcaaaacgctgattcaaaattctattgcatcatccgcccacgaggaattgccgcttcaggctcgcgattcgactttgatcgttatggattggtaccaaaccaagatcaagtcctaggcaagcgggaaacctgaaaaccaaaatcatgcgatcattccttcaagagcataaatgggtaacaactagaaatacatgaagaatcacttctttcgagaatgtgcctgagcacgtgtttcattaagaagatacatgaagaatcacataccagcaaaaatgtcttcacttaaatttataccacaggaagccttgctaatgcctcctcttgtaatgttaaaaatcctgtcgaacacatcaggatgtccatagtgaaatcgtaccctgcacagagaatgaagtatgtcagatacacagcatttagactacaagtctgatgccttctgccctctcagacagtactgccagacttgtgcgcgctacaattgctttagagggagctgctgtcggtattggaaacgtcctcagttcttcgattcattccgtggcgcgaaatccttcattggctaaacaattatttggttatgccatttttggcgtagtaccggtattagagatcaggaaagtagttgggagagctcatgagactctttttgtgaaattcataagtctcaattccccaaaaactcgagttccttttggatttccttcttgattaatgacaaccgtcatcatatcgtattatcataccgttgtcacgtttgagttctttacatgagtttttgagctccattatgtggacttcatcaattttttaattatggacttggtggtagtggtcaatactaactgcaccgtctaaatgctccctgaccaagttagcgtactcgccagggttgagttgagggggcagcccgtgcgctaattgggctctgaggttggctatacgcgaaaaaagctcactttctactgagctgtcctaaactgttccagaatgttatttgtttcataggaagattccaaaagcacattgtgatgccgaaagaatcttcggaaccggtggggttctgattgaaggctagacaaataacatgactgaaatatgtaaatcaaaccagtgaaatagctttataatattatatagatatagaataccaaaagcctgataatgggttaaaaaaatccaaaataagctttttgctttctttttattttgtgtgcgctttcctcctgccttcccgaccacggataggctatggggctttgcacttcttccgcgatataggacgattcgctcgctatctgaggcgttaatttacctactaaaatatcgcctgtttctacccaggaccccaacttcacaactccatttctttccaaattgcggagtaaatgttcttctagatgtggtatttctttagtgattttttcagcggagccttggcttgtcgtatccgtctgaatttcatattttcggatgtgaaaagaagtataaatatcctcatataccaaacgttcgctaatctcattcccaccccgtcgtcgagagcagccagcccgacgtttttatgcgagtgccccatgaagagattttcaatctcgaatctccgtctggttcccaggtggggtattcatccattgatcgaccaactgataaaataagcaattcttccactttctctctgttgcctatcggattgtcgcctgttgatggtaggtttgttctagaggtagacgaggcattactttggctaggtggagtgtttgcgagtactgaagtcaatcttttccaaaaaaggtttagtaaatgcacatcctcgccgctcggctcctccctcattgcccatagtccctaaagtctgtatgtctcttgtctctttgagaccggggatttcccaactgttccttcccttacaccctaatcttaatacccctgttacccgcctgtaggcggatcctaccaaccaaaataaagtgaccgaaagacacaattgcatcggtccaatgagacatggaagcaccagtagatattgaaagaaaaactattgttcggtattattgttgtagttctttgttcctttcgtcgatgaaagtacaaccacccattttccacactttttcatattgacttaagtcagcgaattacccgcggcgaggaggagagattagaactcctggattgaaaaactttttcttctccttgctaattgccgttcctgcccttcgcttcaggccatagtgcttctgaattatttctatacccctttgatgatgcagcctctgactttcgtgggtaaactcaagtctacctcgtaagccacttaaagatctttgagcagctcgagagagaaatccgtcttcattggtacaaaataaccttcgacatttggtactggtcaataacttacggcgagacgagcatccctataccacgtgtatccacactcgtttgtccttttctacttagttgtacagatcacttcagaaaatcgtataaaaatcaagcaagaaaacgtatgcgctttagcaacaaagcgctcatcccttcttctttcgcttggaatcccctcgcttcttctttcgcttctacgctcgtgctttcagcaagttcgtaccagtcgtcaggagctccaacctccgcgcctagccgcaaggaacctaaatgctggttctatcccggccaagcaagcaaggtgaaccccggtgggaaagaaagaccagggggaagaagctgtcaacacttctacaatccagtctcttaacactagctttacttgggaaagtagtgaaagtcctgctgctggataaagatactggaaaaagtctcaagttccactaggcgagatgaaaaagttcagaactgggatgccaaaaagagccgatttacaagcaaaatgaaaaaactaccactttcccactatgtcggaactagttttttcggctaaccctatctatctccttaccctgtaagaaaagcaaggcgccctccagtctcgttcgctgggtggtcagagtacagcttcgccttctcctcaggcggcaacttgaaaaactccattccaatccccaacaaagcgggattcaaaatgattgacaggtaccaaagcaaacatcccttttccccttgcccccatgaggaatcctttgtctacctggatcttcaaagagcctcatagccaaaaattctcaagcagagaagccatttctttctctctttgatacaaattcccatctcatgaaatttctattcaattttattttaaaaaatagggctaaacttctatctgagcctttacgagcaggatccggagtgggttgcgttcattcagcagatcaccggcatacctagcgtaaaagaagagttgctgcccatctgcatgttccattactttttcaagagctaggtctaatggaaaaattcattaataaacttgttttcatctggcagataagcttttgagaagagaccactttgataacgagctttcgggttgccgtattgataccgcccttcgggggaacaggatgacctcgaaaaagaatacaattaaagatgttgattctagaaggaccttagagtattgtcactgttccactggaataaaaatatttgtcagtggtcagtttagttcgaacaacaaagtgagtggctggacttctagttttgaactctggctagagtaaccaaccatcgaaccatctccaggtcacagtcacccaccaggaaggcatagaggcaagacagaaagtcaagacagcaggaatcgaacctagtcatagtaaaatgatcattcaaagtagacttttgtcatagggcaaaggagcttagaagggtgatgtagggaagtagtaagggatgaaatcacttagatgttgtatgacggaacggccgggatgaatcaaaggcatggaaagggaagagatagccctacccttcagtgaaccactcaaggtcaacctacgcctgatatcggcggttattatacgatgcagttcgtggattggcaaaacctggggcgccccggcaggaattctgtaagcttgacttgcgcgcagcgtttgggaatcaaagataaaaaataactctatgggacttacggaactggaaagaaggtagcacctaggcgtaagaaagaaagtaaatagagacagcacctactacgctatctattgaagcttactatataatatataaaagaaaaaaaaaggccatataagtgagatcctagccagagaagagcaacaggagctataaaaaaggaacttatggacttgaatcagagattgggttgacatccgaaacagagaggaaaagaggaagcaaacatagctagctcacgaaagaaagcttgcaactacgcgttatatattttattttcaactgcgctaataagggcacatccgctttctctgtatgtagattaaaaaaatacataccatattttttcccttgctttgctatttgaatgcttacctcagtgcaagagcagggaagaggtttgattgctaataaaatgagtggaagaaggccgtcatggaagagtttggggtccaaagccacaccttctttctcccataggaacagaggtcaggagctgccggcagggtgctgcttttaatctgactgatggctcaagataagttggagacgtacttgagatagataatttatgtatttcgctatttcgaatacctaaactcaagcggtgctaatttgctaatccaagccggtattcttaaaaaaagaggggaagcagaaccaagtcaagatgatatgggtcgccccttcttcttgcgccaaagatcttaccatttccgaaggaactggggctacatttcttttcaatttccattcaagagtttctatctgtttccacgccttctaatctagatcccacttccctccacttcttgcctcacgcccgtcaaacctgactccacattaacgactgtccttccacccaattccctgcatccttgcatcacatctccaacccctgccccaagtagcaatcagaaaaccaatcaatcttccttacactacgacaattcacttgaactaccaacat

SEQ ID NO: 59308 - DNA, 7481 bp, Oryza sativa
ttattcaaaaacttttacaaaatatataaaattatatgtatacataaaagtatatttaacaatgaatcaaatgatagaaaaagaattaataattacttgattttttttaaataagacgaacggtcaaacatattttaaaaagtcaacagcgtcaaacatttagggacggagggagtactaaaaacttaccaacacatctcctagtgcgtttagagatggtaaggtctatgggttttttcacaaaccccatgtagccttcatatatttttaggtaaaaaatgtgtaaagattcaacccaacgttgttctagctgagctgttaggttgtgttttgaataacctgacgattcgttatcctgatcgacatgttattgatttaaaaggatctcacatactacaaaatatgcccgcccgcacataagtccattaaattacacgctcacacgtaacgaaatacatacaacctgtttggtttgggggaatttttgggagggattgagagtttagagatatgaggcaatttactgttttatttagttgggaaatgagaattttagtgggatagggattggaatggggaatttgggaaggaatttcctctttttcattttctgtgtaggaggtggtaattgggagggaatttctcatttactttacctaaacaaatcttaatcatccgtttttgttaataacctaatctctaactaaacccctatcaatttccaccacctctaccaaaaaaaattttaggattaaaattcaaattcctatcttaatctaaccatcaattttctaactcccaatccccttccatcaagttgccaaacgagccaatagtctattatagccacaacccaaccttttcttcttctttttccccctattttgatgaactaggtgaaaccccgcgcattgctgcgggaatttagtatgataacaataaaaataataacgtgtaaaataggtagataacatcagattaagtaaattaatatggtttataataatttaaatttaaatagtatgtagaatggtgattcaaatgtaaaaagtaaggtggtatgactttatggaagaagaaaagtagggagatagtttgaaccgtagattaatcatctaaaggctaaaaacaattgatgtgatataacttaattagaggaaaaaaggagaaagataatttggaccattaatcatttaagcactaactaagtgaggatgaactatataagtatataggatatcataaaacataataaaaatatacattgaaatattatgtgaattatgttggatgataatttaacatgtttgtatttgaaaagctcttaaattataaaaatacaaagatatagcatgtttgcatgatgtttaaatgtgatgattgttagtggatgatgatgtggcatatttgcatgttaagcttaaagagttagtggaggataactttatactaagataggataggtgacaaacaccatcaaacctcattcagttaatccttatcagggagagattggaggggatttattctacttctattgtggtgtagaattattcccccacaatcccctcgaaaccgaagaatgcctcgacgatattagtaatagcagggtttctagttgacagttgactcgttagtagctgacagcgggcccaccccgtgtgggacccaccgggcaggcacatctgatccaatcctaccagcttcttcggctcttcccataaactgcagagtactacgccgcgtcaaaacgcttagaaataggcagcagaaaaaaaaaaagaaaagaggaaaccgaactccgctataaaaccgcgcctccgccgcgacgaagccgaccaagtgaagcagcgccgccgccgccgacgacgacgacgacgacgacgaaaccgccggaggcagagaggagcagaggttacgcacacggtttcaggttcccccccctccctccctcccatgaaatccaacaccgttttcgagcttgatcgtctccgatttcgtttctgggcggcggcggagtactagtggagacgacgcggtttgtgtgggggatgggattcgtcggctcggcgctgcgctggggtgagtggatgtgggtgtaggctagtggggtgcgcgtgcgtgctagtttgattggtgttaggtgacgatttttttttttttttggatgcggcggtttgttaggcgcgtgggtttgtgttgtgcgaccatggtttggatctcggagctacgcatgcgtactgtttttgtgtttaggtttattggcaattatggctgcctcgtgagtactggctgtgttcgtgatgagataagttgattgaccagtttttcatgttgaatgaatgaaattgttttgagactttgtctttgagggtttatttgtttattgactatgtggtttatgttaccgacaccgtaaattctgtgtacagaaatctcatgtatgtgatgtatggaggtcaccatttttagccgagagagcaatttcatttttagacgatctggaattctctccttctgaatagcatcagcatcatagacgcccattgtggcagtacatatcctgaattcctgacgctgtatgtctctgctgacaatgtcttaataaggagcgaacggagaggattgcccactgaaatttattaagaatggggaacaatttaggctggaacattttacaaccggtctaaggacattgtctctgctgacaatctgatatatttcttggtaaaatttatgtgctgtacagactacaaggggtaaagtagtgagaagagatggtaaggtggcgccgctggatctgctgcaattgtcaagtgaacgagtctgatcagcttgaaaatggacatgccaaggtcctgactagtaatgcagatggtatgcttctttgaccttgcttgtgttctctatttatatttcttagtcctgcagtgtcacttcattgattgaaaacttaaaactccgtttctgattgttcacctttctacatttttttctccttttccaggagtgacaaagggtttgaaagattctgctactgaaaaagctcagccacaaaattcggctctcactatcaatattcctgttctatccttggacgaactagtagaaaagacagatgattttggctcaagtgctttgataggcgaaggttcttatggtagagtgtactacgctgttcttgacagtggaacaaaaattgcagtgaagaaacttgattctaatgaaaatgagcccacttcagaattcttgacccaggttgacttgcttttagagatatgaattattattatttggttatagcattaatgcatttctacagatggaggatcctaaacaacactgcttattttctgatgctaggtcgctttggtttcaagattgaaacatgaaaactttgtagatatgttgggatactgcacggagggtaaccttcgcctagtagcatatgaatttgccactatgggttcactgcatgatgttctacatggtatggttcggcatatccatcatgttctccagtttgactaactttactactgtttttgggtagctgggaacgggtgctgtatagctgcagcagaagcagatcaattgttgatatatcttttttaactttgtgtaacaggaagaaaaggggtgcaaggtgcacaacctggtccagcacttgattggatgcaacgagtaagaatagctgttgatgctgccaaaggacttgaatatctacatgagaaggttcagccctccattgttcatagggatattagatcaagtaacatactcttatttgaagacttcaaggcaaaagttgcagacttcaatctctcaaatcaggctccagatatggctgctcgtctgcattctactcgtgtactgggaacctttggttatcatgctccagagtaaaaattcttaccatattctgtgatgaactttattttactgttcaattgtagtttctttatagcattacttcttcaattaactttggaaaggaccagtatacaatgtgattattatagtttgttgaaaaggatccaataagttctatttattcataggcacatttaggactcctgcagtgaaagaaactggtcttactctacgatatttcttactttgtggcactttctacatataggtttttatgcctgggttgctgtagagcccattattgcctctatatgacattttctgatgaataatcaagatatatatgtaacactgtttttatgcttgaaatgatatcattatctgacccaatatgtgaactttgcaggtatgcaatgaccggtcagctgacacagaaaagtgatgtgtatagcttcggagttgttctcttggaacttctgacaggaagaaaaccagtagatcatacaatgcctagagggcagcagagcttggttacatgggtaatgttcaccatatagtttactcatttatcttgtcgttaagttcagatcacatctgaatatctgatttagcagcttatagtgtctacagttaacaccttgattagtacaatgtagcaatacgcagcccaatcctttagtggctactttttacctagttctctgagcatgtctcagttctgttttgcaggctacaccaagattaactgaagataaggtgaagcagtgtatagatccacggttgaatggtgaatacccaccaaaaggagttgccaaggtctcgatctctatacatgcacacaatatttatacacatgagtcatgatagtcatcctttccttctcttttcccccacatttctcactactgcactttctcgatgcagcttgcagcggttgcagcattgtgcgtacaatacgaagctgagtttcgcccaaacatgagcattgtggtgaaggctttatctccactgctcacaagtaagccgactccacccgcgcctccaccagctctggacggttgatgtacagaatcatcagagaagaaataacaactaagaccatataagcttctaagggtcagggactattgtttttcctgcttggtcattttgcatggcataccacagaatggagctacttgcttattgcttctcggaattcaggctaactgcatggagaatgtgttttgccttttgaaggaacacgatccgagcacaataacatacttaatttttgcagacggtgtctaacaatcgggattgcattgcatatactgtcattctgggccaaccataggatttgcaagtatttaggtgcctgtttacagaagattagacgatggcttgtgttctagtagtcgtttattcagtgaactagagatgatgtactgctgaatactgatgatgttctttgattcaaatagtatcgctgttacttgtgttgctttaccgttcgttcaagtcttgggagataaatcaaattagtcaccacatgttgctactgctaagttgagggatactttcagagaaaactcattagcgcatgtttaattattaattattataaaattaaaaatagatttatttgattttttaaacaattctacatagaaactgtgtaaaaatatatcatttaacaatttgaaaaacttgctaacggaaaatgaggaactcaaagcttagagttgagaaaaaaaactggccctagctgctagcccatggaatatggttaagaaacgtgcacgattctgtacgattgtgtgcatcttgtaagcagtcacgttaaaaagaatattttgtatatatgagacttgacttaaaagacacattccaagttaaatgcagagcttaaggtttgttaagccaaaaacgaccttaacaaagtacttactgagttactgtagagctgattaaacattagcacgaagcagaccaccccagatgcacatatattcttgctacaagatcattaatacctaacttatgaaaaaaaaaactctattctatgccactagtatataccaagttctagctcaacgatttatcgacttcattaatcatttctataacatatctaaagtttacacatacaatttagatttaaattcaaatcacccggcaaaaagatttaaattcaaatctaaatatttttaagttaaatgttttaatattaaaaatttgtacgtataaacttttctggtccgcgctcgaacgcttgccctttacacccaggcaggatgctcgaaaaacacatttaatccatccataaaggacgagcctttctcagcaaatcagtcggctcttgtcatgcaacaactgtacagtaagtacagcacggaacagcatctgtttaaattactatgcaagacttgcaagggaacatattgctgctgctatctacaaaaccaacacaaacgaatggaatggatgaatgctgcttcgattcaagctttgtaagtgtgatctcatcacacgcaacaacgctgaaggtatccttcatccccccgctactctatatcagtaaactcacacgattcggttgcgccactgaattagatatgcagaggtgttcttgccacagttaactcaaaatggcgaacattaggtcaaaaagaaggctatgaacaccattataagctttcaactctctacttctctaatgaggactgtgttggtaagatgtatgctgcttctccttggtgtggaaccaagctgaattgtatcagttggcagctctgtcagaaatgtgagctagttaggagagacgtaactaaatcaaaggatagaatgagattaagattatactggactttcttcgcaaaaaaaaaaagagattatactggaattacactgtgccaagaagaaaacctcaggaatagaggatcaaacaggaagaagtggctgcctctcatcagtaccgtgcctgtgtttagcctgcattgtatagatccaatgatttgtatccaaagaaaaacaggggcagttttgaatttgatgtgaatagttacctcagtagcaatagaatcagacacgttgacgactacagattccttcgatctgaggaacaaggcatccatcaaaccaaatatattactagacaatcatggaaatagcaaatggatttctactgatgatagaccacggcatggaaaagtgacaaactacaatgttctatagtgttaagaatccaaacctgtgctcatgagcatcacccatctcaattttactgctcggaacttcatccttaatttggttcgagagatactgaaacaaaaacaccagaaacatgtaaaatcactgaaagagtcagtactaattgactagacaggaaaaaagaaaggttacctgatgcatagatataattactattgatattgcaagaacaaaatttatggtcagagtatgaccaaacaacacagcagatgctactccagtaaagattgtggcgattgttgatgagtacttcttcaatattgtatctgcagtcagcattaatgtgttttaaatgaactgcagtacaattaccaaaactggcatattaaaacaaaaactcataaaagcagaattag

SEQ ID NO: 59309 - DNA, 14000 bp, Oryza sativa
tcgaccagtctggacagaccgtatgaaattgagatgtaaaatatttttggtcataaaataatagttatttaaattatgtttgcaagactgataaaccacttgttttttcttgtcgacacggtctggacaagccgtataaaattaggatgtaaaatattttttctttaaataattgttatttaatttatgttagcacgaccaaaaaaaccacatgttttttcgttgtcgtctcggtccatactgatcgcatgatcaaatccataacatattttgtcctaaaataatagttgctgtggccaaaaatatttatattgaaaaaataagttttcgatcggtttaattttaaaattaaaaataaaaagttcaaaaaattctcgttatctggccagctaagaaggatagggaaaaaaaagaaatggaaaaaatgcatttgttaggatttgaactacagtcttcaatacggctgaagaagccatgtaccaccaggccatgtccacttcatgttggagttgtccgttcgacttacttattcacattaggtgccattgacaacataaataattttctccaggtatttatatagttggaaatggaataacataacacaatagatgcaaagattataaacgcccattcctttttctcatcatataaacaatatgatatcctggatatttaaaaataagatctaaccaccaattctgtatataactaatgtagaacattattacaggacttatgtatgcaaataaaaagttgaatcgatctggctcaatcacttagacaatccaaggaaatatacgaatgacattttcatccagaaaagctattgtggtgaagaagccttcatcgcagtaaatctccatccaaaattactgccataaaaataaagtgctccccaagtgaagatataaacaatataaggaaatcattgataatggatagatagatagtgaaaaaccttcataacctcacctttaattagttaccatgttatcgacagttgttccttctatatctcttcgaatccatgtctgaccatcatgtgcactgtcaaatagctccccaagattactgacatggtatggttcgcattccacatcattccattcttcgcccagttcaaatacatctctgggtttcatcttccttacaatagaccaccctggatttaaatggtcttcaatgtaaaacacttggtcgacttgatttgcaaatacaaagggctcatgctcaatcttttcaccggtatgaattttatttgagaaattcacaagtgtgcagccaaacttatctattttcactccttttcctttagttacatcgacccattcacatttaaacaacacaactgagaaatttccatagtagtctaactcaattatatcaagtatccttccgtaatacatgatatcaccaaggacagggttagtatcactggcggacgtgtagctcgatgtttttgcagtcacaacaactccactgttttgagtcaccctgtcataacgctttgatctgaacctatacccacgggtattgaatgctctatgtcgttttgctacctcaattggtccacgtgccaaccatctaatatcctcgtcaatactatcgatacctctttgattctccaactgcaagatctacaccaaaccaaaagatgtattagttgtactcatatttgaaaaagagaaacctaaattttgagacttacatgatctctgaaccaatcagggaattgttcattttgcatgttctcaatgttttttggagttagccttttgcgtttcttcctttgtaaatcagcagcatgttctctgcaaaacaaataaacataaatttgaagcaaaacacttacaacacataaaaaaaaaggctatgtgtcgaaacatgaattcggcaataataaaaggggtagcgcacgagacctaaaagtggatggatgcggagacaaaggatttagacaggttcaggccctctcaatgagaggtaataccctactcctgtttggggatttgaatccgccgagtatgtattgatgtgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataattttctctcgaaccagattactccaaagccgagtgcttcaatcatctttgtcatggtctcccgagtacttttaccaaatctgaagactgtggaggctgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatctgagtaaataaactcataaaggatttaccaaccgcctagaaaatgaccacaatatataatcagcctaagccataatattggtcaataaaaatgcacacttacgtggcgaaaagcaatgatattgtacctaatcaattgcttaaaaacccaaacagcaccttgacttatatataaaaaagtcagcgggacagttatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtgacatgctcccgagtaataaatcttccgagtaatatagaccaagcgtagctcatatgaatagcttctgatctgagtggttatcccttatgggatactccaaaatagatgtaacaattgaatcccgactggcgcaagtattcagttgataacccttacggggaataataaataatccagtctttgagcatataaaatagacccatgatcatgaattcatgttgcatgtatccggagcaagtccaaattgaagatataatacttgtatttgagctaataagcccctgaacacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttataactgttgtagatgcttcacttggaggagagttgatgttgttgcccaactcgtctaaaccgaaatatttgaagttgttgaagtagaatgtctgctccgaagcaaagatgaagataatgactcctggagttgactcgttggttgatgaattaatttcttcagcttgacataaaatttgtcaaattttgagccttgtatttgtgtagcccccgactctttgattagttgggaaacaaatgaacatagagtcgagaattatagcttcttgtcgtcgagtagtcattgcttgattgaagatatgtgttgaagatgtccaagtagaaatccggtagtgaagacgcgcagttgtgaagataaaagcaccagtcggcggcggcataatcagtcggcgacggaagatgatgatgtccatcagtagtggtagctgtataaaccagatgtagaggcgaggacactagtcagcagcagacgagatgaccagcgatgaagatggtaaggccaatcaacactggcagaatcatgcagccatggaagtgaagaaaccagtcggcagccatggcaaacgtaggcagcttgtgttgaagatattgatgcctattagtagtgacagcgatgtagccagccgtgaagaagatagcatcagttggcgttataacaggccagctgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgtgcaggcggaagcaccagtcggcggcggacgaggcggccggtcggtgaagacatagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtaaagacgtagacgcccaacaacggcggcataaaggccagccgtgcaggcgaggacaccagtcggcggcgacgaaggcaagccggtcggtgaagacgtagacgcccaacaacggcagcataataggccagccgtgcaggcggaaacaccagtcggcggcggcgaaggcaagccggtcggtgaagacgtaggcgcctaacaacggcggcataataggccagccgtgcaggcggaaacaccagtcggcggcggccgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccacaagcatcgggagtcggcctaggcatttcccaaacatgcatatgagtgatatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattagcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaaaaataaaataaatgatgacttagctttgtaatattccccttggagatggcagaagtggccaatgtgggaacaaagtcgtccatcaataacaatgaagacaccagtcggcggcgacgaaggcggtcgacggtgaaagcgaaaatgcccactaatggcggcataataggtcagccgtgcaggcggaggcaccactcggcggcgacggaggcaggccggtggtgaagtcgtagacgcccaacagcggcggcataataggccagccgtgtagacggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaatcagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataacaggccagccgtgcagacggaaacacaagtcggcaagagtagtgccgcggcgttacatgcaaaaagcagaaaataccaagagagattaatctgacatttagagatcaatctaataaacaacaataagttgaaaaggaaaaaaacccggtgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaagggggtagcgcacgagacctaaaagtggatggatgtagagacaaaggatttagacaggttcaggccctctcaatgagaggtaataccctactcctgtttggggatttgaatccgccgggtgtgtattgatctgacgatcaggttgtctcatctgccccctagagggcctcctgcccaccttatataggatggggggtaggattacaagatagaaaccttaaccaatacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtatgggtatggggtacccataatatccacactatgttaggacaatacgtacttcagatatggcactacagcatcacagttgtatagcacatatctatgtgcttgcaatttctctctatcagttaaggagtacgccgatggttttcccaatggttttcctactggaggaaacaaagtggattcttgcctactcatgggagtctcaaattgatctggtttgtcattattccttgatggtatgttatgcttggtagggaaaccttccaagtatcgtgaacaaaatgccatgcactcatctgccaaatatgattctgcaattgaaccttctggacgcgctttgttgcgaacatacgacttcaatttacccaggtacctgtaatatacatacaaggcacaaaactaataagttagtattgtatcatatgacatatgagaaatattataaattgtatgctaatatatttttagtacctttcaataaagtacatccatcgatagcaaactggcccagcaatcttacattcagtagctaaatggacgactaagtgaaccataacagtgaagaatccaggaggaaatatcatttccattctgcacaatgtgattttaattgcttcttccaaacggtcaagctcatcaacatggagaacttttgaacatattcctcgaaagtaagcagataagtcaaacaagacagatgtgatttcatcgggaagaatacccctcaaagcaattggcatcaattgttgcattagaacatggcaatcatgtgttttgagcccatgaatttttccttcagcagagttcacacatctagatatgtttgaagaatagccatcaggaacttttatatccctaagaactttacagaacaattgcttctcacttttggacatagtaaagctggcaggtggtaagtagaacttgcttgaagttctttgttgtggatggagctcccctctaatgttcatttccttgagatcaagacgagcttggagattatcctttgactttccttctaaatttagaagtgtaccataaatattatcgcacacatttttttctatgtgcatcacatcaagattatgccgaagaagattccatcccaataaggtagtgtgaataaactacttactgccttataagtttttgacttcttaaaatcaccgatagcatttatttcatccaataccggacgcccatagtaagtcataggctctgtactaatctctgtggttccatcaaaagaatttctatcaaaacgaaattcatgattaggtggcaaaaatcgacgatgacccataaaacaagatttcttcccatgtgccaaacgtttggaccatacatttggaccacaaggcgggcatgcaaattctccatgcaccatatgtgaagcaagcattcctaaagctggcaagtcatttatagtccacagtacagctgccctcaaattaaaagtttcatttctagatgcatcatatgtggaaatgccattgacaaatatgtctcttaaatcttctagaagcggctggaggaaaacatgaatgttatctccaggacttttgggcccaggaattattaatggcattagaagattaggttccttcatgcagagccatggtggaagattatatattactaaaacaactggccagcaactataggtagagctcaacataccatatgggttaaacccatctgtagctaacccaaatcgtatattacgagaatcagatgcaaattgcttgaaccttttatcaaagttcttccatgccggagaatcagctggatgtcgaagcacaccatcctctactaagcgctcttcatcatgccaacgtgggagcgatgctgtttctctacacatgaacaatcttttcagcctctcctttattggaaaatatcgtaagactttgcttggcgttgctttctttctttctttcttcgttaacttggtttctggttttttatctttccatctagaagccttacaagttgaacaaaaatcatcattaaccttctctttccaaaacagctgacagttattgggacatgcatgaatttgttgataatctagaccaaattttgaaaccaccttcttagcctcataaaagttttttggcaattcttttccatttggaattgccatgtgaagaatatcaagtagatctccaaatgatttatcactccatttgttcatggatttcatattgaacaaaagcactagcagagataagtgtgatagttcacttccatcccataaaggcttctctgaatctttcaccaacttataaaatgcttgagcttctaaatttggtccatcagtgtgtgtacatggcgaatctgcagaatcactcataggcatgtcgtcatacacagtcctaagtgcatcattaattaattcgtgcatgttagcacgcatgtcttcattgtgaggctgtggttgttggttcctaatttgctcctctgaagactcaccatgaaaatcccattggtcataactctgaagcattccattgcacaccaaatgatcatagacatcattttttgaaagtagcatagtatgtacgcatgtttcacatggacaataaatcaataaatctttgtatcctctaacttaaatcaataaatctttgtatcctctaacttatctttatatacaaattcaagaaatccatctactccagctaagtactcaacagaacctctagggtagcgcaaaagaatcttgatggtttctaaatccatttcgacctatataaaaaaaattgatatttcaggttcttgtagataataacaatgacaaggaattgtctcttatgatcatgatgtagcaaaaatagggcaattagaaaagtaccagtataaaatcagtgtcagctaattttgtcacaacctaatagacctcctttatacactgaaacaaaagcttttactctgcaaaaatagagaagagctaaatcaatttacagaaaaaacatccagcaatctaatgtcaaagctgtcatctccaagttaaattccttactataaattacctctagttaatctacagatgatgactccagaagcacatgtgtttaaaacctatgttccaaatatccgttcggatgaacaagaaaaatctgcaggtgttattaaactcaatcagatagactcatgatgcaacaaacctgaataataaaaaaaaaagctgacattgacctggatctgacactgacctggatttggggccaaatggggaatcaacctatgagaagtggctaagaaaaggaccgtgcttgccgttgacccgctgtcgtcggcctcggcccgtcgccggcctgccgcggccgatcccctcgcgggctcgccgccgccgctgctgagaacgcgccgctggccgccgatgcgcgctgccgccgccgccgtcggtgtgcgccgtggcagtgatgtgcgagagcgtgagaagaaaatgagatgcagtgtgggaacaggatggggcggcgctctcgtgcgtgttgggtgaggtgagagacacgagaggagaggagagaaggtgggagattaaggttgcctgctaaagtgcacagatcgtattttagttgttataatataaacaactaaagaaatcatttaataagaaatgtgattagctcagttggttcggttgtgcatattctatcctagagacctaggttcgaatcatctgtttgcatctttgcccccctaatttattcctatcaggtatcagcagcctatttttttcccctatcagcagccacttcgcttgtggcatttttttttaaaaaaactcgcttgataaattttttagaaaacaaaaacagcacgcccagtacacaatgtaaaaaaacagctcgctcaattattattattttttaaaaagcatgcttagtccaaaagttttaacaggaaaaaaaaaagcaactcacttcataatttcttttaaaaaacagttcgctagaggtccgaaatgtaaaaataaatatctcgctcgattattttaaaaaatacaataagttcgcttattctaaaagtttttatagggcatcaagaccattgcaacgcatgatatctgttgtaaagtggattcggccgttgcaagatactcaatctctgcaacgcatgttctgcaacacatattatctattgcaaattgggctcacccactactaagcgttgctagggtcgcattttggcaacgcatgcttaatgcgttgccaagcatgtattgctagaggggggttcttgttgtagtgttgcaagaatgaaaaaaacaaagtcggcttgatgcatcggctcattcgagcagctccagttcacaccgaccagattccaaagaataatagaatgaacattttaacaacttgatcaatcgagttcaatcatagaataaacattttaatcggctcgattcaatcaagttcgatctaacataaaagaacaaaatcaacacacaacaacacatagaaagagttgatgaagccacactaagaacacaagaacactaagaacacaacaatagtaagcctgccgctcaccgttgccaatgtcagggagcacgctgctaccaccacctctgggtggggaacccaccgtctccccttccgttggatctggcgtcggggacggcgccaccgctactactcacgggaggagaggttgttgcctccgttgccaccactgggtggggagcccgccgccatccctcttgctggatctggtgaaggggaaggtgccaccaccgccactatgtagggagccccatgcctaccctccaaccagatttagcggtgggagggcgtcaccgctcgcaggtgggaagagagaggcgcgatggagagtgtcgttcacttctcaccttatctgttcgtgaggataaagatgaacagtcggcttggtttgtcttttactggtgctgtttttagaaaaccgacacctacaatatattataggtgttggtttttaattaactgaacttatgataaattaaacgtgttggttttttttaaaaaaacaatgtgcacctataatattggtttcaatttatctctagaaccaacacctatagtcacttaaaggtgccggttgtttattttaggtgccggttgtttatgttttcagcctacgggggtgggaaaagttatgggaaattttgctacagaacactttttatgtatggttttacccataggacattgcccagactcacttttgggggaaaacactccgtaaatatggtaatttgtcaatggacaccgcgccgattaaaataataatttccggttgaagaggatagagaaatcgcgtgaaatgtcaaaaatgcccttgggcccacatgtcagctctatctcctatttctcttctccttctccttctcttttctcttcttctcttcttcagctaccacggcgacgaagcatgcatagagcggcggcggcggctagcggcaagcgtgagccgcggctggtgtcgtgtcccaacacaactctaaaatacatcctctaaattatgcctagaataattaaaaaccgtgtgaaagcctccaacaattaaaatgtgcaaggttaaaagtcaaataaggcttagaggatttttgtatatttcctaaaagcctaaaatacgtaaataaattttagtggaattttcagagcacaaataataattgttaagaaataaacaaagttaaaaagattttataaaaagaaaaaccctaaaaagtcccccttccctcccttgggccggcccggcccatctctccccccctctctctctctcctctccccgcggccaatccggcctctccccgcgcgcgccgctgacgggcgggcccgcccgccaccctcgctgactggtggggcccacccgtcatccccttcctcccgccgctcccgccgcctcccccgtgccctagcgccgccgccgccacgaatcccgccgcctcccgtcgtccccacgtgcaataaagtggggggaattactccccgtgatcccctctccctttccccctatttttccctctctctctctcgttcaaacgggcggatttgcccccgcaaatctcgccggcgccattgatggcggccggacctcccgcgccggtttccttccccgccggcctctctctccctcttccaaccctatttaaacc

SEQ ID NO: 59310 - DNA, 14189 bp, Oryza sativa
  unsure (1)..(14189): unsure at all n locations
ttttggaagcgctcgcgcgactgctcctgttcgttcgcgacggctcgccttcctcttcgctcgcgtgtttcgtgccttcgtaaacacctgcgaaaagtttcgaccaagcagccggtcttttcgtcacctcggtacgtgttcaatatgttgcgcatatttgatatgttcatgttattctgcgtagtttacatgtgtagatctaatgatgcgttcatgctagttttcatctgtaatgtcatgatttatttatagaataaattaaatcattatatgcccataatctcaacaaagtgattgatgaagctacattctactagcttttcggagttcggaccaatgttttcttctcactgcctgcaagattattgcctttctaattgtgccggcaggatgtctggtggagcaaggaaaaatatataaggagaaagagcccttctagttttcagttcatttctaaataactaaccaaactttatttcgggattggtgggatgggagtatggagttggctccccttttggccgccatgaagagcattagggctatcgcctattgggaatttggaattaacatattcttatgagttactttctccgtttcacaatatatgtcattctagcattttccacattcatgttgacgtcaatgaatctagatagatatatatatgtctagattcattagcatcaatatgaatgtgggaaatgatataatgacttacattgtgaaactgttggtactaacaaattagtctacagctataagagcaagtacaatagtatagccaactactagctccaattcatctatagccaatctaatagctcattcatacaatagttacatactacactattaatacctggtcccacctgtcattcacacactgtgtcttggagtccgtgctacagctggctacaaatctgtagcccgctgcccttctctctcctcgtttatcttcttaaaatatatttacaactggcttatagcctgctattgacctgctgtaaggcagcacacatcattcatgtcttatttggttaatccctcccacaaatggattgagggagatttggagggaattgatttcatatctattatgatgtgtaattattccccttcaattccccccatcttcttcaattccctacaaaacgaatatgtaaatgagatatgtgcttaccgatgtgtaagtggggtccgaaattaccggaattttggaaatcgcaatccctgccacaagagcatcagcttgtgacgtacacggctcagtcacgtacgtggaccgtgctcaaagcgctagctggccaagcacaaacacagctacgtcggttggcaggtatgccatccatacgaggaagcggttaactacgacttgatctactcctttcatctaattcaagacgcgcacacatttttaaaattttactcctaaatatttgaccaataatattttatcaccttatatatgtgggtttgccctcattatctgtgttagttaatttgcaaagttagaaagatggacaaactggtaagatatatatatatatatatatatatatatatatatatatatatatatatatatatatatatatatatatatatcaaccagggttaggctgtttgactgcttgcctaacccagtttggtgcataatatgtagacatttctcgcgcaattacaagactaaatctaatagtttaacgtccgacatatatataaatataataatgttcaatgtcacaacccatcttgatttctcagcaactaagtccgtgtggatctcatgttcaaccaaaaatgatagcacctatatggcatgtaattaaagccagtgctttgcacaactcacatttacgtccttcgcctgatacccatatataatgtcctcatcaagttccacctgttccatatagaaataaactatagtaaccaagaaattaattgtgcatctcctaattataacctacaagagaacataaattattccagagagaaaagaaaggtaattctatatgtaccaaattcatgttctgtataacaagaaagatcagtgtagataaagcaagtggtatatgcccactttccactagcaactagctagtttttatcatactatcatggatgaataacaaaatttcaagggctgatcaggttattattaataagaaaggtaggtgtaatggaggtgacaaaatgtatgatgccctcagagaaagaatgatatattgtgatggttgatttacctcagttggcttcttggattttttccctatatttgatctcaaatcagaacctagaactttgggtttctttgctatccgttcatccgaaagatcatcttcattcatctcacctgccatcaatttagatccttttttttcttagcgaaggtcacattggaaaatggaaatcacatgctattaaccttttatctgataaaagaaaggaaaaattagaaccatgccattataattttgcaaaatttgagatatgccatcctgaccctactgatgacatatctcaaactttgcaaaattataatggcatggttccaaatcacctaaaaaaaatccaacatctgtaacgtattagctggccaatgcatattaaaattcccttcacatcatcacacggtacgctgaaaattatgttcaaattaaatcaatactagcggaagtcacattaccataatcaccaccagggaggccttcaaagtcttccatatcttccatgtcatccatatagtctccttcaacatactcttccacctcttcctgtattgacaattgaattcacgatacatggattagttcacgaaatgtgagatgagcatgtctgcgccaattaacgatcgatgcttacttcttcatcttcctcaggatctacatcacctttttccatgtcaagaactttgaagggataactatagatcatgccgtcatcgccgcaaagacgttccttcaattccctccgcaaagacgttccttcaattccctttggatagcctgcatgccaacaggtatatcagaaataataaggcaaactatgaaacacatgaataacatcagaaataaaaaccttttatatttgagcggcatgttcagctttcgccattctcctgagatctcgctgagtctgcttccggggcattgtcatcagcttctctctgacagggcgagataggaagatgattataattttcataaaataagagaagtcaacaaaagaaagtccacaaaaagaatatacatcaacaacacaaatcagattataatgaaactgctgtactatatatgtaataccatcgaagttgaaagttgcggtctactgctacccatattatttctccattagtattaaaagaagttcctataacgatatgacaccacatagaagtgtacataaataattactattttctctttcaacaacgatatggtgtaatatgatcaaaacaatataagcagaaaactcataatgaaaacactatggaaaataaactgaagagctagcctacctcactttcagtcgaagcttcctcattcttatccgatactgagtcatttttgtcaggcgctgcttaatcttgtgcacaagtaacttgggccaaaattcctacacaatgaaggaaagagtgaaagacaagctatgagactaagtaaagttgacatccagatggggaatgacaaaatatgtacgctcgaagtgcatacaagatgcctgttgatgacttcaattgctttctcataattccttggtagtttgaccctctcccataatttatttggatgatgagctctttcagctgttttcatgtataggtagaaaatacctgcaaggccagaaaaaaaaaaggataaatacaaaatacaaacagaataatgtaacaaaaaagatcagatgataggcataatttctatatgggaaagaattgggagcatatatcacaagtatgcatgattcaattgaagattagactgcaatatatctgcatccttggacagttagacgaagagcaattttacggtccttgagaaggtaccataaagtcctattttttctattattaaattggtacctcattgtacctaggtactatgaggtaccaaaatttacactaaaattttggtatctcatgatacctcctcaaggacagtagaattgctcttggactaaaggattctgaaagcctataagcaattcactcatggaaagaaaaaaaaacactttctgcagtactatggagtatattcactttaaaattaactaaatgaatggacttttaggcaaaaaaaacattaactaattaataagcttccatgctggctagaccaaactaaaaaaaaacagtcatttgttgtgtttaactttgaggttttatatatccaatctactcacaaatcaaaatatcatcgatcttataagggaattaataacaattatcagtcacaattaaatgatttccttcaaatcaaaagcaacgcatctcctaattgcaactgcgaatgtcagtcaacaagggggagataatcccttatatgccactgaaaattggtctgatcccttatataccactgaaaattggctcttcccttatatgccattggtccaaatttgcgcactctctcatgccactacggtcagttgatcgtgtgttgaccgttaacttttaagtaaaaaagacatatttgccctctctgagttattaggcatgccctatactcagaagggtaaatacgtcttttttccttgagaattaacggtcaacacacggtcaactgacgggagtggcatgagagggtgtgcaaatttggatcaatggcatataaggaaagagccaattttcaatggcatataagggatcagactaattttcagtagcatataagggattctctctgtatatattcaccgtcatggtcgcggatggtggcgtagcggctgttggcaagagggcaggagctccggttgcatattccggtggcgttgtacgggttccggcagaatatccccgtcgtgatcctgccgcaaaaccaaaaccatttatcgtcagaaatcaaagaacaccaccacagcgaacgaaagaaagaagatgattgctgctctgctcgcatatatacttggccatgaagctgcagtggttgtgccggatgcagtgccatatcacgtcgtcgctcatccttggatgccttcctctttgcctgctaggtgcggttgcgggtgatcacctcaccggcggtggaagccggcctcagcaggaggacgccggcgccgctgctcgcgcgtggggtggaggagatgggcgtacgcaggcggcggaagaagatcgatcgactagggtaaaaataaaacctggtgttggccttaggcccagcacaaagcccaccgcggccccaactagatgaactctaggcccatatcaatactgcttgctccttatgcatttcactcagccctgacccagttttgaacccttgaactgtggaaggaataagttcactttgggtccctctatttgtcgcccagtccgattttcgtccattgaccgcaaaaccgggtacgacccgtccctcaacttacgaaaaccgggcaaacgaggtctctcggcggttttgaaggcggttagcttcatcgtgctctgctcgaattcctgcagactgctgccagtatattatttgcccttgcatgcccaatgggggtaagagagaagaattgaaaatttggataagttttcttggaaatcaaattgggcaaaagagaaagattttaaggaaatctgaagtcaaaaattgacatttgaatccattttagggatttaatggatgtttttggggcagggatttgatcatttcggtgaatgtgaatattcatatttttggagaattccaaataccacctaccttctctctttaatagatgatgttgttgatgttgttgacttttgaaataacgtttgactattcgtcttatgaaaaaactagtgtaaatatactaaaatataaatcatactcaaagtttctttctggtaaaatatgtcaacaaaattaaatattatctaaaaaatgtcaacaaataaatgatatttatatacaattttttaatatgacgaatggtcaaaagatcatgtaaaaaaccaatattgttatctattaaaaaaacggagtgcgtaattttgaatccaccataagcagactatccaagcaatccaaacatgacttattagaagatacacaaatgtagtaaaatcacatgagaaagacaacagttctgatccaattccatcccagcaatgtatatttaattgcagagattattaatagatacacaacttatctatacatcctatatagttggaaccaaacactaaacatacattaagccactagaaaataatatcctttgaatccttatagcgctttcatcataaccatcatccatatatcatattcatttacaacctacttagtgtaattattatcataaagcttaacattaatgagccacatcaacttagaaaaataatgcccattacatttctctcacgcttgattataaccatacatgcgtcatgtataactgaaattctacctaaattgcctaaactgtgggccatccttttaacattatttctaaattgttttatttgagctttcttgtaattaattctgagatacccacagcagcgcgtggggtatccactagttaaaaggatggcccttcccgctacccattgcttgatattggcataacttatggagctgaagcagtaggaattggtagaaaaggtcctagaaaacgcatgagaaggagaacatgcgtgatgaactccccaccggtgctgagatgctcatagtggaaagcacccccgcaacgcggtgcaacatagtaaagcatctctagccaaatctcagatatgagtttccatcgttcagcttcattgccgatgctgaaaagctcggcggccacttggcatgcctgtggcatgcaacactggatagttaagagcttccgcaatactttgccagaggtccaaatctttcagttcttcatttgccatcgaggctccttgttcctgttcattggcttcaaaaaacttcttgacagcttccttctcacttgttttagcctgttgatcctgttggcgataaattttttccccaatttcaccaagagctctgtcatgtacaagctgggagttgactgtaagcatcacgccacacttgaagacaaggtacatgatatagtttgatagctctcggctcaccttcttcttcttgtttacttcggtggtgctatcctcggagtagtagcatatatctgtcgcaatgtgccagatgagcacagccgtggggaaatcgacatctctgccaatgctatcctgcaacttcgtcatacttgtctgttccaaatcttctgatttgcatctgtcgatccgcttctgaagtgttagctgaccacgggaactggcgaagttccagtcctctttaacttttccgaattctaacaatttatcgagcaccagctccttcaagtcttcagtaatggatatgtgtgttaaagtcgaatcaagcaactcaacaccacaagtattggaacactcactgatccatttctgcacggatgacaacaaacctacggtaccttgcatggtgtacttcgtgatcatgttgtactgtgctacctcttgggaccattgtttcctgcctcgtagtggccgaatggaattgactgcccacaagattatgcttgtagttctttcagaaggaagtttggagatcaagtagggacaaacatacatggtggcagcgaagacatctagaactattgcacctacaagtaatatgtaggagatgatgatatcggctctattatgtagttggccgcccttttcgatcggcgcacatgaagagcactagggctatgggggtgaacatacactggacaatgaccagcaaggtaataaggagggaacgaaatgatatgtggcagggcacaatagtcaagtagaaggctcgacgtaggatattttttttgtgtacccacgatttcatatgccctgcggcggtttggattgtcataaaactctttgagcatggatggtatatcctttgctgctaaaatgcacttcacatcatcgcgtggagtgtccactgaaataacttcactttcagtatatccgatgttttctgcttcggtatgtataatttttgagcttgacttcccatccaatgttgactcaaatctttctttgacatattttttggcttcttcttctactctgcctttctcaacttcctgtagcacaaatttcaaatagtgcagggatgcagccctgagactccttggtctggcaaggataaggcagaaggtacgcccagtgtaccttaaacacccacagaggaacataagcaccacagcagcctgcagccggcggtctgtccaagatgatgtggagatgacgtagccagccacaactacttggatgaccaagttgagtaggtgccgcttccacaagtcattgtcctccttggagaaggtagtgaggttttcctgcccaccaagatggacgagcagaaatggcgcccagaagagtatgagttggtgctgcggtccgttcacatgaaccgcgaggtggccaagtacgaaaacagcaatggagtgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaagataaaagcgagctaagcctgaagacttgactcctgcagcgagcgattccattccacaggcaatccttgacagcagcgacgaaaccaacctcttcgagacatctccagctgagaagaacttcaactctggtgagggggaaaagagagcaagactgagtactacccactgtactcagcaagtcataccggaagaggaggtatgatgcaagatatatccaagggaggctaaaggttcttttgcataaagccggcatttcaaagcagtagttgaaagcagtaaaacaattgtagtaattaatcaatattaaccaatcactgctcaacgctacaccacgttgagaccggcccaaaccaccacctgaactaaccagttccaaaagctaactaggggtgaaactaatcacggtgaatctggtcgaccgcccataaccgcgggcacggctattcgaatagctttactctgatcagaggtgtacaactgtacccacaagacacagccccacgacacgttcccgtgcgccgacatgccaccacgacataccagaaagaggccgtgacaggacccttcacataaccccctctaaccgatcgcaccacaccttagggttcgcccccgtccccagcaggcaacgggcagcctccctttcgtgccgcggtgaatccggaagccgatcaaccggacaccccggccgacccaactccatcacgcccaccctcgcttgggtacgtcggctagagaaaagttacactacaagcctagccgttgcccacgctggcttgtggtaagtacgataagttcttccggggcatcccgcgaaccggtccttaactgccatgggcacgactagcaaaaccatgcacccacagcccaccatgacgtgtattttaattaaccaacaccattacggtggcactaaaccaaagctatgccgataatcaagtctatgctttaatgtgatccccctttgtgcactagttgaactaagcagggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattgggtacaatatgatcaattgtaatgtatgacttgccttgctctcgcactgatggaaccacagcaacgtcttcgagaaaccgcgaatcgacgaaacggccgaaatctacgcgacaaacaaagcacacaagcaaaacatgctataagactactgaaacagagaacaaaaccatttttaatggattctatacatttttatgaatttactaagacttgaatggacttaaacggagctcggatgaattagttatgatttttagaagattctctgtgtttttactataaaagaaaaactcttaatcaatttattgcgcaataattcctcccagggctgacgtcagcaaggggtggggcggcgccgacatgcgggccccactggtcagcggcactaagagagggagaagggggtggctggcaggcggggccccccgggcggcggctcaggggggaggaggtggcaacggcgggtgggccccaccgggcagcgtcacaagggggtgggaagcggcgaggcgcccggtcggcccggctcggcttcaaaccggccggccggttaggtgatgcggcggcgcaagcggccaccgacggcggcggccggcgagaagacgacggcggccggcgatgcgagcgacgacgcatcatggcgacgcgcacacgaggagcggcggcgcgcgcgagaggaagagaaggggagggagttctcaccggggattcggccggcgtgggtgaagacgacggcggccggcggcggcaagcggcggatggtggggcgcgcgggatggacgagatgggcctcgatctcgcgaggccaacggcggcaacggagcggcgcggcgacggcactagcgacggctagcggcggttggaggcggcggtaggcggcggcgcgtgggaagagcggtgcggcggtggcgcgcggcaagcgaggggcggccggaatagcccccgcgacggtgaagctagcggtggcgacggcttcgcgcggcggcggctctagcagcggtggcgcgcgaccggagggcggcggcaggcggcggagctcggtgcgacagcgcggcggcgataggaagcacaggagggcgcgacaaaggagggaagcgcgagaggaggttcgggggagcgttttatgggcgagggaggggaggaaacggccgggggggtggccgatttggccggcgacgtgggggtggagagagagagagaggagggattcaaaatgaatccgaccattctcgggcgcgcgcgagggcgggaaacggcgggacgtgggcggcgatgtgggcgtgcggcacgggcggagtgggcgcgggaagcggggaaaccggcggcgtgggtggtggcactgccgtcggttggaggtggaagaaggggctgacaggtgggccctacctgtcgatgacccagagagaggagggagggaggtaggacttcgggggaggggagaaggaacgggccggcccgacaaggagggtggcgcgggagagaggttgggcagacggcccaacaaagaaaaaggagaaagaaaagaggaaaaaaggaaaaagatttttcctaggattaatatattgcacattgctaattttaattggttaaaattatttacaatgctctgaaaattccgctaaaaatcctgttagcgtattttgacatgtagaatccaagaaaaattccacatgccgattctgattattatttgcatttattaatttagggtttctctcttgcctttaaacaaataatttcttccaactatttattaattgaatttttgttagggaaaagaacttctgggcgcaacatggagtcagctgacaagtatgccagccatagaaggaagcgtaggatccttgacgcgctgcgtgtccgcatgctcgctgcgaggaagaggaagacttgaaggaagaagctcacaaggatcaggcactggatctcccactcgtcccacagctccttcacatgatgcccaaaactacattgtaggtaagtgagaatcaatcctcccaagaacaacaacaataaatcatttattcatgccactctatgaatttgtttctcaatactaattagagatcgaccctctttaattccaaaagaacgaaagatcagaaaatcacacaataatcaagagaagtcgagctggatggtgattattacaacgttagtgattatgtatgtattgtaaactgttctgcagtacagttggaaggtgcaatacaatgttcagttgtaaatacttgatatttcatcgtatacagatggattaaatcatcaactgaatgatgattaaaacattcagttgtacttggactccaagtagaaacaatgttcgatacaaaaatattgttctttcttggagtccaactgaatgaagataacaacaacggatgagtgtgttttgcagtaattaggagatagcagcaggagacatgaaattcactagtattttgatttgttccatttcttttattcaatgacaaaggaaaaggatgaacacgagttaatgataaatgccttgatcattaaaagttgcttgctcttcacataattggcagatcaaaaggaataatccaaatgaacgaagccgaaatccaactacgaatgagagtggtcaatgaagtgcctataattaaccaaaaaaatgcatgctttcagccgaaaatatcaatacatacataaatatatacaggaaaggtatatatatattgcatatgccagttttgaattgccatttaatgaacactatacttaatacgctaattagaacgctgtaatataatatgttgctaggcagcatttatccacacaaaaacgaaaccaaaaagtggcatagcatgttaattacctttgtttctccttaagattgcgcatattgccgattccctcaccatttctcacaggtctcatttcagtcaggttgtggggtgatgcaagttcgaacagaatggaatgttgctttgctaagctcatttttagatcagatcaaaatgtagtgaacctcaagcttgtctttttttaacttttggtgcgacaaatggatgcttgcttcaatggtcagcaagtgtttacacacggaagcatctaagctgcaagcaacatataaatatgaaaaaataaataccagatgttaacaccctggatttttttcccctatttaaaaactattttctaatgcaaattttgatttcaaatgtggctcttgttagcgattccaatcttgtgccaagaagatctcaatccccgcctatctaaaattctcgcccaaaaattcaagaaccattaaggccgtgttctgtcccatatgttcccaactcctctcatttgttttccgcgtgcgcgcttttcaaactacaaaacggtgcatcttttgtaaaaagtttatacatgtaagttgcttaaaaatatcatattaatcaatttttcaagtttttttatagctaatacctaattaatcatgtgataatctatcgctccgttttccgtgcggaggtgagggttcccaaccccttcaaaaagaacacaagtccaatttaaaatcaactaaatatacttctgtttctccttccttacgcctcaccgcgctaatacaagccgtgttgtgcgtccccgtgtactgctggagcatgtagttgactagggttgcactatattcatttacattagcccactcttttgaggagcagaccctcgtacgcaaaagtagggattataatttcgcttcaaaatttcgctctccccccactccctcctttgacaagcaaatatctcttcggacctgcttagaagcccaatttcagatcgaaaactagtgtaaaatactagcctgtatttcttgtccatctagactgtaaatggcacctagatggaccgtttctcgaaaaaaagttccagctgaaaaaggcccattacaccagaaagaaagtaaactcctccagaaaccacacatgaaaaccatggtagtcaggctcctctcttcttgcttgagcttgcgtagccctctcctctgcgtctcctatgtggacccccgtttttataacaagaatcattcgtgtaaacagtaccaattccctggatcaagtagtctggtacacacgagttcatagctgaaataccagatgcacatacacgagaatctagtgctaattattacatcataaacccgcaggcattgtcttaaattatcggaccgagcgggtccnaatacattccaaagcagaaatagatatgggcagcgga

SEQ ID NO: 59311 - DNA, 20393 bp, Oryza sativa
  unsure (1)..(20393): unsure at all n locations
aatttacttttagggtttgttcctaaccaataacccattattcgcgagttatgaactccgaaatcaaatccaataaaataatggaacaaaatcggcatgatgcaatttattcaaaaagtttttgaaggcccatatttttggagtttagatttttgtcggtccaatttttagggtgttacaaacctatccccctgaaataaatctcgtcccgagatttcttaccagttttcgaataaatgtgggtattccgtctttaagaactcttcactttcccaggttgcttcatcctcggtgtgattactccattgtaccttgtacatatgccacactttgctcctagtcctcttctcggctctatccaatatccggaccggatgctctggatacgtgaggtcattgctaaggtgaatttcttccaacagagcttgttcttccggcactcgtaagcatttctttagttgagatacatggaagactgggtgcacatcagcgatattttctggtagctgcagctgatatgcaacttctcctcttctagccgtgatttgaaagggtcccacatatcttggtgctagttttcctttaaccttaaaccttttcggtcccctcatcggataaattttgagatatacgtaatctccttctttaaattccagattccttcttcgagtgtcggcgtaacacttctgccgtgattatgccacttttagacggtcccgaatcaggcgaaccttctcttcggcctcgttgataatgtcaggtccaaataccgcccgttcacctgtcttcgaccacatcagcggagtccggcatcgtcgaccaaacaatgcttcattgggggacatcttcaggcttgcttgaaagctgttgttgtgggagaattcggcgtagggcaaacacctctcccagtctttactaaaatccaatgcacaggctctcagcatgtcttccaggacctggtttgtcctctccgtttgaccatccgtctgtggatgatgagccgtgcaaaaagcaagataacttcctagggcttcatgtactttctcctagaagtgcgaggtaaactgtgtgcctcgatcagatataatcctcttaggcactccatgaaggcacactatcctggtcatatacaactcggcgagcttagcactgttatagtttgtcttgacgggaataaatcttgccgtcttggtgagtcgatccacaatcacccagatagaatcgtaccctgttgcggtcttgggcaatccaactatgaaatccatacctatctcatcccatttccattcgggaatcctgagaggttgcaacaaacttgccggcctctggtgctcagccttcaccttctggcctacgtcgcagagtgctacgtattcggccacatctctcttcatgttgggccaccagtaaccctccttcagatcctggtacatcttggtacttccggggtgcaacgaatatgccgattcgtgagcctcttttaggattaatcctctcagtcctccctgttcgggtacatagattctctttttgtaccatagaacacctttttcatcggttgaaaattcctttgcacgtcctgcggctaggcgtccctttacttctcggatttcctagttgtctttctgagcttcctctatttgggtcctcagaagaggttgaatgtccagggtgtttatctgtccacgaggcactatatgtagatttagctgggccaattcctctttaagctcaggagccatcccttccattctcagatgtttgcaatggctcttacgactcaaagcatcgaccacgacgtttgccttaccggggtgatagtgaacctcgagatcgtagtccttgattaattccagccatcgcctttgtctcaagttcagatctgactgggtgaagatatatttcagactcttgtggtcagtgtagatatcgcaatggtttccaatcagatagtgtctccaaatctttagcgcatggaccacagctgcgagctctaggtcatgggtagggtagttttcctcgtggggtcgcaattgtcgcgacgcataggccacaacctttccgtcctgcatcagtactcctcctagtccttgccttgatgcatcacaatatataacaaagtctttcctgatgtcggaaagaactagaataggtgccgatgtcagcttctctttgagttgctcaaagctttcctggcactgttctgaccatacaaactacttttcctttttgagtagttgtgtcattggccgggctatctttgagaacccctcgataaaccttcggtagtatccggccaagcctagaaaactccgaatttcggtcaccgacttgggtgctttccatcccgtaacggcctctactttagcagggtccactgctactccaccggctaagattacgacctagaaaagcgacttccttcaacaagaattcacacttgctgaattttgcgtataacttgtgctttcgaagtttctggagtaccaatcgtaagtgctccacatgttcttcctcatctttggagtagatcagaatgtcatcgatgaataccaccacaaacttgtccaagtaatccatgaacactttgttcataagattcatgaagtatgctggggcattggttaaaccaaacgacatcactgtgaactcatacaatccatagcgtgttgaaaacgcggtcttgggtatatcctcggtcctaatttttagttggtggtatcctgatcgaaggtcgatctttgaaaacaccttagctcccttaagttgatcgaagagatacacaatccttggtagtggatacttgttcttgatagttacttcgttcaatgaacggtagtctacacacattctcatgctaccatctttcttcttaacgaatagcactggggctccccatggtgacgaactagggcatacaaaccctttttcttgtaactctcggatttgcttcataagttcctccaactcgttgactggcatccgatagggtctcttggatatgggagcagttccaggtaaatcttccggaaacacatcaggaaatcgttgctctaccggcattcctttcatgggtagcatggtgaatatgcctccggcacattcggccagtctaggatcttgatccatagttgttctcatatctgatccccagggggtggttaaggtcacttctctacgcctacagtcgattacccctctattctttgttaaccaatccatacccagtatgacatccagggtctgaggtattaagaccataagattggagggaaacaccacatccctaagacgaattggtacgtctatgcaagcatgattcacagttatctcgcccccaggtgagtgtactatcataggctttctaagtcccactagggttaggttgtgcttttgactagccttcagagatataaatgaatgcgatgcaccagaattgaagagaactttaaccggggtagaattgatagagaacatacccattagtacgccatgatcttcctaggcctcttcagctcggacatggttcacttgtccgtgcccaaatccagtagcggtcctgttagattgcggagtcttgaatagacctcgcccggcagcaggggtagcagtgccacgaacagtcattgcattcgcgccagtccggacaggagttttgcgtggatgtgggcagttgttagcgtagtgcccgtattccccgcagttgaagcagtccacattcttcttggctccaggggcaaccaaagttggtgtaggggtgcggttctgaattgcaaccggcctgttgaagttgctaggtgcagcgggacgattggtcgccacgatagggggcttccatccggatggagtggctcccttgagtcgctgaggcactgtctgaggtgggcgactcatagcaagcctcctcttgcggttgtgttccaccgtcctttgatcgttctccagcctaacgactttgttgatcaggctctggaagctctcatggtcttgcccaatcataggtccacgcaattcatcattcagcccttctatgaacttgtcgatcttttcctcttcatctgcgaggtctccaattgcatagcgggccaactgagtgaacttgttcagatattcctgcaccgttgtattcccttgtcgcagccttctaaactcgttcttcttcatgcgcatcactgcagcaggtacgaagttctcgcgaaacgctgcagtgaactcttcccaagtgggttcttcagcatcgtcttcccaagcttccttgtaagtatcccaccaatcaccagcgggaccctctagttggtttactgcgaagatcaccttgtcggcttcgcgtaccctgacaagagtcagtttcttttctatgatgcgtagccaatcttctgtttccatgggctcgtcggccgtagcgaacgtgggtggcttggtcctcatgaactctccaaagcttgaccctccacggttgccttggttgtttgcgatggcttgcagaagttgagtttgggtggccataactccggccagagtggttaggtcgggtgtctgtgtttcatcgttgctagttgatgcccgacgtcggcttgccatctgtgtaggttgattgattaagtatcctaattttctaaccgccttttacggctttatcccattaggggaaattgttttgatgtgaactttgttttgcaagcatggtggaataaactcatttataacacaacaacaataaatatcataaataacatcacagagtttcacaaatagtacataaatcatgatgtaatcgactgcatacatacgcagtccaaataaggttcatccaaaagatacatcgaactaatcatcaatctactcgtcaatctagatagggggggtgcatctcgcatgctatcccaaaaaaaacatctgtcgcgagatcgaaactgcaaggagtccgtcagtctagtcctccaaccatccgcaggatcccggggcaggtagagggtagtcgctggcacgggcaaacctgagtccccacggctcggaagtagtggcctctggatctggcttgggcttcttgctcgggggtcgggtgctcttgcgggcagtgctgagagtgcgggggcctccgaggaacgtgatgcggggaacgggtgtctcatcctccgaaggatcagtgatgtctggctcgatctctggcttggtatcggtcctctctgcctcggagtcaatctggatcggagtctccatactgtaacccagctgcggtgacgggacagtgaccaggggagtgtgtacaatctccggtgcaggtggctgggtcactgtagtgtccaccaggcagggtgctgactcagtagatgtcatgccaacctctcccagaagggcgtggaacgcgggtgggtatggcggggtgaggaagaagtagcagttatgccctgctgctgtggaagtagaagctcctggggtgctgatcgtggctgctcgaagctgctcctccagctggctgacgtgctcctgactctctctcagctgctcctcaagtgagtccatcatcccgcggcgatcgttgtactgatcagatagctgcttgaactggtcgccatggacctggagctatgccttcagtgagtctatctcactgccccaagtctgatgctcctcctctagctgaagctgctgcaccgagaggtcagtcaactcagtctccaactctcccatacgcctctggttgtcgtcaatctccaacagagcctcctcgtagaagtcatctactgcctcagcccatcgtgacagccgagtcaccatcgggttgtagcagcagggtgtgtcctgaactgtgcagactgagttgctctcctcccggaacgggtgatgattaaactcggtactcgctaactcagctcggtggatagagctgagtcggaggaaggcctcccgggctgcatcctgcatcgcggtctctggcaagtctcggcggtgacgtgtcggaaagctgtagtctaactccgaagaaactcgtgagtgaacctcgacccaagcctcccaaactgatccacactgtctcactcggaaggtcggaaatccggagtaccgcagacgcctcatcattcaatgcagctcaacgacatacccctctgagcggggtaagcccaactcccaggtagcgggtgaatcctgatctgccatctaagtttaagaaaaacccaaagtcagttgagagtaaaaactggttttgtgaagaaaatagttaagagtaaggtgtaaaatcgtataaagttttgtaaacatagcatttttatttttgaaagtgttgctaaataggaatttctcccttggccatcttaggaaaggggtggggcgcctttttggtctttcctacagtcgtatggctctgataccagctctgtggacccccgtttttataacaggaatcattcgtgtaaacagtaccatttccctggatcaagtagtctggtacacacgagttcatagctgaaataccagatgcacatacatgagagtctagtgctaattattacatcataagcccgcaggcattgtcttaaattatcggaccgagtggtccggaatacatccaaaagcagaaatagataaggcagcggaattaaggcagcggcatgccattgccacaggcaacgaccgtactaagacctactgagcaccatcgtcttcatctccctcctggtagtaggcatagggatcctccggagcttcatctcccgcttctgattaattttatatttgcaagggtgagtaccaaccgtactcagcaagccaccacatcaacaatgcatatgatagggtatttcaaaggatggctatggttttttttgcgcaaagcaaattttgtaattcttttcacaagcctaagacctagcattgactgatcaaactttagtaccagtgtttgtattaaaacaacgacggttctgtccaccatccattgtgatcccaaggatagctttccgccgttgagtcgttatggttttctgaggatgcccaccttcccccatctcaggaagtggctccaacaacataaaaattcatcatgcaataacccatcccacacaaattaagaatttaaagactaaccaagagtaatacatgtcccggtgctcaataaccgcgagcacggctattcgaatagatttggtttactcacactgcagtggatgtacactttacccacactccgtgactgcccaacacatgagccttgtcttaacacatgagacacgtcacggcaaagcttttcgataacctcgcattggcagtacccgctccatgaacttttgcatcctcatgcactctaggcgtacacagtttctagcagtgagaggagttctggcgcacccgggaagggaagatttacacccatgaattaagttataattaggttccactcaacacacgacagtcctaacaatggcgacaccattgtagagcccctgccttacacatgagaaaccactatgcatggatattgcctccgctcggctatttattccgctaggtctatccccattcaagaagtgtggtcgtacggggtcgtttcatgcttaacttcatggctcggtccttaattgaccggggacggtactagcctttcccggataccacccaaatccaccgtccgccccggtctaaaacaaatgtttaattcctttcatgtcatcattatcatggcaatgtggcgctcatgtctccacatgccgcatctcaattaccttcccaaaggtaattgcccaagcatataatatttgataaatatgagtatgcaagattctaaagtagcatttctaagcaattgtcataattgactagggactcatacgtaatcatggttacaaggatttaaaggtgaacaataaacaaggcatggcataatcacaaataggatgttcatcattgcatgtaatcttatttgtaaacaagaattaatttcacaatagggatcaacgtggtcaaagaatagtgatgacttgccttgctcaaggtcttgcgggtcttggccttcacccggatccgcggctcgctcggtctctatagttacgtgcgtaagaacaatttgaattcgattagaattcaaacaaaatccaaataatgaccgaattgaaaaacgagcgcgagaggtgaattctatatcggctattttattcgcgaagtggaatttttcctcctcctaagatgttttgcgtttcctaagaaattttgtggtttaaaattacgtcctagacttcatctaattatttagttcttaattatatctaaattactaccgcgaaattgattccttatggagatgactaagaattaatctataacaatctataagaattcatctaattatattttcattaatcctataattaaattctaatatttttaaatattttaaatctccccctaatttttcctttcttttctctccctctctcttttcttttcttttcttttctctctctctctcttttcttttcttttcttttcttttcttttcctctcctctctttcttttcctctttttcttttctttccctcccggcccctttctccctcggctccttctccctctctccctctttctgcctaccgagaccggctggggaaagggaaaaaggcggcggcggcacggcttaccggcggcaacggcaacggcggcagcgcatggcggctgcgacggcggcggggaactcggcacggcctaaaagggcgacggtggcgcggttgagatggggaggaggggggaaaattggggaaatgatgtggggaggtttggagatgaagggggggcttttataggactttgggggcaaatgcccggcctaatgatgatgtcacgacggcgcacgggtctcgaaacgacggcggcacggcgcggcagcggcgatggtgacggcgcgcgtcgacgcgacggcgcgacacgctgcanatggccacggcgcggcagcggcgcggcagcggcgacaagacgcgacggcgacggctcgcggcgcggcagcggcgacgcgacggaggtggcgcggcgtgggacgcgaggcgacgactcaacggcggcgcggcgggtgcgggacgcgaggcaacgcgacagcgacggcgacggcgacgcgaccgcgacggtgacggcacgcggcgcggcacggcagacggcagcggcgcgggacgaccgacggcgacgcgacggcgcggggcgcgaggcagcgacggcgacggcgtggcagcggtggcacggggctcggggcggccacgcgcgggacagggggaggggttttagggctagaccgcaatcgaacacctatggggcaatgaatagtgacgttgtccatttaacccgatttaagcctatttatttatttaaacttggttcgataaacttaaattttgtacaaataaagttcacttaatatttgtgttattcccactaatggatccacccttgattaattttacccatattttatttttatataattttcttgaatttaattagagttaattcttattccattacttttaaatttaattgatacaaatatggttgtaataatattttactcatttctatcctcgccaaatcttattttatattgcactttaattatttactttgtcaatttacttttagggtttgttcctaatcaattatccattattcgcgatttataaactccgaaatcaaatccaataaaataatcgaacaaaatcggcatgatgcaatttattcaaaaagtttttgaaggcccatatttttagagtttagatttttgtcggtccaatttttagggtgttacatccttccatcgccccacccttctctccggagagtcgcaagcttgtgtggtacttgtcatcacatgcatctctctcagccggcccctcccatcctcgagctcgtgcaaggcgcagcctccctccctatcccaccggcgcggtcgccgctgtggaggccatgattcttgcctccactgcatgatgggacccgacgtgatgtgctacctagcacactccatgtctccatgagtcgttatgtgaatagctttgggaatcaataaataaaaaataggtaaaataggttccacggcatcgaaagtttccaagtattaaagtgcaacggaacctttcgatggtgcaaaccaacattcgaaaactttcaatgacgtgaaaccaattttacaaaaagaaaagacaattattgttgtaggacactacaatttgtggttttaactctaggacacgtcaaaagtcgatctttaggggaagacactctcaaaatgtggttatttgttgatgggcaccgcatacactaaaatattaaattccgattgaataggagagataaacaacatgaaaggtcaaaaatgccccgggtcgacttgtcatattcttcccccacatctcactccctctcacactccagccgcaatagcacctccgctcgccaccggcgaccaccacggtcctcccacctcgcctctcctccacctccactgcagcggcgtgacccgtctcccttcaacatgcgcgtgcggcggcgtggcccagctccctcgcttggctacccggcgtgcgctaaggggcgaggcggcaagcattgtgcgcgcgtcatcaatgccgagggcctctacctccaccacggagccacgggcgatggagttggaggtggtggcgtgcggctgctcccctccatagacctgccttcaagcggcgctgccctgaccttagagcagagaaggtggaaggggagaaaagcgctggcagtttgggcggggggggggggggcgactgggggtaagggcaggagaacggcaccggtcagtgggtgaggggaggaaggagctggttgaggggatcagattgaatgagagatgggggcaatttggtcatgacgtgtcaaaaagtagacccgccctcgcctagtcagcactaaaatactaaataaatagttaggtgcggtgtccgctagcaaataaccaagattatagatagtcttctctttatgacacagaacatgtgtgaaacatagcacgagactctaaacaaatacattggatagtagcagataaaactcgatgcagaataacgtttgcattgttgacaaaatttggatattcttcagcccatgttgtcatcagacaaatgaactaccaacaagagcatagttacaagaccagaaatacagaaaaaaaaaagatggtggaatacaaggtttaagcttgcatgttcatcagatagtgtaagcagagataataacttggctagcatatacaaagggctcactcttgaaagaatttctgctccagaaaattctctatccctatcaccttttactcctgcacaaaacattcatccattgaattatgctggccaatctgagtaatagtaaactaaagaagtaataaatccccgttggacttcacactttgtatggtttcaagaaggttttgaaaaacgttatacctctagattgtgtaacatatgtgcaaatatatatatagatcctgttatcgtatataatattttttgtactaatagtaaatttcataatagcatcgtatatgtgtacgtaggatcatcgattcactaaaaaatactagcaaatttcatattgttccaccaaattctagtatacaaaacttctataaaaactcctgtggaataaaattgcaagaatatagagttacatggggaagcaccattagtgcagtggtggagccatgtataaaaaaactctatacatcaacattcaatcatagcattcttagctggtgcagagattaaaactaacttgtagttccattatataaaaatatagagctaacgacaatgtggtttgagtcatctgcccaacaaaatcctaggtcaaccaatgtttaccacgatcctagtagtgatatattattgtgcagaggaacaacaaaggaaactatgaaacaaatacctggtcatcgtcgtcgtcatcatcgtctcccttcttaaggcgggtagttccaccctctttgcatataggtattttcatgtgtccaaaaggagtattgacatcaatgtgcccctttatggtgtaaccagttccctttccccttatcatatcccacatagcagagccaaaatccttgggcctgaagctgattggtaaattcatggttgttacctcctgcttcttaatatttgtagtttctttcatctcagcagaagcaatgctcacattagagagccacacttcataatccatagaattcagtcccaggtcaaagtcatttttgttgtcaagattcaaatggagtgttgcggttgcttcctcaaaggagaactgctcaaacttgatcttactcacattaacgtctggtctgtaaggcactgggatctcaccatttttctccagaggtatagaaatccttccgatgaccgggatatctatatgaagcacaactctgatcttgtatggaatgatactcccaggcttgatgtccccatatgtactcttgatgtcatcataaataagtagcagagggattttcactgtctctgaaccatgagcatgtatggttccagaatcagggattgtcccagacatgagctttctctcttcgctttcgatcaagtattcgatgtcgacgagagggatcggcacggggtttgggttggtgatgagaacatcagcaatcagctctaccttctcaaggctgatgtgaggtatgtggatcccggtaacatcagcagtaggctttccaaagcttactgcatcttcaatcttttcaccaatgtcttgaatgaaatcctttaccttgtcgaagaaacctcccccctctccatcattattgtcgtcatggtccttgtcagctttcctttcggtcacttttgggctatccgaagatgacatgctgtgatacagattgaagagttaacatatcagatttcacaaacaatttcctgtcgaaaatgttcagaggtgaaatatgaacgacaaaactgacaagcgcaccaatggtaattggtaaaatattaaatacacagtaaaatgaaaacatcaacaagaatacaagattacataatcacaacaggaagcggtcaaaagatatacgaagttactatactgttgtatgaaacgacccatttgagctgatctcaaagaaatgttgtaattaaccctcagaaccagatgttcagcccggacattcgactatttcgaaatctatgatcatgtgaattcaagcatacacaaggtgcccccatcttaaatttgtatagcaaggatggacgtaaacaaaacaagcaagctccacctgatccaaggagactactaataaattaagatggcagccagcaaaatatttccatggaaacgtgagaggccaatgataatgagtttggaaaatcaacagtttccggctcctgcaggttattgtcaaattccagccttctcaatggagcttcacaaatcgaaatggatgcatgacggatgcaagtaaataaaaaataatacggagaaatcattgtccttaatcttagaatcctgccgctaagctctgtcgatcgagtacctcgcattgttctgacaaatcacaatgctgataaaaccgtgcatttataaacctacacaaactaatcccgtaatccccatcggccattgatgagaatggatcgcatttgttatcttctacatgcgtcttccttcgttttttccccttcttttttaccgttttataaacaaaagacaattgcgtcgacatctcctctatatgtgattctatcaaaaccagcaaataggaaaaaatggaacgaaacagaaaaataatttgatcttcagggcattcgaattcaagaagcagcgcactgcccagctcagcccagattctctctccccacgatcaagagaagagaaaagaaaatgacagcacgagcacatattggatcagatcatgatcatcagtacgctggatggaagaaaagcagctggactggattgatcgtcggtcggctacctgctagggtatcgacgacgacgatcgaagcgaaacggccgcgatcgagcagagcagaggaggggagaggagatgggcttcgcgtccgtcggtggaattgggatggagagcggaagcggaacgccattagcggcttaagcggcacctgcgcctgcggcgggctgatcggcctttaccaccgtaagaattttttttatttttattttttataaacctttttgattttttaattttaaaataaacattttaaaaagttattttcaagagctaaacattttgaggtcaagtgataaaacaatgttatttggctatacggtccggatggtatagaagctttgttttgttacgctgccctgaagccatgacaggactgtcacgctcgctgcgggtgatgttataatattgttttactgttttgtcacgtttgccgggatgatagggttaaaatgttgaaattttgaaaaataagttttggaaaggtttatttttaatttaaatttaaaagttaaaaataatgattagtcatgcttttctttttgtctttctaaactatcatcctcgttgtcaggttttgggtcattgggcttgaggccatttttgtcttctggatgggcttttccaggtccaaagtcatcatacgtgggtcgggctgaaatttttatcttaatgtaaaacctcctttttttttctcttgagatgaatataaaaaggtctgcctaatgtcatccaagtttaaaaaaaaatgtgattgcacttacattttcaaccgttggatgataacatgtatcgccatatcgcccctccagcgtatgttagaccgtccgtgaatgcaggcatgtttgtgttttgtgcaataaataaattattattgctttgtcagttgaaagaaaagcccaaattatctttttttacatttttattgggggtataatatgactgaaatttcagttatttcggtctaaactagtttgaaatttggaacaaaatatttgaataaatatttccaaattcacaaaagttatgaaaaaaatcaaaaaaatttggccaaaataatttcatatcggagagtacgatagacaaaattttcaaaattctgacatgaaagtttaaggagcaattgcttatttaccatgtttcgaaggataactactaatttgatcttgctatttctagtttgcttatttgaacctgcttttcaaaattgaaccaactgtttgaccgtatttacaatacaccattagtgttttatttaggaaaagaaaaaatctatttattatttcaactgacaaaaataccctccctttaaacttatccatctccctacctcacaaccgacattatatctctctcccccctctctcgctcttgcgtctctctcggtggctcagcacgagcagcggcgcaggtgcatggatcggcgacgcaggcgtgcagagggtgaaacagcagcggcagcggcactgacgcgcggaggaggggctggtagcaacggcaccggcgcggagggaggaggtgccagccgcgcatgtggcagcgcggagggaggaggggcggtggcgcgcatggccacctacgcctgctgttgcgccacgaagggagggaggtggcggtggctcaggcgcacgaaggtgaggcagttgcggcggtgacagtggcgacaacgctgacatgtggagggaggggacggcggcgccatggccgcctaccgctgcacctcggagctaacacggacgtggttcacgccgtcggtggcgaagccgtaggatcttgcaccaccgctcgaagccggtagagtttactttattgtgtcaaatttctatcaaattgattcgaatatatcaaatttggtgccaaattttgtttatttcgttttgccgaaaatctttcaaaattttcaaattgatttgattttagcagattgaagctaaatctatcaaacttgtgtcaaatgtgaaagatatgtcaagttcgttacaaatatatcaaaagatctgaacatatggccgtcttgatataacagggtcaaataaacaagggcaaaatataccatttacctcttagttaacattgttaagttgtcttaacagaatagagttagctttcatcttcgattttgaaaaatatgatcaaataagcaaactaaaaaaatataggatcaaattagtagataacattcaaaataggatgaaataagcaattccccttgaaccaggggtgaaaacggagcggatattatccggtccgatccgctccgaatccgtccgatgtgagaatatggtaaggatttttagatatccgaccggatgcggattttgtcatgcggatgcggatgcggatatggtatcaacgatatccgacggatacggattatccgatattttaatcggattattcgatatactatttggcggataatccgcaactttcagaccacacaacaactctatttagcacattttacatcgggcggcccatctagcccatctagtgtaacctaatccaatcctccccgaaatctctctctctctctctctctccgtgactcttctcttggccccttctcctgctcccacacgcgccgctacatggcgccataggtgtgccgcgccgccgccgctccttcttccagtccgccggcaatgtgttgtgtgctgtatgctgtatgcagtgtgatgtatggaactagtgtgttgcttactatatgcagtgtgctactgtgttgtgtggctgtgtgttgtatgcctgcattgtggtatgcctcattgccttgtgcttgtcgtactgatgagtgtgaagtactaaactactgcactgaacactatatttttaaattttaagcaatgcagtgaactgctgaactgaacacttatattatatttttgatggatgtgttatattaagcaaaattatattattgatatgttttagttggttttttctagagaactgagatcatgttcatatgttgttttgccatcgtattgcggctaattgtattgccgctctcttgttgtatggattgaatacaaacttgacatccgacaactttttatccgtttttgaactgagtccgcaccgaatccgacgtccgaaaaaatccgctccgcatccgtatccgcacgtcatccgcatccgtttaaaaaaaatggtttaggatatggtatagctattatccgtccgaatccgctctgttttcacccctatcttgaaccctggatctgctaacgtgctagagctttggtccgtccggagttgaagttctaatttaactggtaataaattttaataatttcagtccataataattatacagtagctaggaaagatattagtaattactacataaaaacgagcgtgtagcgtgcaatgggtaattttcacagatagcgtgtgtaacaaaagactatattcggatatcctatgttaacaaattggttatcctctcctcgcagttcgcttaaaaattgtctcagtttaagttaaattgataaataaatcatttagcgttacgttacggagtctcggttgggcttaaacaacaagcgagccttcgcacgccttcgttggccgatcgatctccccgtggacggacggagggacccacccatccacgtcgccgctattttcgcggcgcgcgcgccgccgatctccgatcaccggcggctgggtgcgagccccgcaaccgcaaggcgtccctgctgctactcccgcccgcatcctccctgcgcccaactccaatctcttctccgcctccaactccaggaggtcgctctcctcctcgctaatttcgcccgcctccgccgatttcctcggggggaggggagcagcggtaggtgccgtacgtctccggtgagctcccgtgccgacgcgcatcctctttctttcgatttcgccttagcctgtaataacatgtagatctggaacctaggtttttctctttttcttaatatatagaagtatatatatatataaaaaaaaaactgtgggttcaaccagaggtatccccatgcccacgttaggttcaaccctgttcgcagaatacgtggaaattttgtgtacagctgagattgttttgttctgaatatgagtagttattaccatttggttgttatttagataaattgtattccagcatattttgattattttctcttttcgtgttttactctttcagtaacttttgtgtggtagtaatttatgaccatggcgacctcgcgagaggttttcaagtatcaccctttgcctacaccgggagtggaaaacagttttaaggatgagatccaatccaaggttttgggcacgataggggatgtgatgaactcatttgatccaaagtcattcccacagcatgtagaaggagcactgggaacagctggaaacatcatcaattcctttgagtcaaaattggctgagcacaagcaatttgattttggtggcaaaaccaatttttatggctatgattgtgcggacgatggttggggatctgcacccttgaaggcagataagccggtaaaccttagaaatctgctgggtggtttaattgcaatcatcagtcgtggcggcaaaaattctgaaattcaaccgccaaaggacactaagtctagtgtcgcattcttagggtcaggtagcgatggagaaacattcttgcacgcctcagtctatgtgccaagtgctccaccattgcttgacgaagaagctctgaattacaatgtgtatagggttgtgattgaagcagaaccaccagaatggttacctgatagttatgctaactcatgcatgcaatgcgctgcttcttttactgttgttactcgtggaaggcatcattgtcgattttgtggagggatattttgtaggacatgctcaaaaggcagatgtctgttgccagccaagttccgtgagcggaatccgcaaagggtttgtgatgcttgttatgataggcttgatccgttgcagaacttattcattaattctattagcaatgccacacagactgcaaagcatgatgttatggattggactagtaccagggggtggttgaatttgcctattggattaacaatggaacatgagatttacaaggccgcaaattctgtgaggagctatagccaggtttgaggttactgattttgatttcttatcgcctccttacatatttaatcgccactctcatacatgtttaattgcaatatttaggatatacccctactaatgaatcatacaaattttaatgcagattgcaaggctaaaccccgaaaggtctattcctcatgcagtccttagtggagcaagtgggcttgctatcctgacagttgtaaaagctggtgcacttcttacatacaaacttggaactggcctagtagttgctcgaagatcagatggatcttggtcaccaccatcagcaatcgtttcagttgggttaggatggggagcacaggtattaactacattgctaatttcatctctgtctttgatatggacaatttgttgtccatcaatttatgaaatgcgttttttttgtgttgttacacttaatacagtttgcttaattgctctagctttccttgtggtgtagaaattatccacatgcattgcccattatttgtctttgggtaaaaaagtaatgtaatggacattttttgtatttcctgatggaaaatagtacagagtgtgcatgcctgcacaagagctcgtaatatttaagtgcttgttgtggcactcaatttacctttaggtaaaaatagtttttttttggatatgaacatcaggaggaaactgcttccttttgttgtgaatgttacgtgattactggcattaacaaacgaaattatgttttatgtttacttgatgagtaaaaatatgttaatatgatttcagccataattcaggaggtttcctaatatttactttttacatgttatactcttgtatgttgtattcttatgtttgatcatacaggttggtgctgagctaatggatttcatcatagtgcttcgtggtctggaagctgtcaggacttttagcagccagatgcatttttctgttggggcaggtttaagtgctgcagcagggcctgttggtagagtgctagaggctgacttgagagctggtgataaaggctcaggtgtttgttatacatatagctgcagcaaaggtaatctttccatctgatcgtagttcttaagcctccctagttgcattgaagtcagtctctgtttctattggagtgtataaattcgtaggaagaaaatatgttgcgtcacatgcataggaaaatacatggatatgaagtcctctatatgacagctttgctgatttagatccatggaaatcatttaggtaaaaacctcgaaatttagtttaaggtggaacagaaatttcggtatatatagagattaatatgctggactttgaagatatgat

SEQ ID NO: 59312 - DNA, 1395 bp, Oryza sativa
ctaattacgctgtaatgtggtgctacagtaaacatttgctaatgacgaataattaggcttaatagattcgtctcgtagtttggcggtatctataatttattttcttattagtctatccgtatacgtcacaattttttttggctaaacaactaaacacagcctaagttcagctacctggccacctcactgccatgcagaccacaaagaagtttgcgccagctgctcatattcatataaatgtcatacatatgttagaatatatatatatatatatatatatatatatatatatatatatatatatatatatatatatatatatatatatatatataacatctatataaatatggacaatgctaaaaagacttacaatgctaacggatgaagtaccttattaatagccggtattgttagaaaataaacagatcaatatttccttttttgtaaaatggttcatgttttaatgaactatcccgtgtgggtgttcattcacaatggtaatatataattttatttatatagcaaaaatgtcagagggttctaatatctagaagagggttttcggaaaataactggtattaatatatttcgtaatcatggttctttaaataaataatatttgaaaccaaaatagacacatattaccaaatgctcatcatttagcccatgcataacaagaaaacgaaaaataaaatcaaataaattccaacatgcacgggagttagaaaagatttttgattattccgaatttttaattatgtatttcagaattgaaaatttcagggtgttacacttatcaatggcatttcttagattatctccaagttaatacatattgctttacttttcattgtgtgagccacgtatttctacgtaggcagttgtcgatcgacaacaattttcttaagacatgcttgaaaggaggcatcagttcgctgtagaggatagaaattctcgtattattcagtgaaaaatgaaaaggagagttcaagtatgaaaacaatttataaataacttaaattcgaaattaaacaaagggatattggaataacggtccatatataacgtaatacgagattaattaaaattcgaaattagaaaagaaaaaattttaagtaggaatgcaattttaaaaaaactgaaataccgagattaaaacataataaattcctaaattagaaaaggaaaaaaagtttaagtaggaatgcaatttcaaaataactgaaattcggaataaaaataagaaatattaaaaagatagtcaatctagaacaaaacacatgattaattaaaattcaaaatagaaagtaaaataaattcagaagttagaaaaataaaaataagaattgaagtaggaatacaatttaaaataactaaaattcgggggtgcag

SEQ ID NO: 59313 - DNA, 1494 bp, Oryza sativa
gtcgatcaaaattcttaagtcaccagctgcgaactacagcataaggcggtaaggcccgcagaccggggcatacaacttttaacagctctagtcaagtcttacaacattcagatgtattttcactttccgctttccagtgaaacctgccaattcagtgtcctagcctgtaatttttcaatggaatcaaccagcacggtactttggtcatgtagcagcggctagcacgtccagaaatgcatgaatctgcaaaatatgacaagtgtcatcaaaacttccaataaaagcaaaataatgttgaagcattattgattcacggttattaaaatgataaagatgaatgtggagagactgccaatagaaaacaaaaagcaaaaccaagtatatattacatgtacttatcaaactatggaacttcactaaagaaataaaggattaacaagtggggggtacaggaagtgactaacttactctcagaattcatggcctaaagatgcgcatctgaggttggaaaacagagcgaagcctgtacatacatctccatgaccccatgaattcacccgaaaactggtgggttgttgaactcatgttgtgaggatcatctaaagcaagcaaactttagccatgtttttagataatgagaggaaaggtgatctggtatgtctgcctgcagtagtagcaagacaatcataagtataccgaataaaatagacggtgttaatttagtgacttcactgaatgaaaagtgttaataaaaaagaagatagcatacaatgtcccatgaagcagaaaagccatcagttgaaagataccaacatccatggtgcgattcaatgcccctcctattggaggtaccaagttcaagcagctgatcaagatcgtcctcgtcagaatcatatctccgtcgctttctcttccgatctctctttctccttttatggctacctcttatgagatcctcatcatcactgtctagtgcaattgagttcccatcattttggaccaatgggtaatcatcagccttgcgaaattctattctgttacaagtgaacagatgctcacaagaatcagctgatttgcacccttttgacaattcacagaaaactagccaggactggatgcctatccacttaagtgcgtccggaagttctgtatccacaaatcccttcatgagagcaaaatgatcagcatcagtcaattgattagtgctcttcagaagctcttgcatctgtccttgttcttcctcttgttcttcatcattcatgaggcgccaaagttgtctgcccttagaaatgacacagttcaatagcacaagttcatcaagagatatgtgatcactgtgtgctgacaaaagaacctcaagccaacagcatgggaacaccatttccttgcactgtgaattcagcttgatcaacttccccaaagctctcaagaaattaagaagcctttgttcatctaaatgaataagaagatgttgagaaagagaagaaaactgct

SEQ ID NO: 59314 - DNA, 16440 bp, Oryza sativa
tactccctgggatattttgacagtaagaaactcacataaaccaaatcaagtttgcaagcactttaaactaaatcactcatcttaataataatatcccttataaattggttatatggctgtttaaatgactttttaaatcatagtgcaaagtaaagatgtcgtagtgtcttacacgatcttatcagaaagccaaccacccacagtctgctgaagattatgtggaagatcccaatgatacagagttgcgtatggctcaatacctacagccagacatgtcattggttaataactagaaacattgcaaccttgtaaggtattaagtaaagcatatgccacctttctcaatcatgaaatttataaggtcattataaaaggcaactccttgctcattgacatttttccccaggccatctgcaggcatgataaaattagtctcaatcatagaaagatgatctgaagcattactgatgaaaaaaaggatgtcatatatatctggaaatgcatggcatgtgcaatttttgtatgtgaagctctcatgtgattagctcaacataccaggaaatatgcgtggccaagatatagaaaatctataagcacggaaacccaaactggccatgagttcaatgtcttcctgaaaaaactcatcacagacaagaagttactgctctatgaaaaaaatgcattgtacagaaatatgaaagtggtctatgaggaaaaggactaatgtttgtttagaacaagtttcagggattgtttgcaataaaattaaaatgaagccagtgttgtttcccttttttccttgaaaagaaagacaaggaaggcaattgctaccttgtatcgatggtaatgatcaactgcaacttctccactgctcccatctaagatacgttctgaaaagcacaagcatttgaacattacctaattaaattgataggcgccaaaaacatagaacccaggtaaacaaacctttgttttctgtgaaaacatcccatatgttatctcctttgcctccctcccgtctcgccccttcaatctatacagtaaaagattcatatatacatgatttccattttgggagagaaaggaagtagcacggctgttcttcttccttctatgaaatgaaacaacagcaaaacaaacttctttattccctgcacaaacttctttactcaatgttcctctcttctctttagtgaagagaaagtaaaatacaattaggccttatttgtttaatccacacctattgtggtgtggaattattcctcctcaatcccctccaatcactctctcttgaggattaaccaatcaaggccttattgggttaaaattctctcttgccatagcctgtattttccattttcaactaaaggttgcacaccaattttagtttgtctgttaaccttttttttcccccatatatcttcctcatccaaccatcgactcataaaaaaatttccacaaaagtggcacctggggccgattgagtatatgcacaaaaagtaaggcacatcatgaacattaaatctctcatacaggagttctacacgcagaatgccaattcaagctgtccgtgtgatcacaattcacagtaaaaccaatccacagctaagtctaagctgatcagcaagttgaaaccgaaagggtacaacacccacagtgatggcgccaccagaaccgagagctacactcacccaaaatcccaaataaagttctaactccatcccttcccaccggggtacagtacactactactagtagtagctagtctagtacagtcaccacgggcagcaagcagatgcgatgcgatgcgacgcgacgcgggcggcgagtacctggtaagcggaggtggcgacgccgaagacgaagccgtcggggaagtcgccgcgggtcacctccgcgtcgcgccccgtgctccccattccccccggcggcggcggcgaggaggaggcgatctccgcagcgtgcgcgacgcgtggctcggcaggtgagtcgcgcgcctcgcgtggtttctgcctgcgacgaggcgtgaagaagacttgtgcaaataaataggaggagagcccacgtgagcggccacgggggtgggtggcacggggacgaggcggtgggacccaccgcgcaggctctgtcgacccgggaggtggccccacatgtcatactgatagaggcaggagatccggatctcgtttgcgcccccacgactctatgcccccccctccccttctgtcctttttgtcgtgcttagaggttagtaactgtagttcttgctaattactctatcgaagtctttaaaattttttggccggtctttgactaatggcttgtttatggcatgggtttatatatttcaaaattcataattatatcgagactgtttcataaggggacaggatcgtgccatttgtttgaggtcaaacagcccaatgtgcaaacacgccgttagaaatacagcatcagcagcagctttgcatcattccatacagtgacagatcatgtggccaagcttaacaagacgggaagttaaatcgaacgaaaatttgcgtcacaatttagagcaacttgttcgaaaaacaaacagcaacgagagcactacttcgaatagaaaataggcactattaccagccaacttgttcttgccatgcccatgaacaaaatgtgagaggatgccggcagagattccactacagaaactcagcgcacattcagctcatctccagtggaggaacaaagcaaaccatgtaatattgtcactgcaataatacttttgctctgtgtccaatggcacgcaaaaaaaggatgcagtttgcaactttgcatcagaccaaaatagtttcatgaactcaggatctgattccgacaatcaccatggacggtcactgattgcttcattagtactacctccgtcccaaaatatagctatatctagcacagtactttgtcccaaaatgaagctatttttctaactaccttctcctctcaaccattcacaaccattctttttcacatactttctcttttcaaccaatcacacaccttcttcaatcattctcacctactttcttaatacccgtgccaaccttaaaaatgcttgcattttgggacggaggaagtatatagtaactccattttggctttacctaatgaaagaagaccttgatcatggccaatcaatgcatgattccttcttgtctgcatagcaattgaatacattatcaaatcaaaaaagaatatatttgtgtggttgtgcagctcgtgatagcttccacccaacagcccgctcacagataaccaatcggtacacataacagcaacagctagacacagctcctgacgaagtaagaaaaccgtcgatgtcttttcagagggtgccgacaaaggcttgaaagtaggagactagacaaaactctaaaatgacatgatgcaattctttctaccaaattcaattacgacaagctgtttccaatttctcacagctgatcacccaacagatactgatacattgaaatgaataacagtctgttgtaatagatgcaagggattaaaccaaaaaagtttacaattatcttactacattatggtaattctgttaagtcagttgtcactttgtcaatagtaacaggtgatccaataaaaaagttccaagtagagtttgcctatttaaggtgggagtacgaacaaaggattttcctggcacgactttctctagactctactacactactctaaatataaatgtctgtaatgctaggcaacttggtagtctgctcttttttgttttggaaatcaagtcagaaaaaaaaatcaaagcagcacaacatatgatgtgtacagttgctccaatactattgagctaccagtcaccataagacagtgatacaacaacaactaagaggctattaatactaactgaatgcaagacagcaattcatcatgcaagagaactgggacgaggctattacaacgaccaggtccaaccgaccaaatacaatgaaactatattatctgaatggtggtgcactcatataggaactaaactacatttatcaaataaaagttatctacttgcacaccaaattattcatgcatgtcctagtaccaggtcaatgaaaaatatcttccctaaatcagattccgatgcttgaataaatatacaatcacagttcactgacattttggtattttttacatcataactgtctacatgttctttgatataaggttctagaggtacctgctgcaacattgacatttttgttctgatctgtagctctgtactctctccttgcaaggcatgagatcatatggaaaataaaatatggaattctctcagttctaaagaagtaggaattctagaccaaaattaaatctcttcctgtcagtctagcacttacaatataattgcaagattattgtagcatctaacaacaaacagacacaagtacaaaagctgatgtttctcacaagctcaccagagaagcagagagcaaaagaaagcactgccccaaaattgattggcagctgtgtcactgcaagcgtaccaaaaagaaactatgcttcttggctggcttttgacagctcatccatttccaattccttgactgctgctataaggcttcgagtagtgcctttaaggcataatccaccatcctccatttccttcaggagattctcagcagttctccagtccaaagccttgagacaaagtgactggataagtttgttgtactcatccatatttggctccatcccatcttccttcatctcctttaggcactccaaggccttctcaaactcctccatcttgcagtaaccacgaataagtgtgtgatatgtaaccctgcttagtcttggatgaatcctcttagcatcacgaagtagtgcatgggcttcatccatcatgcctcctttggcgtagccactcatgatcacactgtatgtataaatgtcggggcagatcccttggttctccatcactctcatcaaaccctttgcatcctccatttctccatttttagacaatgccgtgatgacaaagttaaacactgcgctaccaggagctgggcctagatttaccatcctcatcagcactttctttgcatcttccacgttgtttgtattacacaaaccatgtataaccgcagcataggactggccagcatccttaagagattccccctggtactcttccagcagctcaagagctgtattaatggtctcgtcattcctcgccaaagcgctaacaaggaaagttaaggccgaggtcggagcctgcaccttcttttcctttgcagttatgtatactgaatgtgcctccttcaccttcttcttcttgcaaaagaacatcacaatgtcaccgaccttctcgccatcggggaagcagccagagctaatcatcccatcgcaaactctccatgcagcatcaaccatggacttcctcccagctgcttgaatcgccagataatagctgtcgccatccggagcgcatcctaactcactgaacatgtcaaacgcctccaatgcagcctttgacttctcgagcttccagaacatcgcaagcagtttattcagcacctgtgtattcactgatccaggcacagctcccatttccttaaccaaatcccagagcaaatatacatccatcttgtcgatctcatcggaatcagcgatcttgtcgacgactatctcaagattggcgaggctcttggccgcggggttgttcttcccggcagatttgaacaggcggagcagctttttaccggagcagctctcggcggcggacacgagaatggcggcgaggagtggctcgttgaagtccacgaccatgtcggcgagggcggaggggatctgatcctcgggggtggactccacgacggcgccgacgcgcgcggccagcacctcgtcgaccacagcatcggcggggtcgggggaggcgtcggcggcgaagacgtcgtcggcgtccccggcgtcctcctcccagagcgaggccaggttgtcctccccggcttcggtgggatcagaggcgaggccatcctccccggcatcggtgggatcagaggacgcggaagcagcgccgccgccggcatccgggaggggctccggggaggaggagaggaagcgggagagggggcggggaggcggtggcgctcgggttaaggctcgaagtggagatggcggcggcgggagaggcctgtggatggaggagcggaggaggaggagagcacgagctcccgaacgccgccacatctcctcctcgtcggcggcggcggcggcggcggcgtggtagctgtaatgtgtggaggcggaggagtcactggtcgagtcgaggtgggaggcggaaggtttctttcttgctttctagggtttaaggccttgatggcgcactggactgggcctgattatttttgggccaatatgaaacttttctctttttcccctaaactaaattgccagttattttcaacacatttatgaatttagatccacgattgcgttgataacatctagataaatcatctttttcccattttagatgaaatataaatttttaaatcattataattcaacatacaaacttcaaatctattatgaatctaagaaccgaaagacgggaactgtgccaaacaaggcctataagcctcatttccaagaatcatcgccttcactttcgagataagtttgaatccaaatcttcgatggaattatcagcatttccatggaacatattatgatggactcttatactgaccaacaacagaggaaatcaaagcagatgaggattttattccaagcgacaccaggttttagttacatactgtaagacacaaaatagacattcagattgagctgctcatttccaggttgtatgattctactgtctattgaatccaacaggctacatgtcaaagaaataaaagatacatggatccttcaaaaaaaagcaacaggtagatttgcaatgtaggagtagtagcaatctccacccacacaacacacatctgaatgtgcatctatgcagtgatctcggatttggcattcttaacattttcttcatctttggttgatgccgctgctgctctgtcctgctctttcttctgcgcccttatcagtacacgtcttgcccggggacgcatctcacgcacttggcgtggtggcatcacaaaaggttcaagagggcgatcatggaatggatgctcatttccagaaaatatcctcagtttgcgatccctgtcctgtgatcagaacagtgcatgcttaataagcaacaacagcattatatgaagctttagcaatttgaagacgagaattgaaggaaaatatagatgttttaccacacaccagagaggaaaagacttgatttctcggacagaatagagttaaatcacataacaaagaaacaccatgaaagatcagtatacaactatcatgtggaacatgaaccaagaaggtatgattggatttacggtatgttgaagttgaacttgctattcaatacagttctcttgaaaatccccaccccatagaagaattgtaagataaagttcagcaaggctaagagaccgaaactataggcttattatggtaggttgaagctcaaaaatcttatcttattaatgtaattccaaactaagagaccgaaactataggctagatgtagaacaggattcatattggatagctatctagatgtttcaattatagactccattccttttcaaggggaaacaaatgtatacagcttccttcgctcagtgcaatataaacacagatatgctgcttgctgcaataatgaaataatcaaaaaaacttgatttttcaccattcaatcagcatgtcactgcagattctgtatccctacaatttttgggggtattatgaggaatcattggcaggatgaatacactaccagaatcacaatacgtagcataggcaactcacaatatatatctactgctgtataattgtattcgatcatcaatatgccatctagatccatcagcacaccactgtttattcaaactctagagtttcacaactcatgaagctagtccacatcaaggactgatgtgaatctctctatactgaacctaactggcctaactggctctaccgtgaatggatgtactacacgtttgcaaaaagccaacagctcgtcccttgcccgtggtatcccagctgctacaaacgacctcctgcaggccacgctacaaacgaccacatgcaggttatgctatctctaggatcagactcacatttcatcagtatcaaagcctaaaggcaagataaacacgcatgtcgctctggtatctgacggtttcaaccagctgcagtatgcacattctcaatcagcagacaaccaaatagaccccatctcggcgatcacccactctgactgcggctacaccaacactggtacaccacctgtgaacgaaagctcatgcccacgaggagaacctgatgggcgacggctccagccgaaacccaaaacaccacacatccctccactccacctggtgctttgcagagagcacacgcgcacaagctcctattccacggggcaccgcgcccgcgccgccgccatgggtggatccaggttacattaggtctcagcgccagccgaaatatgcgaggggaggacagcgcggctcgctctacggagacctcgatgccatctaccggagaggaggtaactgaccttgaggttgtcggtgaaggccggcagcgccacaaccatgttgatctcccgcggtggacttgtggccggagacgagaggggaagaggcggcaacggcgggggaaaggagaagacgatggagtcgtgggagcgactcttttgtctccttagtgcttagtgggccccacaggcccacctcattatatgggctcaatttgggcccaagtttggccttcttcagattgggctcctttcgtttccaacgagtttgagcctttttttttttacctccctttcttcttcttttttctttttctgaacgcgcacaatccttgcgcatcgatatattagaagggaaaaatatattttacaactaatacctgttagtcatcagggtaacaggaaataggtggaacactgaaagacaatcgggcgcctgtaaacaaggaaaaggagaaagagcttgtagatttgcatacattctttcaaaatttgcataaatttcacttgcattttaacaaattcaagtttatcctcccaaataaacaaaaaaaaatcttttaaatcctcccttgccgctcacatcggcaaagcaatagtagcttgcagatgattttctgcaccctccatggaagcaaacgaagcccagaaatgacatggcaagcagctttcacgtagctttgtgctaagtgcaaacttcaccaccaaaccaagccatctgcaactctgcagcaaggccgccaagatagatcatcgacgttaaccccgatgcgatgtttaagctaataatccaagtcaaaatcataccttgccatgctctccaagctactccaattttctgcgattgatgcggtaatggacagtacaactaccagtacaagatccgggtgacaagccaagaaaacgcggccgcgcgggaggaggaggatggaggagaagaggcagcggctggtgatctctctctcggcgctctgcctcgccgtcgccgtgatgtccggcgcgctgctgccgccgcgggcgtcggcggcgggaggggtcgggaggaagcggcggtgggccgggttcgactactacgtgctggcgctgcagtggccgggcaccgtctgccgccagaccagccattgctgcagctccaatggctgctgccggtgaccccccatccctccctttcttggctagtttcgccattgtcagcttggattgatttgctcacctggtgcttctcccccttttccgtctctgcagctcacatccgctcaaattcttcacgatccgtaagtgtgtatgagttcttgcggatcagaagctaaatttataatcgattgtatcaattcgtgaattcatattcttaaattgttggaatagatgggctgtggccgcagtacagctatgggggatggccatcctgctgcaggccaaccacattcgacggcaacaaggtggctgccaaccacccatcttatcttcagaatgggatattgggatgtggtcgttttcccccccaatttgatgaagaactgctagcttcttgctgtaagattggcatgtcaatgtgggtgtgtatttatctggttttaccttgtgacagatctcgaggttgaagacgatactcgaggagtactggccgtccttgtactgcggctctttctcaacctgctttggtgggaaaaggccattttgggtgcatgaggtagacattggtatctaaatgagatatgtgatttgatgaggagaaattactgacatcttacccttttttcctcttgactcttgttcatgtgctgatgctttactcgacattcgtcagtggggtatgtgatttctgaacttgttgttctgctccttaatgttgtcaaaattgttattcctagataagataagtactacaaaattccttttgtttaaaatatcatgttgccaatgcttgagaaaagaatctttatagtttcttacaccatgaataattcctgtcctcgaatcactgaagacagactgactgcattccatgagtttttttgaacatgacaaatttagttagttcctcgtatgtattaaaaagggactgctttatgtcttttttacgtataatttatctggtcacaaacagacagttcagaagctgcatgaaaaggtttgacctctaattggcaggagcatcccaacctaaactttcctaagcgtgccagatgatgcggctccatttttattgtatctaatactccacatttttgggcagaaactcatggaacatgtggttaccctgaaatacaggatgaatacgactacttctctacagcactgtacctttacagcaaatataatgtgacggttagtggatagtatttggtttcatgatatgaattcgtgaaactataaataatcacctcccatcttaattcaatatcccgcgtcaaaaaagaatcttaattcaatattatatacatatgcgcaaggtatttgaggttgtaacatttcctcagcacattgatatagttctcactctggtcttgcagaaagctctgaagaaagcacatatttatcctagaggaggcaggaaatacttagttggtcatatcgtctctgctattgaattttcctttggggcaatgccatctattgtgtgtaaaaacggctcagttcaagaactgaggctctgcttccacaaggattatcaggtaattttgatgtatttgtgagtgaagcacattattatgtcatcatgtccttacatattcagatttgattaaatcggtcaaagtaggaatttctcctgttatagtgatattagaagggcagggcctaatttttaatcgagtcacagtaggccctagattatgcaataacaaaacatacatattttttcaaaacggctaaacatagagtgttgagatagacaactggaatggatatcccaggctcccagctctcaagtgtccttgaaattattatttttactatgtggctttcgtgataaacatttatcgtcaagtgcagattcttctgagcatttctcaaattcataattgaactaaatagcgtatttttgcagcctcgcgattgcttagttgagggtgagaactctgttagaagaaaccattgccctcgatacgtcactttaccatcatataaaccacacggtgagttatctgtttgtgccaattatcagtcactgaaatgaacagacagtacatgcaatagaaactatgttttctgaacttctgaaatagtactaggttttctgaaatagtactaattgaacaatatagttcatttaatcatcttcttcttgaatttatgtggctttaccttctcttgttttaaagataggttttctgaaataattctctcagttttgacacttattatctggagaaatgcatgccttgtgctaatagaacaatagtataattgtttcagtcatcttctgcaattcatgtgactttaccttctcaatgaaaacataccttgttcatcccatgtgttttccctttttctgacactccggttgcacttgcagcatttggcaattctacagaaggaatcagtaaccaagtcaacgttgagcaccaatcatatcagtagatctcacatctcactgtgagtattctacaatataaacacggctctgatgactcaggaatgagatgtacagcaagaaacccactaggcacacatacagtaacgtctgcatctgtaattctataatgcaattcaattgattataaagcaactgaaaatcccatgctgagttatgcagaacttttactgcatctcagtttctgtaaatctgtaattctgaattgtctgcaaatttgcagcatcccgtcatttccaaattcaagcgcgccgttaacaattgccaatctcatgtttttgtgtcaaaaccattgtgctagatttcataatttgtcagcagctataatattttcgctgaatatcacatcacagcgtttatgttctcagcgaatatttcgctgaagtctgggagcttcgtgctctctgttccgttcactttacgcatctcaacctatcgctgtacaagcgcctgctttctgattgaccttggattatttgcgttctaagatttgtttgatcagatgctgattaatgtcaccttttggccttaatcatataaggaatattccaaagttaccaaatccacatgccatggcatcccgggccaaaatggtaatcagcctccggttgcttcaccttgcagggctctttatcttaaccaatctggaaaaaaattcacatgaattctgagaaaaaatgtgtagaaaacaactcgaatacttcaaagcgaataacaatccatttgaagcccactactttgaaagtttgaaatggatgaattttgcggaaaaatatctctcgataaaaatgctaaccaccaaatcacttgtaactaactgaaaacagaaatggtgcagtaatttctgatttggcggcgggagggccccacctgtcagtgagacgaccatcgcggtaaccgcatccaaataaatccacgtggccgccacgccgagcgaattgaccgtacaaccaagccgcagagaagaggaaggcggaatcagtcgagggcgaggcggcggcggcggcggcgatggcgacggcgaggaaggcgccgcgcatggtggcgatctgggcggtggtggtggtggtggtcgccgccgatctgttcggagcggcggtcgcgcggtcggcgtcggcgcgtcacgcggtggggaagaagcagcgggagttcgactacttcgcgctggcgctgcagtggcctggcaccatctgcgcctcaacccgccactgctgcgccatcaacggatgctgccggtagagcctcctcctcctcctccccgtctcctcccaccgccgccgccgcacgcgcgcgctcgtcggccggttttggtggtcgttacgattttcgcgcgcgcgccgcgaccttcggagattttttttcccctgatgcggttgcttttgcagctcggagccgctccagacgttcacgatccgtaagtgcgccgcgcggctgctcgatcgatcggtttaatcccaccctcgcgttcgatttggatgccgtttgctgctcgagcgaatcaatttctgattgatcgatgtgtgtgcgtgtgtattttgcgtactggatgaacagatgggctgtggccggactacgacgacgggacctggccggcgtgctgccgccacaccagcttcgacatggacaaggtacttggctgcagagctcctcctctttgtagctcgaatgctcgatgcttacacggttaattgaaagagtgacaatgacaaggtggttgtgctttggtgctaaccttatcgatgcatggattcgtcattcgatttttgtggtgtagatattgcccctgaagccgacgcttgagaagtactggccgtccctctactgctcatcctcttccacttgcttcagtggcaaggggcccttctgggctcatgaggtatataaaagtttcagaagtcaagaactaatggattggattatacaagtatacctcttttggatttgcaactgaccttttgtgctgttttcctgtctgtttgtcatatggtattcgatcattcgcggcatatctttagtggggtaatgttcttcaaatcattccaccttatgttatgagctttcttattgtttaactttctaacaggaagttattgattccacttgaaatatcacgtagttatatttactaggcactgatttgtcattactcaactcagctttctttttttctcagagaaacatggaacatgctcatccccggtagttaaggatgaattagagtatttcaccactgctcttgacctctacttcaaatacaacgtcacggtaagcatttgggcttgggcttactagttgtaggcttgtagcatcgagttgatttactttccagacaaaagtcactgtgtcacaaattacagcaacagtagccttttgtccaaataggtcagggtgttataaggacaaggcccaagttgagccacatgccatggcacaaaatcttgtcctttttcctctgattaaatcgcaccgcattgcaggaaatgttggcaagtggtggtatccatgtttcaaatggtaaacaatatgcgctaactgatgtcattgatgccatcaaatgtgcttttggggcctcaccgcaaattgtttgcaagaagggctcagttgaagaactgaggttatgctttgacaaagatttgaaggttagctctcctttttgttcttcgaacaacttcctacagtttgtatcatgaaaattatgctgcttttagaatgaacgaccaacagcatgcacattttgaaattatgttcctacaggcctgcagtttcatttgctaaaactcaagcatttaccaacctcaaacatgctacatctttctatatgtatgcctaatagtgaaaacaaaaaacttgatcactgttgaaacaccactaaactgtacggaattcaaggtgattatatgcatcatatagtgttttctgcttgtgtttcttcatgcccctattaaggaatgttttatctgttgtgttgaaatttctaaacatgtgctgcataaattttgactggtgagtatttttcccaaactagctacccatgtgaatattttccccaaaagttgggaatgtgcgcagtcctgcacgtgttatttggcaatgtctcacatggtcacatgttgcatatgctgtacaataaaatactataatctttctttttcaaagaaaacctgtacaatattgctaaactcggtggtatatttccagccccttgattgccttactactactgctaccaatgaaaacgtatcgaagaagaagtattgccctcgatacatcaccctgccaacatatgaccccataggtaagttcagttgctggaatgtaaatcattgttccaactcttgatgcgcatgctaatcctattgtctgattcgtctgaacatgattgcagtacatgctaattctactcgggagatcataacagtcgaaagtgaggtctatggatatctttacacatcctaagatacgattaccgcgagcaagaattacatggccatgatgaagccggtagttcagggctcttagctgcttaagacatactggggccggcattgaggttcaaggaaatgtatatctagataactcgattattacatttgtaagcacggcacgccagaacaacggagaatgtgattgtgtctgaaaaatcaattgctttatgtactatgcaaggttggaaaatagttcgtccatgtatatagtcattggtcagggtcatctgcgactgcaatctgctgaattataatggacagtggcaatcggtctgaacttttctggctacgaatatctatcatgtatgtgcccagagtacgtgttgacatggagcaagtcatcacgtgaattttgagtacaattcgttaagatcgtgcgagacattttcgagtgaagaactttattgtgttgtcatcgtcagttatacatgttccctttgtacaggtgaaaatgcacacttttgcacaccggcaattgcagcaaatacaaaccaacaactgtagaacagtactccctccctccgtttcgaaatgtttgacgccgttgactttttagcacatgtttgaccgttcgtcttattcaaaaaatttaagttaattattaaatttctttttccctatcaattctgattgcattgttaaatatattttcatgtaggcatataattttacacatttcacaaaagttt

SEQ ID NO: 59315 - DNA, 5454 bp, Oryza sativa
atggtgatgtttttctggcctttaattaattacttctcatgttatttgtggatttaaattgaaacaaattattaagacatcaacgagtgcgagcacaaagatgagtacccctgctacggcgtctgcaccaatacggcaggcagctacgcttgctcttgccccaagggatccagtggaaatgccagcgtggagggtggctgccgccgcgacgacaagttcactctagcactcaagacggtcacaggtacctacgaaagattttttttatatattttatatattttttatatacctttccaaaaagtatttttaaatatgaattttgactacgccagcctgtggccaaataactttgtcacgtcacgcacagctggcgcggcagtgctgtcctgccacactagcctcttgccacgctaccatggctggcgtggcaaaacaacgcttcaacgccaaaaggtttagtttttgaaatattttttaagaacggtatattaataaaattaaaaaataaaaagtctaaaaaaataaaaaaattctcctacaaaacgggattcttcaccttaacaacaaataatcttgactttatatcactatgtcactgaaccgaaaatcacctgacactgacgttacagcagaggatccatatctgttgtaccaatatatgatacctctgtcccaaaatattaggacaagatgatattacttgttcggattcgtaatattaggaaatatcaccttctacactagtcgtaataatttgagtttggagaaagcagtgacagataagccagcagcttagtaaaaagctaatccctccgtcttaaaatttttcagatgtattttgtttgattaggacaagactttaaccaataattgcttcattagtatattatttatgtggcacaaacttatgatcataagaaattacttttcactataaatttggtaaattttactacaatacatctaaatcaatctatctatatatctatctattatatactaaaactccatgaaacttcctacaaacgctcctaagccgccatgtgtactcctacaaatactcctaaaccaccacatgacatcttaacaaattggtgggcctaatatttttatctattaaaattttattaaaaaaataaccccacaaacttccctcccctcttctctccccatgggcccatccttcaaccggacgaacaactcaagttcgtacgtacttaggtacggtctccctcccctcctatccaatctcttcttcttttttttctttagttataaaaatttttaaacaataataaatcttaaataaccatattttttctatagttatttgcatgttgtctatcaacaattaaaaaatataaggtgttctttaacctatatgaaatatttaatttttttatcacatcctaaactttgcatatcacgtaaaactgtcatataaaataggtaaaaattgataatgtagattacacgatcatatatcaattgacagaatatacataaacaaattaagttagatctattatataacaaacgtttctaagccaccacgtggcatcctgcaaacgctatgtactacgatgccacgtgtcactataataaattagagaaatttttaaaatttttaagaaaaagaaaacatctagacattaatttttattaaattaggtagacccattatttaccactattatatttatctttaaaagaactccttaacctccaaaccggatccaaattggacctgtacgtagcgtacgttttcttaaggatagtacgtacgtacgttagtaacgtacttccaccccttcttccctcaatttcttcatatttttgcacatatttcttcccctattatcatatactttattagttagaaaatatattttgtgttaaacaattcaacaactataacatctaaatcatacaactaacttttaattcgcttatatcttaaaattattttatgactaaatctacaggcaaataccaaatttccacaataattcaactttgagaaagaaaatgacactttggattatatttccagacttttgcgtaccgttgaagcaattacaaaaaaaatgaaataataatattgtagactctatcattgtgcataacttcataagaattaaattatatctacaatcataaaatctaaaataaaaatagctatgagtaatgttcccaaaatatataagttagaaagcaagagttacacgaaaaaaataagcagctataacatctcaatcatgggatcccctaaatcatacgagtaatatttttcttatgtattttgattattttacatttaaaaacccatatttgaggttatattatctgacttttatatgcaattcaaacaattataaaattgtgaatagtaacgatatatattttatcattgtatatgtcagggttacgggtcagacataccctctacccttcgatatacgttacatatcgacatggcatacccacgcgcacgcggatgttttctacatatcctaaggaaacctttgacgaaatctacagatgggaagagtccttctcggacagaactgggtcgtcgacgtatcgtattgggtctgatatctctgagtcctacttgaaaacctccagatctatgatataaaagggaccccccggggagggcatggatcatcgaatctcagagccaacacaacccacacagcctacaaagccgaagtctgcgaggagccaagtcgtcgagagctagtcgaatccactcgactacaatctcgccggatccgacaagttccatcgttccctttgtaacctgtgttttccaccatataatcccatatcaactggattagggctattacctaccaagggacctaaaccagtataattcttttcttttgattgttcgatgtcgtactacgtagatccttgtaccaacgtaccccaataccctctatatccggtctacgggtatcacccgtcgacagtatataagttcacaataattcaattagacctgtaatgacaaaaagtaaaataaacctaataacactatgtattgttaaaaaaatttactcctcccattctgatattataataaataaaaataacattagtagatttttagtgttcacattttcaatattgtatactatgtaggaaaagacgagtagaaaagatagatcttaatcaatcaataaaatttttattctatttttagttaataaagtaatagtaagtaaaacacaataaatgtaaaaaaataattatatgtgcacgtactttgtcccattcgactttctcttcttctcctatctcactcaactcctttttcttataatttttaactaattaacaaaataataaaaaatgatcaataattacaaagctaaataattatgattcttatgtcatatctgtttttagtttatttgaactgttattttgtttataattaaataaataattcaagatgcatattactcatatttcacttcgtaaaaatgaaaatataccatttaagcatacacacctatcctttgcatggtaaccaaatagaaaaaaaatagagcattataaaaaaatgacaataagtattacatcacctcaaatcattatacatcctctgtagcgcatgtagcgcatttacagtggtacgtaacttacgtgctacatcttaattaaaagtaagaccttagaaattgtaagaaaagacatttgaccatcaattttcacttaataggtggatccattattttaaccaatagatataatattagagaaaatcttaagctgccatgtgttacgtcttaaaatttagacgcaaaggatatgaaaaattttgacaaaaaaaagcggatcatcaattttcacttaaatcattagaaaaaaagcccccccccacttcgccctccctcacatgtgcacaacacaacactacccgtgtcccctcctcccctcctgtctcagcttgagttctccactctctcctttacccctcctttctatagtgagaaataatcaataatattaaacatgcaaattttttagctgtacatctgatttctaatctaactattgctctattcataattaaatcaacaatttaaaggttcataacctctatagtttgaactggtataaaataaaatttaaaatataaaatatcaatagggactaaattgaactatttggagaaaatcaaataagttcgcacctttcactaaaattagacaacccattacatgttccatttttataatattttttaaatgcttacatgttaatggccttgcatctatcctatactatagtattatgagtttgtcagcctattaagccacactatggtagcagtatagatatagttagttgaaaagatatatttattactattaaatttaatttttcgaactcatgttaactatattttattttagaaaagatactataggtcaaacgtattactacgatatgtctttgttaacttatatgtaaatatgtaacaacttgcatgaatctaaaccaactaaggctatgttcgggagtgagggtgtcgcgaccgggaaaattgccttttcccgaacgctagtgtattaatccccgtcccaggaaaagccggggtacaccacacaaacatgatataaaagacacatctttgctatatcgacaatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggagatgcacaattaatgcaagggagtacaaggggataataatataggggttacgttttgcagtaaacagcatttaaaagtcacttagttgcccaaagccattttgtaaagacgattctagagctacacagtattattaaacaaggctgtgaaccctcacgaacctgccttaacccaaggcctacgatgatttggaccgaactggcaacccgacctgggtcccagctcgtcccaagccaacccaggccaaccattccatgttttagttgttgagcaaattttaagaattaaaacactgacttgggtacattgctaggcttgcccatatccgagggctcggctattcgaatagatttactctgatcagaggtgtacatctttacccacaagacacatcttcctcacgtgttaccacgcgccacataccaccacggtatacagacggaagacgtgacatagtttccaacccatcctagccataaacaagagtaccgacccaatcctgcctacggccgggatacccgggacaggcaggcagaactgagcccctagcattgggcaccaacccttcgccg

SEQ ID NO: 59316 - DNA, 9458 bp, Oryza sativa
  unsure (1)..(9458): unsure at all n locations
tttatgttctacctctgtttcaaaatgaagatgttttgttttttttaagtaaaacttcttcaagtttgctcaagtttatagaaaaatgtagtgacatattcaacaccaaaggagtacttcccctctgcaattcctgatgaccactattaaaaatatttttataatacgtttgtttagcattaaaaatattgctatggcctatggtttctataaacttagccaaaaagaagtttaacttagaacaacactaaaagaatctatattttgaaacccgggagtaaaaaggtagccttgtttgaatttcttttagcaaactattcccttcaaattcatgtgatttttttgtgacgttaggcgatattgttatacccttcaatttcatgtgattttttttgtgacgtttgacaatactgttatcttatatagatcaaggttatcaataatggccactcatgtattagagtggctgatcagctttcgttttcgatgtgtcaatagctttggcacatgatgctccggttgcatggctttttgctttagcatgcaacggctggctactatttgctatggataaatttatggtcggctatgcttattttgagaaaggggtgtcaccactcaccactattaggtgttctcttgtatctttgacagagtgcacattattaaaacacaggttgattaattatagaacatttgaaacttaaatctgaaagaaagaaaatctttttatttactactaagtgaaaccttcttttaatataatttgaaaattacacacaactagatcctttctattaagaaaaaccatttttgtttatgcacaaaattaactctgtttttcccagacaaaaatgaattttgtttgctattagggggcactacaagtaaatgcaaactcatttctatgagatagccttctgtaaaactaaaattcaatacaaattttacaagtattgtaaatttaccgctaatatccgacttccaagggctcctttgaatcgcatgtgaaaaaacggaattatatgaaaacataggattttgacatgaaagcaaatgcaaaatacaagattacacctaggaatcagatgattgaaacttacggctccatcatttcgcttattattgaatatttgcaaacgaaaaataatttgtgaatagaacttttatatatgtgttcttagcgacctaaagcaaaggatgaaaataaacttcactgaaaaactccaaaaacaactccaaatttaagcttgataatttaaatttcgactgataagcataattataagcgaaaatataagaccgttagaaggaaatttttcaagatgttacaactctgactaacttcctttcaaaatctctacatgaatgttccttctataagaattccagagaaaatgagagtgctgtagaattaaaatcctcctatagtataaataaagctactttatgtgcttatatttttttttctaaaagtaaatattaaagaaaatgtcttttgtggccctccaaccccaatgatgcccattgcgagggttttttttttttatatataaataagcgacccaaccattccccgggagtcaaggtggaagagacggacagaggccactacccgtgcaccacgccccctctcccacaatctcgcaaaaaagttgattttctttttcagcttcctcctcccctcctccgcttctcatcaatccactagcatatcagatcagattcctgtacacttccctttcctcgcatccaatcccgactatcaaatcatcaccatccttttgcaaaaccaaaaaaaaaaaagtagataaaagaagaaggttcttgcatccaagagaggaggacactgtccgtcgtgcagcgtttcttgcttggttgaatcgggtggttttgggggggatggcggggaaggtggagaagatggcgtcgatcgacgcgcagctgcggatgctggcgccggcgaagctgtcggaggacgacaagctggtggagtacgacgccctcctcctcgaccgcttcctcgacatcctccaggacctccacggcgacgacctccgcgagctggtatgctggtgctactctctctattcgatccccaatgactgattaaatctttttcatcatctgctactcctactctgctacctgcatgttcatgctccagatcagcagataatgcttgcttgtttgcttgctgcctgcgtgtgcgcgcttgtgaatatcttctttttttttaatggagtgatttggttgcttgtggactgattgactgactcactcactgaatgattggattagcttttgtgagtgggattgtggggattctgtgcttcagcataattggaacatggagagtgcccatgtttttgggggtgctttctgctttttctttattttaatttgggggtaaaaaaccaaaatattccaacagtttcttcctttattttttagtttgtcggttgacaagttggtgcttccagtgagggtactgagtggagttttcgttctggggcctgcccctttcttcttcttcttttttagagtattcggattatgtttctgggttaaaatatgtgtttgaattattgtgttcgtataatggaaattcagaaaaaaaactggcatcttttgcatttggagctgttttccaggggtgtatgtactgaaatctgaatatttactgtttgagtcaaatctgagctgaactttaattatctatcctgaattcctgattgattaacaactgccactttgtataaacaacagtttcatagacatccatcgtaactgaacacttcatttttatcaaattttaagcagaggaagtcaaagacatgggtgtcaaatgtttgtgttttttatttttgttgtttcgtcaaactgaatgtgacatgtactcattagttggatctttaggatatcaggaaatgacaactgtatattaaaagttttatattgacaaaccaacatgaattctttggtattgctagagccttgcttaagtacttactcctgtgcaaaaattttgaggtttagtgccctagtgtgctcaggtttggtgcttttgtatttgaagtcttcatttgcagacgtggctgcaattttttatagaagggtaaattgtgaatgaaatctgagttgatctttaattgtatattctgtatatctatcaaccactttaatgattacaacaaaaattccagctttacatgaacatgccatgaacttccgttgaaagtgaataacttggctttgtcagttccccgtgtggccaatgttcatgcacgagactaatattgaatacaatttgttttgtcaaaataaactgatacctttgttgcagacccttccatggatgtatgacaaggaattttttttttactttgatgtatagtcaattagtttgatttttttttgttctgaattgattggaaaataatgcctgtatttacaattttatatcaacggaaaaaccatggattgctaatttgttattgatatgtgtaggtccaagaatgctatgagatcgctgctgagtatgaagggaagcatgactcccaaaagctcgatgaacttggcaacatgttgacaagcttggatcctggtgactccattgtgatggccaaagctttctcccacatgcttaatttggctaacttggccgaggaggtccagattgcatacaggaggagaatcaagctcaagaagggtgactttgctgatgagaactcggcactgacagaatctgacattgaagaaacttttaagaggcttgttgttgacctgaagaaatcaccagcagaggtctttgatgcccttaagagtcagactgttgacctggttttgactgcacatccaacacagtcagtgaggaggtcactgcttcaaaaacactcaaggtgagttacagaaacaatactatgatatcaaacatcctatggtttcttatcatctaattgtgaaatttcaaatataatttaggataaggaattgtttggttcaactatactcaaaggatatcacaccagatgataaacaggagcttgatgaggctctccagagggaggtaagataatcaagttaatcactgactcatttatagtcttgattttttttttcaaattgtatgtgccttttcgattatttatagaaattataaattactttcagcatgatgctcaacatgccagattttgtgctccaactaaatttattaatgcattaataaggtgaatcagaacatgttcttatttttcagattcaagcagcctttagaactgatgagatccgaagaacccagccaactcctcaagatgaaatgagggctggtatgagttactttcatgagacaatctggaaaggtgttccgaagttcttacgccgtctggacactgccttgaagaacatcggaattgatgagcgtgttccttataatgcacctctcattcagttctcttcttggatgggaggagaccgtgatggtatgcaaaggatggcttttgacttctgtatagttcagttcttgtgcatttaataattttgtgcattgcaccaatttaggaaatccaagagtgacaccagaagtcacaagggatgtatgcttgcttgctagaatgatggcttcaaatttatactgctcgcaaattgaggatctcatgtttgaggtaagaattacttcatcccttatcttccacacatataaatcaattttattaaattctccaaattctggcagctgtctatgtggcgatgcaatgatgagcttcgggcacgagcagatgagctgcatctctcctcaaagaaagatgcaaagcactatataggtaaatatcgactacccattttaatagtgatggctatctgttatgattgacaatgttggcataatatcgtttccttgttcgtcttagaattctggaagaaggttccgcccagtgagccataccgagttgttctaggtgatgtgagagacaagctgtacaacacacgtgaacgagcacgccagttattatccagcggatattctgacattcctgaagaaaccactctcaccagtgttgaacaggtaaagtattgatcaaagaaccattggatgcttgtaactctgaaatgggcattctttcttcatcacctttgttcttaagtctaaacaactgtcttaccttgcagttcttagagcctctggagctatgttacaggtcactctgcgattgcggtgaccgtgtaattgctgatgggacccttctggacttcttgcgccaggtgtctacctttgggctgtgccttgtgaggcttgacattaggcaagaatctgacaggcacaccgatgtcctcgatgccatcaccacatacctgggaataggatcataccgtgagtggtccgaggaacgccgtcaggactggctcttgtctgaactcaatgggaagcgcccattgtttggcccagaccttcccaagaccgatgagattgctgacgttctagacacgttccgcgtgatagctgagcttcccgctgacaattttggggcctatatcatttccatggcgacagctccgtcagacgtgcttgctgttgagctcctccaacgtgaatgccatgtgaagacaccacttagagttgtcccactgtttgagaagttggctgatcttgaatctgccccagcagcagtggccagactgttctccatagattggtacagagaaaggataaatnnnnnnnnnnnnnnnnnnnnnnnnnnnnnnnnnnngggtaaggacgccggtcgtctctcggcagcttggcagctgtacaagtctcaggaggagctcatcaacgttgccaaggagtttggggtgaagttgacaatgttccatgggcgcggtgggactgtcggaagaggcggaggtcccactcatcttgccatcttgtctcagccaccagacacaatccatggatctctccgggtcactgtccagggtgaagtcattgagcagtcctttggtgaggagcacctttgcttcaggacactgcagcgtttcacggctgccactctggagcatggcatgcatccaccaattgcgccgaaaccagaatggcgtgctctgcttgatgagatggctgtggtggctacaaaggaataccggtccatcgtcttccaggaaccacgctttgtcgagtatttccgccttgtgagtgttttgtttcttcataatcatcagacttggaacatttcatataatgcatttaaggcacttagctaaacattgttcatttcaggcaaaacctttgtaaattaattttctttacatttttcatgaaatcaggcaacaccagagatggagtatggaaggatgaatataggaagcaggccatccaagagaaagccgagtggtggcatcgagtcactccgtgccatcccatggatcttcgcgtggacgcaaactcgcttccaccttcctgtctggcttggcttcggttctgccttcaagcacatcctggagaaggacatcaggaacctccacatgctccaggagatgtacaatgagtggccgttcttcagagtcacgatcgatctggttgagatggttttcgccaagggtgaccctggcatcgccgcattgtacgacaagctccttgtctccgaggagctatggcctctgggagagaaactgagggccaactgtgaagaaaccaaacagcttctccttcaggtgcgtcgactgaccttgctagagctgattacactttggaaaccaatgatgcaacatctatgagatactgaaatgttccattgtcattcactcaatgaaattctttggccacttttgaccttcaggttgctggacacaaggatcttctcgaaggtgatctctacctgaagcagcgccttcgcctccgcaatgcctacatcaccaccctgaatgtctgccaggcttacacgatgaagcgaatccgcgacccggactaccatgtcacgctgcgcccccacatgtccaaggagatcatggactggtctaagccggctgcggagctggtgaagctgaacccgaccagtgagtatgcgccggggctggaggacaccctcatcctgaccatgaagggaattgctgctggaatgcagaacaccggctaagcgaactatcaactatgaagtgcctgaattcacaccgttttatatggactcttatcttgatttcggtcatttgctctcggccatttaattttgccgatgcagaggctcgtgcagtttctaatttctttcggaagatattttcaataatggagttgtacaagaacatcaattaatcaaaataaagtggatattatgttcattatcgtttagagcaacctggtaaagccatttttttgtgtagaccacatagtgagtgtgttgaaattccatttgcttaatgaaactgccattatctaagtaaagtcaaagggctcctttatattgaaagaaattcaaaagaattttgaaggattacaaacctactccctccgtcccataatacaagggattatggagggatatgtgatacatccctccaaaatattatgggacttcttgttcaaattcataatattagaatgtgtcacatctatctactatatactaaaagtccattaaacttcctagaaacgctatcaggtcgccacgtggcattcctacaaatactcttaagacgccacatggcactgtttaatctcaccgtcgattttcacttaaatttgtggacccattattttacatcattagattagatctattattaaaaataataataaatttctcctatacttatatcatacacatagtataactgttctacgtgcgtacgattgaaagcaattacctactgttcacaaaaagaatcatacaaagttagataaaaaaagacagtcaaaatacatgcatccataaaaatcgatggtcaacagacatacgtaggtgagagagaggacaggaagaaattatttattcaatctaatctaataggttaaaacactaaacccatcgatttaaatgaaaatcgagggctatgtttgtttaaaaactatctatctatctattatatgctaaaagtccattaacctttatacaaacacttttaaatcatcatatgtcacttctataaacactcctaagacgtcacgtggcgttctaataaatcaaagaaaatcataagaattctaataaaaacaaaatctaaccattgattttcctttcaataaggtggacccatcatgcattctctaccattagattcatcttaataaaaaaataagacacggaaaagacccatgtttttctaaggtggactcggacggtccatcatgctataccgtgcgtccggttacgagccggtttggccgcggcggcaagtttatcgctaattaatttatctctgtatatacgtagcacaagctaagattaattagctcccatattatgttactactaactcatagctatatttattatatatacgacaatatatataaatggaagctaggagattaacactaagattatacatatatagctaattaaattagttatacatgatttgtgaaaggagattaacggcaatataacatagctaattaaatcagtttgcatggtttgcggcaacattacatagctaattcgaaccaatgcatttggcagtctctagataaattgtccagcttaaatcgttgtatctaagatctgatctgttttaagtcatcgtgatgtctttaaaatttaaaaaagattttttaaaaaacaaaatgcatgataatcggttttaacttaaattgtttagaaaattagaaaaacaaagtcccctccacctcaccctcaccatcacatacgcacaacacttttcgccccatccatttttggcttgggttctccactctccacttctctctgtatcttttggagtagcaatgataaaaagagaaacaaccaataatatcgaaacatccacagttatattaagctacatgtcgcatatctattctaattgttgatctatacataattaaactaacaaattaagattcataataacttgtataaaatagaaaaaaattatcaatagaggctaaattgagccaattgtagaacatctaacaaattcgtaaagaaatagtttttaattttcacttaaactgaaacaaccgttgccatatcaattaaattggccttccctctatctatgatgccatggcattatgagttccttcacgtattattatatatgtaattcacactaaaatagcaatatttgttagtattagaataaaaatttaactcatattgactaggtatatttaaaaagctctataggacacacgtatcatagggaagcgaggtctagattatgtatatctccttcgcatttattgatcatgtagagtatgtgtaacaaattacatcaatatgaacaaattagagagagggttagcttgatagtaaaaataa

SEQ ID NO: 59317 - DNA, 6373 bp, Oryza sativa
agtaaccaaccatcgaccattttcaaggtcacagtcacccaccaggaaggcatagaggcaagacagaaagtcaagacagcaggaatcgaacctagtcatagtaaaatgatcattcaaagtagacttttgtcatagggcaaagaagcttagaagggtgatgtagggaagtagtaagggatgaaatcacttatatgttgtatgacgcaacgaccgggatgaatcaaaggcatgcaaagggaatggatagctcaacctgtcagtagttcaagtgaattgtcgtagtgtaaggaagattgattggttttctgattgctacttggctggcataagaaagaaggcgccccggcaggaattctataagcttgacttgcgtgcagcgtttgggaatcaaagataaaaaataactctatgggacttacggaactagaaagaaggtagcacctaggcgtaagaaagaaagtaaatagagacagcacctactacgctatctattgaagcttactatataatatataaaagaaaaaaaaggccatataggcctattgggtgccgatccactcgatcctatgctatgcatttgtgaccaaggcgaggtaagatcatgaatacaagatggcgatgagtcatgccaagtttggggagtgttgctcataccctcattgcatgttttaaaatagggcatactgcctgtgatttactattgatttccaagtcgacacgagattctatttctttccctctacactatgtacttacttttccggctatgcgagagagactttatccttggtctataggcacaaatccagtagaaaataccaatccaacttcctcctaaaatcacttctaacaggcgagcgtgacttgtgcgtgctacaattgctttagcgggagctgctgtcggtattggaaacgtcctcagttcttcgattcattccgtggcgcgaaatccttcattggctaaacaattatttggttatgccattttgggcgtagtaccggtattagagatcaggaaagtagttgggagagctcatgagactctttttgtgaaattcataagtctcaattccccaaaaactcgagttccttttggatttccttcttgattaatgacaaccgtcatcatatcgtattatcataccgttgtcacgtttgagttcttgttcttcccccgaagaatcgccaccaaagacattcttccatggttttttttacatggggggggctcggttttgtaaaagattatgggtttgtgtcgaattattttattcttcttacccagtccttcggtggaatgatgaacatacaaagctcatgaataggattgacttccctaggcgagattagggttagaggagatagcaaacatggagattaatgcttcttcaggttctaattgcttttctgttgcactattgcttaactcctcctgtggatcttcctttcacaagttgacaatcacaatcgcagtacctaaacgtcttgcagtgatatggagttaccaaccacctcgacctagccaaagggccaaatcaagatgggtttttgtagaaaacggctaaaccggctagcggagctgatttagagagacccgacgaaaacagattcgggttcggaccctgacggtcagaccggccgcatacctgcggtaagaccggagttcaggccacggtcagaccgcccacatacctgtggtctgacctgtcctgtgaaggaaacccgacactttctaaactttggtaattttcctctatttcatccatatgtgccaaatttggatgtaaacatcaacttaaatgtttaaccagaaagattaaactggtgaaaaaagacaaaacagtttacttatcttctaacaaattcgagatctgaatacgataaagtcgtcgtagcttctggcaccaataatacgcctgattctcatgctcacaagagcacaaagtagccaggccagccttgttgccttcgttgcatggagaagaaagatacacatcaccagagtgtgggatcatacaggagaagaaaaggatagaacgaaataccaccttcgtcttttaatatatgacgatattgatgtttacacatactgttcaccattcatccaaattgaaatactaaacaaatatcatttgtaacttgtttttgttattaaagattttttaaatcatgacgtattttttttatttttgcaataagcttttaaataagacaaatcatcaaacgacacgtccaaaaaaatttaaaagcaaagagcatttttcagctcgaagaactaagaaacatagggagtactctcttcgttacgaaataagtttagttttatccatcacacataccaatataaaattaaaaaaaaagactacaatacccgaactttattaaatcctaatgcaattattcctatctttatctactcccaaatcccaatgcaattttttacaaactctgatacaattgctaaagataaatttgtcttgagattaacaattgagacataaataaagtcgtttgggatagtgacacggtctccaaaacacaattttgacttcctgtttttataaaaaatatttattgaattttatgaaagtatttttcaagacaaatctatgtatatagtttttatattttcaaactcaacagcttaagagttattcatgatttatattcctaagatttgacttaaacattattctaaatgacttactttatgagtacggagggagtacgagctattagctccgtccaagaatgtactccctccgtttctaaatatttgacgctgttgactttttaaaacatgcttgaccattcgtattattaaaaaaattaagtaattattaattcttttcctatcatttgattcattgttaaatatactttcacgtatacatatagttttacatattttacagaaaaaattgtaaataagacgaacaattaaatatgtttatgtgctaaaaagtcaacggtgtcaaacatttacaaacggaaagagtactagcaagcacacatgtgcgttatcgtcttctcccggcgcgaccgcatgcggaggagagggacgcgacggccggtggcccgggcgttatcatcaaaaccatcaaatcagccgtgttgtcgatgcggcagccagccgatcggctcgccggacggccgcctgcgtttgtcccatcgtcctcgcgagtcctcccctcctaacctgcagtgctatatatgccacgacgagcaggaggcgaccagacggagagagagatcgatcgaacgaggcgtcgccgtcgatcgccgtcgtgccggatcgtttggttagcttgcaagacatgcttatatactccttccgttacatattatattataaatcgttttaactttgttttaattttttttcgttttcaaagtttgattaaatttataaaaaaaataacgatccttttaacataaaataaatatcctattaaaatatatccaatgttatatttaataaaactaatataatattatatataaatgatgctaaattaaattaaatcaaaacgagttataatagaaaatagaaaacagatgaagtatatatatactctatactgcgcgggcgtatggatcgccggagtcgccgttggaaaactacatgcgtgaatgcgtgattaaaagtcggcatgatccaccaccgcctgcagaaagaacaaagcacgacagatggtgacttgtggtaaagagattctgtgaaggggaaggtttaattttatgctgtcaattaagtaagtctctcatcggatgggctaaacagtcaaagaataaaccaaaatttaaattttcaaacttaattttgagattgattttgagatattttcaacgtagtttctttttcagcattgacttttaagtcaccaagaacatatatataaaagttttatctaaaaattcatttttattctctaataagccgttttggcttattagggaaaaagccaaacgatgagagcctaacctttcaagactaaaagaaaaatattattttagcagtatatagtttatttttctcttccatgatgttaaacccaagtgtataacagataatatgatcgatctgatggcgtctagaaggctcatggacaattattatatgctgctttttaccatacagtatattgggatcacggtgacctaattttaaggacttttttgaaactcaagaattttataagattttcatagagatccgttcgaagcaagtaaatgtttttttcctatagaagcaccgctatgatcttataagaagcagctagtatgtaagtcagttgaaggaatatgagaatctgaaaaaaaaagttttttcacttatatttctagtttgttatttcctccatcccaaaatatattcgtagtgctagtatgtggcacttcttataccaaaatctcttatatcataaaatgtggaaaatagttagattctataactactgattcctagaatcttttgaggacctgaagatttggaataaattacaggcgtaagaatctgcaataactgattgtttagcattatgaaaaacaactgattggtcagcttctgtaatctgcaaaaaatggctttttatcttctctcttctagttcatgaatctcacaaccacatattctcaatgtttaggtataactttatttcttcgagagagctaaacattttgagagaggcaatacttcttgagaatgctacatgctgggtccccttgtcccctgcctatccaaggacgagtgagctgagcaacaaggaggagggtgcccaccggcgaggacattcgacgtgggccgggggagaggacctgtttagcgagaggacgtgaccaccagcgacgagcactagcatgggggcgtggacgacagtaggctgtgtggttggcgacggtagcggtggctacttcttccctgggtcgccatggccgcgcgcgaaggtggccaccaccgttgtcgtcagcggatccagcagagggaggataggaagcgccatcgtcaccgccgctgcgccaagtgaggacggccagatccttctccactgatctcgattccccacggcagcaacgatgacaaaggctgatggaacgtgtagctggtactgatggataccttgtcagtattgtttgatacctatagggatcgaccggtgtcagtggatacctataggtatcatctgataccttgtcagtattgtttgatacttggtaggtatcagatccaggattccgtgtttcgcaagccccatgtacgcaagaagctttccaaatgcaattcgtgcattcgttagggcatgagcaacgtatcttgtcggactcggtagtaacgtgggcccaagatacatgtgatagtagtatatgaacttacccataatatttattcgtgtgagtgagaagtaaggtagggtccacttaaaagttgattcctatgaatggtgagaaacaataatttcatggttccttatactaatattttacttgcatgtgtcagatttactgtacaaataatgatatttatttcttatgttgctacttggtagcaagagtgcattcaatgcttaatacctagtttttcatcacattgtggatgtccttagagcaagtttaatagtatagccaactattagctccaatttatctatagccaatctaataactcattcatacaatagttacatactacactatcaataactggtcccacctgtcatacacacagtgtcttggagttcgtattacagctaactacaaatgtgtagcccgctgctcttctctccttatttatcttcttaaaatatgtttggagctgcctcctgctatttaatctgctcttaggcatgctgaaaattgaaatgcaatgaccggggcccacgcgtcagtaacggattcccacgccctcgcgcctcctcaaataccaccacccactccactccgctttccttcaacattcgcgacgagaagttcaaaaaaaaaaaaacattcgcgacgagcatccgatactcgccgccgccgcagcgcgcgccatgccgctctccgcaacggatgcggcggccgccgccgtcaagccgctgccgcgtgcgctctcgcttgcgggggcggccgtggcggcggccaccacgtcgctgatcctcatctccgtcgtcgtctcccgcgcccaccactccgcctcctcctcctcctcctcgccgccgccctccagcagcgcctccaccgcggcgccgctgcccgcgccacccaccccgtcgcccgtcccggagcaccttcaccaccacccgccgccgccgccccccgttccgccgtgcccgcccaacgccacccacgttgtcccctgccacgaggacgacgagctcttcggggagcgccactg

SEQ ID NO: 59318 - DNA, 17972 bp, Oryza sativa
agaaagaaaggggggaaaagaggacttcttttagggttttttctttttataaaccttttcaactttgtttatttcttctcaattattatttgtgctctgaaaattccactaaaatttatttacgcattttaggcttttaggaaatatacaaaaatcctccaagccttatttgacttttatctttgcacattttaattgttggaggctttcacatgaattttaattattctttgcacaatttcgaggatgtattttagagtcgatttgggacgtgacaaacctaccccccttaaacggaatctcgaccccgagattcggaagaactggcgaagagaccgggatgggctgccttcagctcgtcttcacgctcccaagtagcttcttcttcggcgtgattactccactggaccttgcaaaaacggattacccggttcctggtcctgcgctccatgatgtccaggattttcactggcctctccacgtaggtcaaatcttcacgaacttcaatttgctctgagtcggcctgctcggatggcactcgaaggcatttcttgagttgcgacacatggaacacatcatgcacgttgcccaaggaggcgggtagctccaactggtaagcgacttctccgcgtcgagcaacgatacggaaaggacccacataccgaggtgcaagcttccctttcgtctgaaacctgtgtacacctcgcaatggcgtgactcgaagatacacaaaatcatccactgcgaattccaggtcacggcgacggttatctgcataacttttctgccgggactgtgccacctttagattatcccgaatgattctgactttagcttcagcttctctcaggatatcagtcccgaacacttgactttctccaacttggtcccacaatagcggtgtccgacatttgcgcccatacaacgcttcatatggtgccatttgtatgctggcttgatagctgttattgtaggagaactcggcataggggagactcttatcccaggtcttcccgaaatctagtacacatgcgcgaagcatatcttctaggatctgatttagacgctcggtctgtccatctgtctgcgggtgataggcggtgctgaaatttaatcgggtacccaactcttcttggagcttcttccaaaagtgagaggtgaattggcttccccgatcagatacgattttcttgggaacgccatggagactcacgatcctggcgaagtagagttcagctagcttgttccctccataggtggtcttcacaggaataaatcgagctaccttggttaatcgatccacaactacccatattgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggtctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaaggggataataataggggttaggttttgcagtaaacagcatttaaaagtcactttgttgcccaaagttattttataaagacgatcctagagctacacaatattattaaacaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaccataatccaacaattccatagtgtccaaatgatatgagaattcccaaagtctaaagttataaaaccacctaatgttgcctaattaatcagcgaagcatctacctaaattcatactagtggaaccaggaatagagtacccactagttggggttttgtttattctagggtgaacaaggtaataataacaatagcaataataatgtcataacaaaggtaaataggcagggctaaataaaacagtgataacgcgggaatttaaataaagcggtaatgcattaatttaaatcaaaataattttataaactgggattcaatatgctcaaggatgatgtgacttgccttgctcgctttcccaaacgccggcttcaacttccgcgaagagcggatcttccgaagctgcagcgtctacacgaccaacggaaaagaaaaggcttttactctaataaactccatacaacaagcaggaacaaagcacaaaaataggttcttgacttcttaaggaaaaattagagacttgaacggtccaattccgagttcaaatggccaagatatggccatttgaaatttatatgctctttaaatggatatttacgaatttcttcatttaaattttaattaaaaacccatttattgcgtcagccgagagagagggcgcgcggaccgggtccacgggagtggggcccacgcgccagcccctcggtccacggtggaccgggagcacgcggctggcggcggccggcgccgtgggtcccacgcgtcagccgcacccgcgggcgcgggcggctgacggctgggcccacttggcagccgcgagggcgcgcccgaaggcggcctcgccggcacggccgacgggagggggacgcgcccgcgccccgatggtcaccgccggcgaccaccggcgcggcggagcggcgcccgagagagcggagaggagagggaagcgaaagggacggtccacggctcaccccgagacacgaggacggcggagacgacgaacggagcggaggaacgcggcggcgcggttcgggacggcgagggcgacggtgctccggcggtcggcgggcgaaacgaaggagcggacgaggtcgacgacgacgcggcgaagccgatggaggtgacgccgagtggggaggaagtccggagcgacggcggcggcgaaccggagctcggcggcgacggcggagagagaggaagacggcgcgagcacgaatccgacggcgagagcgagcggcgagcggcggaaacggaagagcgaagcgcgggggacgattatatagcgccgggagggggagagcgcggccggagagggaggaaacgggcgcggggatctcggccgccattgaagacgccggcgacgattgcgggattcaaatcggacgaatccgagggagagagagagggaaaagagggggaaacgggagagggaatcacgggggtgatttccccctctttattgcgcgcggggacggcgggaaacggcgagattcgcggcggcggcggcgctagggcacgggcgggcggcgggcgcggcgcgaggtcggggatgacaggtgggccccacccgtcagcgagggtggcgggcgggcccgcctgtcagcggcgcgcgcgcgggggaggccgatgggccgcgggggagaggagagagagggagggagagaagtgggccgagccggcccaagaagggaaagggggggaaagaagacttttagggatttttctttttataaatcctttttaactttgtttatttcttaacaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattccttttagaaaatgatttttatttcgggatgaatttatcaggacgtgacacatatagaatcatatccaccttgggtctttggaagtccggtgatgaaatccatcccaatttcatcccatttccattcaggtacttggagaggttggagaagtccggccggtcgttggtgttctgccttgacacgctggcacacatcacatagggccacatactctgcaatttcccgcttcatgctaacccaccagtatttctcccttaagtctaagtacatctttgtactgcccgggtgaatggaataaggactttcgtgagcttcctgaagtatcagctgtttaagttctctgttatctggaacgcatacccgctttccgttccatagggttccgtgttcatcctctgtgaaaccagcggccttaccctgtttcatattcttgaggagtccatgcatgtccggatcattcttctgagcctcgcggatttgatcgagcaaggtgggcttggcttccaatgcagctaagaatccacgacccactatgcttagattcagggcttccatctgttggttaagttcgggtggaatgcctcggacgttaagagtgttgcaatggccctttcgacttagagcgtcggcaaccacgttggccttaccaggatgatagtgaattcccacatcataatccttgatgagttctaaccatctcctttgccgaagattcaggtccgactgagtgaagatgtatttcagactcttatggtcggtatagatttcacagcgattcccaatgagatagtgccgccagatttttagagcatgaactactgcggctaactccaaatcatgtgtagggtagttgccttcatgaggacgtagctggcgtgaggcataggctaccacataaccgtcctgcatgagcacgcaccccaatccttggcgcgaagcatcacaatacaccatgaagtccttgcgagtatccggcaagattaacaccggcgaggaaaccagcttttccttgagagtttgaaacgccttctcgcattgcgggctccacacaaatttctcttctttcttcaacaactgtgtcatgggtcgagcgattttggagaagttctcgatgaatctccgatagtatcctgccaaacctaagaaactgcggacttgagtaactgtcttgggttgcttccaatcggtgacggcggtcactgtttcgggatccacagcaactcctttagcagatatcacgtgccctaagaatttgacttcggacaaccagaactcacacttgctaagcttggcatacaattgatgttcccgcaactttcccaacaccagacggagatggtgttgatggtcttcctctgattgtgagtatatcagaatgtcatcaatgaaaaccacaacaaacttatccaagtattccatgaacactttgttcatcaagttcatgaagaaggcaggcgcattggtcaaaccgaacgacatcaccgtgaattcatacagcctgtatcgcgtggtgaatgcggtctttggaatatcttcttcacgaatacgtagttggtgatatccggaacggagatcaatcttggagaatacagtggcacctttgagttggtcgaacagatcatcgatccggggaagagggtacttgttcttgatggtgacttcattgagagctctgtagtcgacgcacatcctcttcgtcttgtctttcttctctacaaaaatcacaggagcaccccatggggaagtactcggacgtatataccccttttctttcaattcttccaactgtttctttacttcggctagttcatttgctgccatacggtagggtcgcttgtgcagaggagtggttcctggagcaagatctattcggaactcaatctctcgcttgggcggcataccaggtagttcttccggaaacacgtctccgaactctctgacgatggggatttctgacagttctatctgatgaagttctgaacttctgacagaggttgggggtgcaaagaaaacaaccggttgttctggccctcggtacagagtgacagtgcgtcttgcgcaatccactactccttggaattgagccaaccaattcatcccaagaatcacatccaagttcttggtgtctagcagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggaagctccagagtcgaacaaaattgtagcagggatggaatgaacgaggaacgtaccaacgatgacgtccggagttgtcagcacgtcctcggccgtcacgtgattcacacgaccccgaatgacatccttcccgccgttgttggagcggggaggcgcttggccttgctgacgccttggctttgggcatttatccgcaaagtgcccgggctcgaagcagttgaagcacagacgctgcggacctgaagcgtccctgcggccttgaccaggctgcaccgttggcgtaagaggacggggcgcacgagtcccttgctgattctgctgctgctgcggctgtgggacgcgcaccacgaattgaggtcgaggcgcggagcgaggttgctgctgctgttgttgctgctgcgaggaggatccccctggatagggattggtgtagcgaaccctctggttagcaccctgttgattgcggaaattcgccaagcggcgcttgtgcgattccagctccttgtgcttggcttccaagcggatgctcttgtccaccaatcgttgaaaatccggatagtccccagagactaggcggacggacagctcggggtccattcctgccaggaacttctcttgcttctcctcatcttcccgcacatcctctggggcgtaacgggccaagttgttgaactcgtgcaaatactccatcacggagcggttgccttgcttcaactctcggaattcccttttcttaagagccacgactccagcgggcacatgggttctccggaaagcggcggtgaagcgagcccaagtaataggttgctcccctggctgcgtagcctggaaatggtcccaccatagagatgcgggtccccgcagctggtgggcggcgaagacgactttctcctcatcgctgcactgcaccgtgtctaacttcttccccacggcatgcaaccaatccaaagcatccacggggttgttggagctggagaaggtaggtgggcggatgcggaggaactcggcgagtttagagtgttggggaggtggtggtggagcattctgttgtggcggattttggaggtggtggaggaaagcggtcatcatgttggcttgctgggcgaggatttgggtgagaatggcattggtgtctggtggtggtggtggaggcggaggaggaggtggaggtggattgccttggtggttgtggttgctgccttcaggttgattgccatcaccggtagcagcgtttctcctggtcgtcaccatctgaaaaccccacacagaaccagcaaacagagaaggagctaacaattaaaactaaccacccacgactaccattattcttacatttattactgctattaaattggttcattaatgttcaagttgcttaggcgaataaaataagacaggctccgacatagttatgccacacaccggcataaccatgtcccacacgactcaacaagaagacaaacgagaaaaacacacgcgcaagcctactaactgctcgtctactgctgcgacgggccaggacggaaggtgagcaacagcgcaccctccgtgctaccaacgccggaaggcttccccctcctggggaaccacgggcgcaggctcggcacgaggggtctcgacgaagcaagtccacgccagggactgacgaacaagctcgggcctggaggtgctcttgcgggcggtgatcttctggctgcgtgtaacgtcccgccttcccccaggccgggcccgcttacatctgatagctttcacaggtcatagactgccctcacagaccaacacatgtcttttctgcacactttgtcctcactcgtgtgcaccgggaagaatttcccggtcggtcacccatcccaaattgctccaggccaagcatgcttaaccttggagttctttggagattggcttccggaaaagaagttgcaacttgttgatatgaatattctattaatcctattaagccctagaccgggatgttacaccctcacccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacatgcgcccgtgaaaccgcgagagtcggctctgataccattttgtaacgtcccgccttcccccaggccgggcccgcttacatctgatagctttcacaggtcatagactgccctcacagaccaacacatgtcttttctgcacactttgtcctcactcgtgtgcaccgggaagaatttcccggtcggtcacccatcccaaattgctccaggccaagcatgcttaaccttggagttctttggagattggcttccggaaaagaagttgcaacttgttgatatgaatattctattaatcctattaagccctagaccgggatgttacaccacgcttgtcgcgaccgggaaaattgccttttcccgaacgctagtgtattaatccccgtcccaggaaaagccggggtacaccacacaaacatgatataaaagacacatttttattatatcgataatatttacattattacaaaggcacttaaggcctgacaatcaaaaataaacagcaacggactagcgggcctacggctccatcttcacaggcgctcaactggggtataagccaggactccacctaagacatcttctccaacgcttctcttactgaagaggggaaagattgagcaagaatgagtacaaccacagtactcagcaagccacaccggcagatgcatgattaatgcaagggggtacaaggggtaataatataggggttaagttttgcagtaaacagcatttaaaagtcacttagttgcccaaagccattttataaggacgatcctagagctacacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttaggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcctgcctacggccggaacccccgggacaggcaggcaggactgagccccaagcagcagggcaccaaccctctgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaaccacctaatgttgtcctattaaattgcgaagcatctacctaaaatcatactagtggtaccatgagtagagtgtccactatttagggttttgtttatcctagggtgaacaaggtaataataacaatagcaataataatgtcataacaaaggtaaataggcatggctaaataaaacagtgataacgcgggaatttaaataaagcgataatgcaataatttaagtcaaaataattttataaactgggattcaatatgttcaaggatgatgtgacttgccttgctcgctttcccaaacgccggcttcaacttccacgaagagcggatcttccgaagctgcagcgtctacacgaccaacggaaaagaaaaggcttttactctactaaactccatataacaagcagaaacaaagcacaaaaatgggttcttggcttcttaaggaaaaattagagacttgaacggtccaattccgagttcaaatggccaagatatggccatttgaagtttatatgctctttaaatggatatttacgaatttcttcatttaaattttaattaaaaaaacggatttattgcgtcagccgggagagagggcgcgcggaccgggtccacgggagtggggcccacgcgtcagcctctcggtccacggtggaccgggtgcacgcggctggcgctgaccggcgccgtgggtcccgcgcgtcagccgcacccgcgggcgcgggcggctgacggccgggccccacctggcagccgcggggcgcgcccgaaggcggcctcgccggcacggccgacgggaggcggcgcacccgcgcaccgatggtcgccgccggcgaccaacggcgcggcggagcagcacccgagagagaggagggaagggggaagtgaacggagcggtccacggctcaccccaggtcgacgaggatggcggaaacgacgaccggagcggaggaagacggcggcgcggctcggggtgacgaggacggcggcgttccggcggtcggcgagcgaagcggaggggtggacggggtcgacggggacgcggcgaagccgacggaggtggcgccgagtcgggaggaggtccggagcgacggcggcggcgaaccggagctcggcggcgacggcggagagaaggtgcgacggtgcgggcttgattccgacggggagagcgagcggcgagcggcggaaacggaggagagaggcacggggaacaattatatagcgtcgggagtgggagagagcggccggaggagaaggaaacggccgcggagatctcggccgccattgatgcgccggcgacgattacgggattgaatccggacgaatccgagggagagagagagggaaaagcagggggaaacggagagggaatcacggggagtgatttccccctctttatggcgcgcggggatggcgggatgcggcggattcggcggcggcggcggcgctagggcacgggcgggcggcgggcgcggcgggaggacaggaatgacaggtgggccccacccgtcagcgagggcggcgggcgggcccgcctgtcagcggcgcgcgcgcggggaggaggccgatgggccgcgggggagaggagagagagggagggaattgggccgagccggcccaagaagggaaggggggaaaagaagacttttagggtttttctttttataaaacctttttaactttgtttatttcttctcaattattatttgtgctctgaaaattccactaaaatttgagggctccttttagaccaaggagaatttaacaaaaattctccgggccacattcgaatttttcttgtacgtattttagtgtttgccaatttcttttcgaattttaattaattctattattccttttagaaaatgatttttatttcgggatgaatttatcaggacgtgacactgcggcagacgcggcgacgcttggggcggcagatctctccctgggcgatcttgagctgatgcagctgcgcctccactgcgtcgaggtccttcttgagctgcaggttctcctgacgcagctccaggatcttcatgttgttctcgaccatcccgcggcgcaccatctgatggaagtcgatacgagccgcgtcgtacgcctccaccatgcgcgccaggtgcacgatggtagcgtcatcctccgagctagcatcccggaaggtggcgtggtcgcaggctcctccgcgacgagggtggtagcgatagggcgagtgctgcaactcatccgggtagcgctggtgaagggtgccgatggcgaggagagcggcgttctggcaagcggcggggaaggagtctccacccgcggtgactgccagcgaagtccgctcgggagagccggagaggatcactgcggtgacctcccaaccagcgtggggctccgcgtcgtctccctcctgatccggaagcgtcctggcctggtagtccactccgtgtggataccctaagaccacgcacatgccccgcagctccaagacgaagccagtcatgtccaaaccacgacgggtgacgctgccggccatctacaaacaaaaacaaaaagaaaagcaagatttcaaaggtcagattttgatgataagtgaagcagcaagacagagagagactagacagttttcacaaataacaaaggatttttatttttgaaaatattgctaaggcttgggatctacggctcgtcctagggtcaaggatggctctgataccaacttgtcacgaccagaaataacccaacgggcgttcctgacgtgcgtgcattaatccttgtcccaggaggcaaggtacaccaaaagttgatacaaatcagagtttaacaagcggaagcgtaaatagttaacttattacatgggcagcgaaggcccagcacacacagagacaaacgaaaaacagcggaagactagggcgacgaccacaggcgcttgacggcaggcacgagctagacaccaaagccttcatcttcaaggagctcctcttctgggcttgggaaaaaattgagcaagactgagtacaaccaccgtactcaacaagacacacccacaaatgcagaataaatgcaagggagtacaagggaattataacataaagggttcgggttgcagtaaacagcatttaaagacatttagttgctcagggctattttgtaaacactatcttagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggcggggtgaacccaatttcacaattcaccaacaattccacagtgtccaggtgatatgaatatttcccaagtctaaagttataaaaccacctaatgttgcctaattaacttgcgaagcatctacctaaattttaaactagggataccacgagtagagtgtccactagttgaggttttgtttaagctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatattcaaagatgatgtgacttgccttgctcgctttcccaaccgacggcttcgacttccacgaagagcggatcttccgaagctgcagcgtctacacgaccaacggaaaagaaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaaccgggtttattgcgtcagccgagggagagggcgcgcggaccgggtccacgggagtggggcccacgcgtcagcctctcggtccacggtggaccgggcgcacgcggctgacggcggccggcgccgtgggtcccacgcgtcagccgcacccgcgggcgcgggcggctgacggccgggcccacttggcagccgcgagggcgcgcccgaaggcagcctcgccggcacggccgacgggagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaggaaggcggcggcgcggttcgggacgacgaggacgacggcgctccgacggtcggcgagcgaaacggaggagcggacggggtcgacgacgacgcggcgaagccgaaggaggcgacgccgaggggggaggaagtccggagcgacggcggcggcgaaccggaactcgtcggcgacggcggagagagaggaaagcggcgcgagcgcgattccgacggtgagagcgagcggcgaacggcggaaacggaggagagaggcacggggaacaattaaatagcgtcgggagagagggaaagcggccggaggagatggaaaccggcgcggagatctcggccaccattgattgcgccggcgaactttgcgggcacaaaatcggacgaatccgagggagagagagaggggaaagtgggggaatcgggagagggaatcgcggggagtaattccccccactttaatgcgcgcggggacggcgggatgcggcggattcggcggcggcggcggcgctagggcacgggcgggcggcgggcgcggcgcgaggaaggcgatgacaggtgggccccacccgtcagcgagggcggcgggcgggcccgcctgtcagcggcgcgcgcgcggggaggagccgatgggccggaggagaggagagagagggagggaagagaagtgggccgagccggcccaagaaaggaagggggggaaagaggacttcttttagggttttttctttttataaaccttttcaactttgtttatttcttctcaattattatttgtgctctgaaaattccactaaaatttatttacgcattttaggcttttaggaaatatacaaaaatcctccaagccttatttgacttttatctttgcacattttaattgttggaggctttcacatgaattttaattattctttgcacaatttcgaggatgtattttagagtcgatttgggacgtgacaagggattatactggttcaggccccttgataggtaatagctctaatccagttggtatgggattatataatggaaaccacagattacaaagggaatagcagaactcgatgataccgacgagaccctagtcgagttggttcgactagatcacccggtgacttggctcctataggctctgacttcgtaggctgtggtggttatgttggcggtaagattcgatgccttaggtcctcccgggggtcccttttataccgcgggtcagttggtctccaagtagaactcagagacatcggaccccacacgatacagtaacgacccagttctgtccgagtaggactccttccatccgtggactccgtttctattacgtgatgaatttccttaacgtgtacaggaaacatccgtatacgcgtaggtataccatatcagtatacggcatacatccaagggtagagagtataccttaactgtaaccctgacaaatggttttagtcaattccataatttgtacttattaaatttaatatttatatagactcatgtttttacccccacaaacggatttacttctattgtcgtgacaagttactttccttttgttttaagttacttctatatatgcaaattacttttcagctttattgaatttacttttatacgtctaagaagtaatttaatgaaatctaaaggtaatttatatatattgtaaaaagtattatgtaagttttcattaaaaaaatataatcatgtgatatcttgttataaagatttaattgttatgaacacaacagtgtaatcggatcgtagatcagatgagtaatttaagagaaaaatttatttgaagcatagttggtaggaaaatatttctctacttatttaagtagattcttccggtcaatgccccgtcgctagcagtggcagttccaatgggcggttcaggtgatccctggaccaccctagaattttgcccatgaggacaccccctgagctgtgctagggttagggagaggcacagacaaccgccagccatagtcgcacgcattgctggctggcagctgcctcctttgtcttcgcgtcccgactccgactccgactccaccttcaccttaggcttggcacgatggtcccgacacatcgcctccccggttcccgcctttgcctccgcgtcggcatgccacctccccatctcctgcctccctcctcaagtcctcctcggcaccacccgactccgcctccgcctcggcgccgcctctatgcctcctccagtcccccacccctgtcgggcagcgccggtacgccagcgggaggcggcaagcgcctataggccggctgcctaggcgcttgggcccaggtgcccagtccggcggtcgcccccaccccttggaaagggaagaaagggaggcgttgaagcgacgtcgccattctgccggcggccggtgtcaggtcccctccctctccagctctcctgctgcccgacaaagttcaaaggtcagtagacatttattgttggctttttgcaatgttgccctatgcagtagtgagtagacagtagtagtgttaggg

SEQ ID NO: 59319 - DNA, 2309 bp, Oryza sativa
aaatcgttcaaaggaggtcccatggcagtatcgactcaatttttgcccggttttactgacgtggcatcctagttaacaaaaaaataaaaataaataaatatgtgggacccacacgtaagtgaaaaaaatatggggtcgacaatcctaatcagcaatctcctttttctccctttttctcttctgtttcgttttttgggggagcggcagcgggtatactgcctcgggaccttttttaaaggggcaattttgtttctaaccctatttgatgtctaatattgattttacccctactttttaggattttcatttttaccctcacttttttgaactgaatgcttgttttgcccctactttggatggtgaagttaatagtgttaagtaattgacaaaatggcatttataccctctcatgtatgttcattaataatgtttttgtccccattttatacatgtagctttagaactttatttttgggagtatatttaaaattagatgacccgcattgactaatataacaatttggacaaattctgaatttgatggaattttgacaaaatttcagcattttgatagaacttaaacaacattttaacaacattttctaaaatgtaattatctgttcctttagatactagtcaatgtgcttcatttaattttaaatatactcacaaaaataaagttataaagctacatgcataaaatggggacaaaaacataattaatgaacatacatgagagggtataaatgtcattttgtcaattacttaacaccgttaacttcacctctaaagtaggggcaaaacaagcgttcagttcaaaaaagtaaaacgaaaaaagtaggggtaaaatcaatattagacatcaaaataggggcagaaacgaaattgtcccttttttaaatggttttacatagtttagggatacacatttctagttctatggttaagggacctcaaagaatgttggtgttaagttgaggtatctccgttgaacttattccctctaagaaaaaccgaacccatttccagacggaatgagctcatctcaggtcccttaacttgtcaacgaatccaattttcgtccttcaactaaaaaaaccatacaacgggtccctcaactgtcaaaaccagtgcagatgaggtccctcggcggttttgagagcggttttggctgacgtggcgtatacgtggcaaatttgacttggtcttcatatgatgtggcattgacgtggcaattatgtggcaaatcaatcccaaaaacaaaaaaaaacttcgtgggacccacatgtctgtctcacacacaaattaacaaaaaaaggtggggcccacgtgggccccacaagtccctcttctcacttcctctctcccctgtttctccctctccctgctagctatggagcgacggctgactccgggcgtgcgcgcctggtctctccacctccggaatatgaacgacgcggcggagctgtccgtggggaccgcgtcggcaacggacacggcgtcgtggtgcttcgcaatggcactgatcaggcttgtgttgtgcacgctccacgctgaggccgtggtccgtggaggtccgcggccggcggctaggcggcgcggcggtgaagccgtgcgaggaggtgtacgtcgtcggggaagacgagatgttgcacaccatcagcctcactcctcccgtcatccctctcccttctctctcttcttccctctcctccctctctctcttcttcgcggggagcgccggaacggacgggctggtgggcagtggagcagcagccggcgacctcggcgaggcggcgccctcgtcgccgccttccctctccggcgatggccttcacgcggcacctggaccagtagccagtaacgacaacgacgacatggttggctcgtgcaactgcctgtggctcaagcgacatccccttgtctgcggcagcatcatcgtgatcaacccggtcaccggcgagtccctccatatcccgtcgccgccgttggcgaccagccgcagccacgcgggtatgatcagcttcggctaccattcgacgactggcaagtacaagatcgtccatttccttccaatggcgggctggtggatgaagtcacgctggggggcaccgcatcgtcgtcgtcccctcccgccatggcggcggcaacggtgatggggtggtgaatatcctcacgctgggagacgacaccaccgccgccggcggcgcgcggtgggggcgtcgccgtggagcctgtgcgtcgcctggggcgttgtcagcgtcaacggcgccacgtactgggtgcccgagggcaagtagatcatgtcg

SEQ ID NO: 59320 - DNA, 2303 bp, Oryza sativa
cgtgaaattttttagggtgattttgatttactgtatgcaagattaatgtcatgccatcgattattctccacaataaaagaatgagattgtggtctctttttccctttgcataatatgcgatagtgggtagttctgtagttctatcgtataaattgtttatacatatacgttagtttggactattattttttgtcataattatatgtttattgaatcatgtttgatatttacattatataatgagagaggggcattgtataatttaacaactaattatagagtgtatgtaattcaatgtgtgagatatggccttatagtatttaattaacttcttataaaatgctgcatataagagataaggtattgttttatagccccaccgtgcgccccgtgttcaaacgaacgtggggcccagcagaaaagggtatctatccctctcgagtgtcctgtgactcctgtccagctaaccagccactcatctgctgctgatctgcttgctattcgagggggaagaaaaaactcagctgctgctgctgctagcctacggatgattggatgaagtatcctctcagtagtagtagtagtagtaatagattacggcattcgcatgtccaaattggtagttttaaatattgtctcatctaattttaggttggttctttctagaatggaatgattcgttatactgggtaggatcccatctatttttagatttgttttttcgaaacggaggggtatgtcgtaggtcacttatacgtgggtcagtaaaaatatgatttttatataccagttatctctctactattataaaaattaaagatatttttaccgttactttggtagatcattcgtatttgagtcggttgttaagttcgttcgtttttggaaatatagatccgtgtttgagtccgcttttaagtctgatcacttttgaaaatacaaaaggagtcatataagaaatctctttaaaaaaaactcgcacactaacttgggatgcttttggaaatacagaaggagtcgtataagaaatactttaaaaaaaaactcgcatgctaacttgagatgagagatagactcctaattgtagctcatagttttctaaaagaaatatccaagcaaattcccacaataattttcactctaactgaaccgtataataataataataataataataataataataataataataataataataataataataataataataataataagactaaaatagccttcatctgttgcaacacatgggcattttttctagtaaaataaaaaaaagtatcatctagttgttgttaccgctggtttttcagtaaattttaagttttagtagtaggttaataggattaaaagtatacttttcacttttctttacttagaaaaatggcaactaattgactcttcaagtttgtctaggccaaatattactagcaagtaggagtataggatatattcttggaagatgacgctacctaaagagaagcaaactagctaggcgctaaataattatctcacggaatcaggaatttcataccgaacatgcttatcatgaaccactaaggttttagtattttgacttcttgtaatatttatgtgacgctcgtgtagagaaaaatattgacgattaaggttttagtattaagttatgtactccctccgtttcaaaatgtttgacaccgttgactttttaattcgtgtttgaccattcgccttattcaaaaattttaagtaattatttattcttttcatatcatttgatttatcgttaaatatactttcatgtacacatatagttttacatatttcataatttttttttgaataagacgaatggtcaaacatgtgctaaaaagttaacggtgtcaaatattttgaaacggagggagtatgacataggacctagaacctaaaggagatatggaggcttccgaagatagtgaatactagtatttagtatttgtcgctctcatgtaactgtactagaaaacacgtgtttgagatttttttttccttggaacagcccagtcaaagcttctcgaggcattttgttctggttaatattatcccacagtacattactagcggaattttcccatctatttttacaccgagatattctttttttttgaatttgatacatgcaattttgcactggacacaattatcctagattatgtttctatacatatatacatttgtattggcgctgttctacttaatttcactcttgtgcagtcaacacacagtgtgttgtgtctgccaggggcggatccaatatgggtgcagggggg

SEQ ID NO: 59321 - DNA, 4340 bp, Oryza sativa
aaaaacattattaatgaacatacatgagagggtataaatgccattttgtcaattacttaacactattaacttcaccatccaaagtaggggcaaaacaagcattcagttcaaaaaagtgagggtaaaaatgaaaatcctaaaaagtaggggtaaaatcaatattagacatcaaatagggttagaaacaaaattgcccctttaaaaaaggtcccgaggcagtatacccgctgccgctcccccaaaaaacgaaacagaagagaaaaagggagaaaaaggagattgctgattaggattgtcgaccccatatttttttcacttacgtgtgggtcccacatatttatttatttttatttttttgttaactaggatgccacgtcagtaaaaccgggcaaaaattgagtcgatactgccatgggacctcctttgaacgatttgaataagtttaggggtaaacatttctggttttacaggtaaggaacctcaaaaaatctcgctgttaagttgagagatatccggtgaacttattccttcttagagcgagagaggtcagctatgttaccccgatatgaggatacggatacggatacggatacgcgatacggggataccgggatacggctattttcgaaaaacatggatacgtggatacgtctatatatacataataaattaaaaagaaacaatgcactcctcaaagaaaatgggagaattgattgccaataattgaaagataactaatagagcaatacatagatacattaaagcttagaattgtatagctttgaccagacctcatgcagtagtactggatcttcaaaaagtcacttatggctttgtagtcttactttacggtgtccaatatcacaaactgatgttctccttccccggccccaacaaatcgagatccaggatgccctgaaccgtcaatacacgatacttacctcacttgaatgaagcaatccctaaccgcgagcagaggtgtgtgctgcgtgcgctaagctaggggggtgcggcatgcggcggcggcggcggctccgcggggcatggcgacgatgcggcgcctcggcggcgtgcggcagcagtagtaggcccgcattgcaaagtggtggctctacctttgcctcgctccagaacgacgacgccgttgggtaggaaaagatggacgcggcgaggattggtatcccgtgagaagttaggattagatcgtaccttgtatccatgcgtatcagagaagtatccctaattatttcatttttctgaaaatcagaaaaatagaggatacgtacgggcgtatcggagcgtatccgaatacgtatccgtattcctttacgtatccgatacggatacgctcccagccgtatcagggtatcctaggaggtcagtattgcagcttttgctcaacatatgcttgaggaattggagtagttagttcaacccaaatctgcgtgacgtctcgttccttccttaaaagaataatcttgtttagaagtaaagcgttttagtattagaaaggggccaaaatgttcgcttaacgagaggggcttattttgctattgtagtgttgtgcacagcaaggtttcgtaagtacaatgtacatatattaacaacctgtaatgttgttccccatcacgcaataccatactccgtattagattagtgctgaaccgggaagccaatgaagcctagttttacacggtaatcaaccaatatcctaaatggtttgctgatatgtccattgctcatatgcacgcttagcttatatcctagcaatatttctggtctagactaacatcataacgtgatttgtgtgcgcagccaaaaaaaaaaagagattgaaaagaaatcaccgtcctgtattgtgtggttaacaacaaaagcattcacctgtcaccccctcccgcactcgccgtcgccatcgttcgtggacgcactcccccactgaatttttttgagaattaatattatttttatggaaaatcgcaaaagtagtggccaaccggggaaaatcgcgaaagtaggtccctgtcgaacgggtgcaattcgatagggcacctatcgaacgacgggcagttgacagagccctgtcgaacggctggcgttcgacacgctcgcctgtcgaacggagggagttcgacagggcccaccaccccgcgccgccaggcctgtcgaaccgggggcgttcgacaggtccctccaccgaccctgtcgaacaatgggcattcgacaggccggtttaaaaccccgtctccccagcccgcgatgcttgttcgatttgtttgaggaccacatcgccagccgccgtcgagagtcgccacatcgtcgccgtgagcgccggagggagcgaggggaggggatagcaggccggagacgaggccgaggaggcgtcggccgggaggaaagggttggcgatgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaatatgtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtacaaacagacgatgagtacggttcggcgtcgacgcatcacggagtgcctgcttactcccctcgcacagcattcattgaggacttcttttccactgatcctccccaggaggaagtagggatggattactggcacgcagcacctcaggtcacacagccgacgcaggagacggaggccggtcaggggccagacgtgacaccacagcagacagctagagataggcacccccctgataatttgacatatcccactgagcagattaggcgtaggaagaagggaggacctagcaagcgtgcgaagggcactgatcgtccttgacttatctatttgtattaagcttttagttatttctgttctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcacatacatataacattacaaaaatattttcctttcttacacactaaaataaattacatattattaaaaaaaataacttattacaaataaatggagaacgcgaccctgtcgaactgcggcagttcgacagcccagcctatcgaacgggggctgttcgacagccctgcctgtcgaacgggggctgttcgagtcctgtcgaacggcagccttccgatctcctcgccagtcgcgctatggccgttcgataggtgccctatcgaactgcacccgttcgacagagacctattttcgcgattttccccggttgaccactacttttgcgattttccataaaaataatattaattctcaaaaaaa

SEQ ID NO: 59322 - DNA, 3261 bp, Oryza sativa
taaagaaatccaagaaataaactagtagccaaaaactagaaaaacgagtttctccggattgtcaccatcttctaagaatctctagctcccaaaacatgtagttgaggaacataaatacagagcacgtcaagactggaacaaacatgaacatccagattaagcaccaagtataactgggtatatatcgatctgttatctgtatgacttaaggcacggtacaacgacaaggtaacatcatagcgaactagctatgccataagtttctccttttggagtgacgaacagctacatatatcaaccatgttcctgaaggtaaccgagactatatatataagcggccactacagttctcagaagtatccagcattttgggctgtcctgatgatctgaaagagagctgcacaaagaaaagagtagaaaacacaatgacttggtaagatgttcataaagttatgatgaaaaagatggaaactactgccaaggctgtaatgaagactgaaatagttgcaggatttttcatgcaaggagttctattttaccaacattagactgtctgttccatttgaatccttaactagggtaacatcaaaccttcctcttctattttccaaagtcttaaggagaagcatatatttttttgagaagtttataagcatataaggatttattgcctggcaacagattagtagctgatgtccatgggtgtggtagctgcagcagttaacaaccatatctggagtaaaccatgagactatttttggaattaatcagagcaggaatctagcttcttattctttgaaaaggatttgactaatctaagatcaaaacaggaaacacatagatactttcccacaaagtgataacatcctaaagcaaaactaatgatgtgtactacagctacccccatacacgactactgataatagtactagattagcactttcgcaatttagcacagtttagtcctggagagagcacagaagcaatacccataaaaacaagaactaagggtgaaaatagttaaaatctatttaggttggtaaaggcattctgagttatgaagagtatgagtgaagataaatagctcaaccattcaccacaaatatataaaaaaagaatgtaacttacatgaaccaacaaccacaaagacgaaaaatccaagcacaatgggtccaacaggataatcatttcctttcttgactgtctcaggaacagaacccctcttggtgacgttcttctcaaaccgtgccactttcctatctgagagacgccttgaggtagtctgtttcatcatcagcaaataatatcagaagatatcataaaagaacttgtttgaagaaaggaaagaaatatgcagtgtatttggacagaatcccaaggaaatgacattcatgatgccagtaaattcatacagaaactttcatctattcaggaaaaaaaatgttactcaagatgcaaagcacaatggtgccatcaccagctaactgatgcctgctaccaaatatttctgacaacatgttgatctgtccgacttgcatgttaagggagtaatttttacattaccccctagaaccagtaagcagggtttgaaagttgatcataactaaatccatcgaaattataaaatcaagcgtattgggtgagttatatgtttttgtgcctttattatatgtattagatgatactcaatggcacgtgataatgctgacaagaaaattagaaatgctttactatatcataaaaatagtaatatcctctgctcgatttggtggaccctgattccaaactactctctctgtcccataaaaaaaccaacctagtactggatgtcatcctagtactacgaatctggacatacctctatccagattcatcgtactagaatatgtcacatccagtcctagattcgtttttttcgggacagagccacagagggagtaatccctaatcttcacatcttatcctggaacacattttcgaatcaaagcataggagtcgaaaacaataaaaccatacattaaaatatatgctaaattgaagttacgcaggatcggaagcgttgtagtgtgctagacgacaaatgcaaaattgcatgggtcaattaatactcttcgtcgacatttcaaatgcgttataaagtaatctatatactaccaaatatgatggctagcccacgtaaatgcataaccaggttttctaggtctttgataggccaatccagaatatgcggttacatgaagtgatgtaatgcaagacaactagtgaatgttcgctctcggatcaggaaaatcaatctctgcgtcactgttattctaaacctgacattagttagtcagcaacaaaacttgataaacttgttaccagatcctctaaatcttgccaaaggataatattgaagcatagcctaaaaataaacatatcttttgttacgaaatgaacggtttaaactacaggtaggcacgatcatcatagaagtacactacactatctacatacaggagaaatatgaattcaaaagcaaacagatgtgcacagccacggatcttcctgcgaagattcagaagaagaggaacagaaacaagtaaaccagaaatcaacatttcgtcggttctatttcacaaaatcatcgccaggacaggggcggatccaacttgggacacccaaacttttcggggaacaaacaaactgttacttgtattaaggttaaggcactgaaattaagggaagagcttcttccagatctagaagagaagctagggttaacgaacgaacacaagcaaattccagaaccgatgggagagagagatgaatcagaaaaaggatgtgatgctcaccatgatcctctcccctgctctgctcgccagatggagatcgccgccactcccctgttcagccgcgactcgtcttggcggcgcaaggaggaggagacgagaggttttctttctgttacgccacaaagggaaggggaagacactcggagaaaaggggaaatttaactatttgccacttttaggtttaccaattatccaaatacccctcttatatttgcccttattttcttgcccctcttagcttgtagcttcttaattacttatttgccacttttgcccatgtggcatgccaacgtggcagcgcggtgcaaaattctccgtgggacccactagtcagtagcacaactgtccccttaccctctgtctttgatcagccccgccgttcccttcattgccggtgaccctctatttcctggcaggtggcagcgaa

SEQ ID NO: 59323 - DNA, 9980 bp, Oryza sativa
tgcgtcgcctggggcgttgtcagcgtcaacggcgccacgtactgggtgaccgagggcaagtagatcatgtcgttcgacctcgagcatgagcgcatcgaggccgtcgcattgctgccgacgatgagcaagtgctgcttgccggtgtccatggagaaggaggacgcctgctgccagctgaccacccccgccacaccggcccccgctgcggcacccaccaccccgcgcctaccaccaccacacccgccggcgcgcctaccaccccggctccggccaccggggcacctcctctcccccggttgaggcttccgtcgccggcgctgttgtccaccgtcttggtccagctgccgcgtgaaggccatcgccgaagagggaaggcggcagcaagggcgccgcctcgctgaggtcgccggctgctgctccgcccgccactcgcccgtccgctccggcgctcccgggaagaagagagagagtgagggcctgtttggcacagctccagctccagcttcaccccttctggagctggagctcagccaaacagtttcggctctaccaaaactgggagtggagctgggtggagctctctcacaaaatgaactagagttgtggagctgggtttaggcagctccacaactccactccagactcaactcctggagttaaatttaggagttggagctgtaccaaacaggccctgagagggaaagggaagaagagagagaagggagagggatgtggggcccacttgggccccaacatttctaattttctttttgtgtaactaacatgtgggcccacgatttttattattttttctgtgatagaattgccacgaaagcgccacatcaatgccacgcgtaacgaagaccgagtcaaattaaccacgtggacgccacgtcagccaaaactgctctctaaaccgccgagggaccttatctttaccagttttgatagatgagggacctactgtatctggttttctggctgaatgacgaaaatcggattcgttgacgagttaagggacctcagatgaacttattcctttccagacttcagatccagatccaagttccaacccaacagctggcctattttcccaaggccgtcaaagctcgtaagcccaaaaggccacaagtctacgaaactaggccttttaccccgatctgacattccatcccatttggcccatgttgtcccagcccacagctccacacgtatgcaggcatgaaccaaacatttctccgggtacgcctcggtctcccgctgacaaattgcactattgcagggcatatctcctcacttgttcatctccagctctcctggcacactccaagcacaaccttctttcccgttctgcatccttccatcctcgccacctgcgatgatgggctcgggccgttccttgatggcgcctcgcctccccgcctcctcctattcctcgctgctggcgccgacgtcgtggtcgacgccggccgcgcgttctccgccgggggccgcgtctacgagaggagtgcagcgagctggaggagctgagcgccagcgtgcactggacgcatgtaccaccgaggcgaacggcggccgacgtcgcgttccgcgtgtccgcgctggcgatgatgaccagaacggcaccaacgtttttttctgcacttctggtcaggttgcaggatgccgaattgccgatgcccattgacgatgctcagagcaagtttaataatataacccactactagctaattcatacaatagttgcttattatactattaatacatggtctcacttgtcatacacacattacattttagagttcgtgctgcagctgggctacagatatgtagtctgctgctcttctctctctttctttattattttaaaatatgtttatagctggtttatagccttctattttacctattttacctgctctcagaatggtgaccgtgtagccgacggaccaccagtacaagttccagtcgaagcgaaccttaacggtcgtctttggtggcatcagcagggcagaaacccgagacagagagacagaaacaccacgttttagcacgtaaacgcaataacgaagttgctgaattttgtgctctcagttctcacaggtagcatcactggactgtctcattcaccgagtagctatctcaaaagcatcgatattgtggagtactgaagagttgctagggggaaatgtcaatacgcgcgattcagagcacgactgtttccgaaggtcaggccgacccccccatccggcggctccgattagtggtgaaaacggtacgaaaatttttaagattttcggctgccgtttccaatgaccatttcagtcagtattggttaccgtccgtgttagaaatggcaacggtaatatcttccggaaataggatgaaggtttttctgaccgttttatcgataaccgtatttgtatggtaattttcgtcaaaattctaaaagttccatagcgactcaaccaatcaaacatatcggaagcctatgaatgaaggaagcctagcaggtttgtagcacattagaaaggggaagtgaccaaaggaaaacgctgttaacgctagggcatggcatgtggacgttgctgaactttggtctactcaacttatcggtgttgagatattgttaaattttgtttatattgttgatcaaacttattattatatcattaattatcatataacggtgttatgtgaagtgtgatgatgcaagaatgaagttataaagtcatcttcgtacataattaaatgtgtattaggccacacttttctgattctgacatgaattttcgacttccgaccaatgtcggttgattccgtttcgacggtcccatttccgatatactgatatcgttactgtttttgaatcttcgaatctactgttccgattctgttttcgagaaaaaaatgaaaatgaaaatagtatatggtttttctgaccgctctcatccctgctccgattatgtaaccacagcattggcattttggcaggcgccatggagatagaaccaagcgatggaaacaccatcgtttacctcgccagtcgccagtatgacgcattgacgccgacggaacagagcgccccaagcccccccaacccacagcattcagaactccatggatgggtttgtccttgagattttcaccttgaccgtttgcttcaagaagagtggaaaaggctccaaccaaggtggctccatggatggcacgtcaccttctacttttcaatgtacgccgtgtttagcttcaaagtttttcttcaaacttccaacttttctatcacatccttctaattttaaccaaacttccaattttaatgtgaactaaacacagccgtattctaacaatcctgattattttttaaagtataataatctgcatctgttattatgtgtatgtgcaatttcagtccagtttctcgtatgtttggtctattgtgatcaaacggatatggcttcctatgtagacaaggaacagtacctcaaagcaatcgaggcttgtttggatcaatgccaatacctatcctcacaaaaaacttacgcaggggcaatgtttggaagttaccaaaattttgataattgtctggactaagatccatacaaatcattggttgaaatagactggtagctgcgcttggcacaagagcaagtcttatggaaaaggtagatttcacccctaattttattcatgtagactattcatcaattaaaagatagcatatacaataaatcacacatatattaattgtagtgcactaaccctaatagttttattttatttgtttgatcaatcttctcttccttttttttcccttttttattataatttatgtgaaggttaccccttataggaggggtgactatttctctcttctcttctctccagctcatcatacgagtgtatgtggcatcttggagtaaatgtttagatgcccatagcacttgctctaggcccattcatagcgcctcctactcataagaggagccccggaaagccatgtaggctagggctacgggtctaaattttgagttctttacgatgcaagtggctctaggagtggctataattctatatttcagctccccaacatcttttgttttagttctcattttttttcaatttgtatggaggtccaaaatttacactaaacaccctaaaatctaaaaaaaattatattaaaacccctctctcccttatcctcacccccctccccggcatgcccacctccttcggttaccacgagcccatggcgccctcctctcctctcctcatgtcgcggcggtagtcaaggagattgggggcacgatggcggtcgaggaggctgaggcggcgacgaagccaccaagcggacgatgacaacaagctcaggggtgcgtgacccctcccgaccgacgatgaggagatggagcccctcagaaggcgacgacctcaacaacgacggcatgggagcttggccaccaccgtcatcacctcccctcttaggcatcaaggaggagcgggatccgacctagatagtgccacctggatctagcccagcgctaggtggcagcgtggcatgtgaggcagcgcagctcggtggacagtgtgtccggtgagcttcagccagcaacgcggattgaagtggagaggacggtggggaagaagaagaagagaaaggggtcgacgtggacaagctcaaactctctcctcgccgacggtgtcaagctcgaagtgaggccataggcagggcgatgccttccatagtggttgtagcttcgccctccgaacgacctcgctctgactcttctgacaaggttcatgcgttcttagcaagaacgatgagccttgcaggggcatcgtggagccacatcaaggatggggcgtggtaaggaaattgccacatccttacattgtgaatggcttaatcatatggagaggaaagtcacttgttttccgcactcacgttttccgaactactaaacggtatgtttttttataaaaaaaaactatataaaaggtgcttaaaataatattaattaaaatttcaaatttaaaataattaatactcaattaatcgtgtgctaatggtttagcgtgttttatgtattttcttaatcttatacaatcattctctctccaacacttcctatttagtccttttgggatatgctaacagaatctgtgttttttttcaagtacaattcctcttgtattcgtactaagggagcattcgttttggaagaattttaacacataggaatagggaaggtggaggaataggaatgtatgcacacttcgatccatagaaattttcttagaggtttgagtagatggaaaatttccacgaaaaattttcgttggttttcctatacatacatttctataaacctaatgacactaataggaatccaaatactttgattttcctcaaaaaacgaataggccctaaaacaagtaattcaaaacgtgggtaaaagaattatcaacagttcaaaatatacgaaaaatagttaggtggagcgccttgcacgtataggtagcagaaagtcataatgtaacctaaaagttatggtgacgtttccgtgatgaagaagccaggaagcagatttatagaagcagaaatcatgaactaatttctagagcaagtacatatatgccatgtccttaaggattaactacctaaaaagggtactccgtccacatgaggcccaaagctactttccaaaagacaacgaacagaaaggcacgaaccacatgccatgctatgaaaggctacattaaactaaaccaacaggcaacagcagaacagctatatataagctttacagcaaatatacaatgcacaaattggaataatcaaacccaaagttctattttaaaacgaacagaagcatatacatatggcaaatcaaggtagaacaaataagtatgcacttttggtggctttatttctgggagccaactgcaaagataggatcggcgtccccgaatagtttcactagtaagtcaagcagatctctagtatacaaatggaattggttaaaaagggaatgaaaacaagcgagctaatgtagccataaatgggcaagataataaagcattcctttggtatacaagtttgtccatatgacaggattccagcttatgttggaacactctaagtatgtgccgcaatcaccactgcacatctcattcaaaaaccaagacctaatacatgtaggaattaaactaaaatctgaaaccttcacaaaacgtttgtattcgctcctctagcatggtggtgtccataaaccacacctctggttagctagaaacaattaactaacccgtatattaacctgatatcaccaattcatagtcatgcacctgaatacctgatataatgcttctttcatctatcccaagtcatatatgaatataatagtactctcgctaggaagtgatacctgcaaaaagattcaataaaaccattgtgagaaagaaatgttgtagatatcttcaacagggggtttcactgattgaagatataaagcagccttatttacttcaccaatcgcagatcatgtgttaaattactggtaaatataaaacattatactgaaatcaagtactgtatttgatttattccaaaacatattcataccgctctaagcttaacaaatgcatgccattccagaaattgagacgattcctaacacaatttgtacaactaatttctgccgacaactgcactatatttatattacttacaaatgatttcatgcatcccatctgataatcaaagtttcaaaagtttgattgcacttatgtataaacatgtatttgtgactggaatgagcagtagatactcaatttgatgataataacatacatgaggcaagggggccatacaccacactgaaatttagacttggaccaactgaatgatttagtgatgacgatgaattgggctaccagtaagcataattgtccaaattaacaaccaaaacattacagctccataaaagtatctgcgcaggataggtagatgactcgcgtccgagttaattaaactataggaccaaagttcttttcaattttctataaaaggaccatgtagaaccacgtgtattacaaaagggcagcttatcacactagcgtacaatcaaatgcttcatccactgctcatttttaaaaagtgcacaactgactaactacagaggcgctaccgctttcctagtgatgtaggtcgtattgcccccattctgttcatttccatacaaataattcagatgcataaattaacaaatgcaacaccttattaggtttgatgtgaagtggaatgaggtcaatatgagccaactggcacccacatgcatccataaaatttaccaaaccatctaagacatgattattttattttaacaaatggttaacctattgccacgtttttaacacacgcagaggcaagacaagagtatcacagttcaaattgacaaattagctgtggcaagagattactacgagattaggtcctcagctaatacaaatgtttcaaaattctgtggtgacatgtaaatagagatcagcaatagcatatgttgatttgtccaagtgtagtgctcaactctcattaagtattaagttcgggcaacgaatgaaggaatcttgtattgaacaaaggcatctagaatctagataaacaccaaagtgtggattgagaaatcaaattacattttaggcatagatttaagaaaatatagaaagcataataatagatatagaatgtggattgcttttgtgctcatgcaaaatttagccattatcaggtcctaactcctaaggctaaattttgctggattggaaactcccaagaaaggtctttttttatatatggtatcaccagtctacttgagtatactccctccggttccaaatataggtcgcattatagttctttactcttcattaaatataagtcactatagccacttgtcccgtggatttttcctcttatgtccttgctaattgaatgccactactctcgtgaacaaatgaggtattttttccaatgtttaataacaatagggcaacgaggtcactttaacactttctaattcctgtgcacaactctaaaacaacctacattcagaaccggaggggagtatatgatttatttgcttcattaatggctaagtaagtgagaaagcattgatttggttataaagaaatagggaatatgtgtttagctcagcaaaatgttgaagtgattactgacctctgcttgtctgattattattaacagtatagttgcccatgtaacttgctggtatgtttgatttgatatctggatcaacatttccaaggtcattaccaaaaggaggcatatcaatctcagatgacgtgaacctccaagttgagtctccataaatggagctgctgccatatgtatctgcattgttcacttcatatgcattgggtggtgcagagaagggttcaccaatggtaccagttgcattgctccttccatagctgccagaaggcaagccaaaactgtctccagctccacggccaaggttagccagcccaaggcttgaaatgttgcccattccatggccaggagtaggccctccccaattaataccgtcactggtaatacccatttgacctccagttccagatggtgcaaaagaactcatgtttgtggggttgtttgggtagttcagattttcattaccccaaacattccttgacattgaactcaatagtgatcctgaatcatcattaagaccaacataaccaataggactacctaatctgtttgaactaccattgtagaatgaacctatctgccgcccattggagttattgacaaaactagaattggcgccaaaattcgcattcatcccagattcagaattcatgcccattccataaccagggccaaatgaagagaatccattccgtgcgcctgtaagcagaccataccttccatcaaccctcatgccataacctccaatagggtttgggttataaccctggttgaaaccattcaagaagctatggaccctgctcatagcatagttctgccctcccgcaggtgaacgtgcagcaggtccaggtgattgctcctttggaacagctctcttgacctcaaccatcttaccattcagctcatggaagttcttgtgcagtgccttgtccaccgcatcttctgagtcataggtgatgaatccaaagcccctaggcctctgcgtgttgtggtcgtacatgacaaccacatccgtaatcacaccaaattgctcaaaataccttctaaattcaacctcagtaacattagaggccaagcctccaacaaagatctttctagtacggcctggtccaggtgaccctatgctgctgccattgttcttgctggtgatgctctggtcgtccctgggaacagctttcttcgcttccacctgaatcggtatgcacaattgagctcagacaatgaacagccgcactaggacagaattgccaccgaaatgcacaatacttcactagcagaggaaagagcaggggggggggggggggggtcaggtcaccacatgatttaccatgcgcccgtcgatcatgtgcttatccatggtgacccgctcggcgacgcctgcgtcggtgaagaccacgaagccgaacccacgggcgcggccggtgttgcggtcccgcatgatgacggcctcggtgacctccccgaaccggctgaagtactcgcggaggcggtcctcgtccgtctcccacgagatgccgccgacgaagagcttcccggagtccgcctccatcgcgtcctcccctcccctcctccccctgcaatccacaaacgcaagcccaattgataccagccagccatagcaaatgcggacaaaaccccgacttatccacaacgccaccacaaaaacgcatgcgcccgcgcgcgcaggacgcacatcagctagatccgagctgaaagcaacgccgcgatcgggggccgcacccaccct

SEQ ID NO: 59324 - DNA, 27974 bp, Oryza sativa
cgcgggtgcgacatgcgaggctgctctgctctgtggaagttcctcgcatggctcaaatccagcactttgctttgcttctttcggtagcttggcgattcttctaggcatatcgttgttcatctacgcattcgtgagcgtgtttagcgacgcatgcagcggcttagtccccgttgaatcgtggtttggttgaagccgtgaagttaatcaccgagagagacggaccgcgtcatagcagcgcacgagtggtagctgagcaaggtagatcttgaagcttttgaccgctgacttggagtgaatttttttaaggtgggtgttcgtaataatcttgtgccgggacccgggggtagttgcgctaaacgggtcaaagtgtcaaactttgccctctgttttggtgtcggaaaattatgggagagggggatactttacgacttgatctacagccctctgttttgttggcacacggattggtcgaaccttcttgtacgatgggtgtacggtacccatccattcatgacgttgttctacggtcagcgttacggcatgctgcttgattttgttcacttgtcggtaggactaggatgccaaaatagttggtggtattgcacaacctaatttcttagttgtttcttttttgtttcgtcttttattagcggaattaacatgttttcacatcataatgatgcttgtttagaagagctaaggtttctgctcgtcttagttttatttggcagaaaagaatgcatgtatgacatttgatcccaagttaagttgccacagtccaacatgtactttggcatgcccgctttcttcagttctgatcagatactcagtattgttgtaggatagattctatgtagttttctggcgatcttctttcgttagatacagtagattatctcaggtatctgagatttgagatattgtggttttctcaacattaaatgtttgagaattcatagtgggtggtttcttcaatgaaacaacgtcagaaaatccatttcaattaccgatattgccttgtttggttctgatactacttaaaataattgcttccagtagttcagtgccagatttacttgagttggtagctcagtttgtttatgttctgacttctgatatctactggttcattgcagattttgttcctgctggatttctgaaattttactggaggactagagatatcaagacaccaacaacaaactagtacaaagttttccttccagttaatctgttcctggatctccttgccatacgcgaagcagtggatactatgcagtaattggttaggaggtctttactgaaccataatggctgatactccaacttcccgaatgattcatcccttcagcaatataccgagccaaaacctgaagcagttccagtattctgataatccacagcacccttgccacccttatagggcaccttcagacacccacgttgtgccacatcattatggcctaaagtcacattcaccggatgctggttatgaaagccaggctactcctaacaagtacacattggactcctctgaaggtgctggttgtatgagacatgattctccttccagtcaaagtttcacaaccagaagtggtagccctctatctcaggaagacagccactctgactcgactgatggatctcctgtaggcgcctcctgtgtcactgaggatcctaatgatctgaagcaaaaactgaaggatctcgaggccgttatgcttgggccagactcggaaatagtcaacagccttgagaattcggtggcaaaccaactttccttggagccggagaagtgggtgcgcatgatgggcattcctagaggcaacttgaaagagctactgattgcctgtgctagagctgtggaagagaagaatagctttgctattgatatgatgattccagagctgagaaaaatagtttcggtatctggtgagccacttgagaggttgggagcctacatggtagaagggcttgttgccaggcttgcctcctctggcatttcaatctacaaagctttgaaatgcaaggaaccaaagagctctgaccttctgtcttacatgcacttcctgtatgaggcctgtccctacttcaagtttgggtatatgtcggcaaatggtgctattgcagaggctgtcaagggagaagacaggattcatatcatcgacttccatatctctcaaggggctcagtggatctctctccttcaggcccttgcagccaggcctggtggaccaccaactgtaaggatcactggtattgatgactcagtgtcagcttacgcacgaggcggcgggctagagctggtcggaaggaggctgtcgcacatcgccagcctgtgcaaggtgccctttgaattccacccacttgctatctccggcagcaaggtggaggcagcacatctcggagtcatccccggggaagccctcgccgtgaacttcaccctggagctgcaccacattccagacgagtcggtgagcacggcgaaccaccgtgaccgcctcctaaggatggtgaagagcctgtcgccgaaggtactcaccctggtggagatggagtccaacacgaacacggcgccattcccgcagaggttcgcggagacgctggactactacaccgccatcttcgagtccatcgacctgacgctgccgagggacgacagggagaggatcaacatggagcagcactgcctcgcgagggagatcgtcaacctcatcgcgtgcgagggggaggagagggcggaacggtacgagcccttcggcaagtggaaggcgcgcctcaccatggccgggttcaggccgtcgccgctcagctcgctggtgaacgccaccatcaggacgctgctgcagagctactcggacaactacaagctcgccgagagggatggggcgctctacctcgggtggaagagcaggcccctggtggtctcgtcggcgtggcactagcgttgtgactttgtgaggtgatctgacgacgaacttcccttgtaaccatcttggctgggggctttagaaagctatagtgatcatggactggtaagggtagctgtaacaatggtgttgtaatggtaaggtagcggctagggtcaaactcgaaaatgggcaaaatgctgatgaggtgtagaagtgtagtacatgtttgagagtatatgtttcagtttttcttttaaatgtcttgtagtaatgttgtggcacactaatgtctatgatcagaattatcatccactataagctaaaatatccattggaatgctggcaagtagagctgaaaatgtagcatcatgtttcaaccgggacgaatccaacggtccgagcattcgtacgtgttacaggtatcacatttgcatatctttactgccaacggcattgtacatatgcagtgagatacaaagctttgtcacaaaagagaattagacaagctcacaaaaccaaatcaaccataatccatgttctatccacattccactgaaggcgaagatagttaaagaaaaccaaattctgatgatctaattaatcttaacgggttcactgtacaacgaatatagggccagtgccacatacaagtatacaacaaggcctttgccgctccagaagacccatgtggtgtattttgctgcagcccacaggtacagctctcgcctccggttcaactgatgtgtcaatgataggagcatctttctgaagagaatgtcaatacgaagcattggtaatatatgattctcgagctataagcattagtatagactctcacggacccatgactaaattgccggcggtactgtagcataagttagccgaatggtccatcggtgtggctttgaaagtaaaaccttcactaggtttttcttctctcgaaccatatatattgctagctgcattgccagccatagtcggcattgccattgctggaagtcccatattactgtatactgaacccatgggctgcatttgatactgcatctgatcagaaactgaggactgcaattggtttgtggcatcgctgtggttcgggctgattccaacaccaagatcaaggctgatggtgtcactttcagctgcttgagaatattggtttggaaatgtcctaggttcacatgctctcatcatgccaccaaggccctgcatattgctgttaattggatggacaacaggcttcatggggggagtggacatctcatggctcgcattcctcgacgcagggacttcatggttatgttttccttcatatgttgttatgactgattttggatcatgtgatgctctctcaacatgcttcctgactgggcatcctgtatttgtgcacttgtagtaactcctgcaatcatgaaataaaatgaatatacaagttgcatcctgtatatatatgggttatggacacatacacctattcaataagtgatggaaaatatctgattatattgaaccattagagccttaagagaaggcctaatttccaattaagtgatgcccggcatcccagtcttagcattaagcccctacagccttactccccagcagtatcaccggacaatccgacacacatgttttacaaatatgtataaggcaaaaaaatcttatctttctgatttaaaataacatgaccagaagattattgaacattttgttgttactgttaaaaatctgttgacatgtcagagaaaaaaagaggagaatttactaggagcaatagatgaagaaaataacaactaaccgtggattggggtttcctttaactactttctggccatacttgcgccagcggtacccatcatccaagatgtcaacctcactaaccgtttgtactacaacacgaggctcacggttaggcttgcccatcaaagcagcatcaatagcagcagattccattttcctgtttgaacagttgtaaacaacacattcagtagtataaatgggtgattctcgccctagtgtgtaacaagttcaaatgaactgcaccttcgttttgactctaaatcatcatcctcaacagcatcatctccagggtaaggtctccctcctccggcatcattgtcatcatcactagctgagcctggaacaggctcaatcataccagctgtatgtactgcattaccaagaatgctaagaacatttgaagatttgtctgcatataaaaacataacatttaaaaatcgcataaaagaacacaacaaaaacattcatccatatcacacgacttttccttcggtgtatggactggcaaaaatataccagcagtgatgtactggagtgcaaatacagctcagaaaactcttatcaaattttgttttgtatgttacaaaaaaaaatgattggcaggttaaaatggcccgtggaattcaactaagttgagaaaaaaaaccacccaaacgcagtgcacagccaggctgcactcaacctcatgcaggggagttttttggtgcaaaacctgggttcgagcttaggtcggtgactcggcgtccccactattggaggctctaccaccacgctatacgttcattcgctgttttatatgtcaaatcattcatttttttaagaatctaaaggaatatgaatcataattctgcaagaaattcttgagaagcaataagaagttcagagatgacataaatagcaagagaattcacaaaaaaaagggggggaatcagatccaagaagcaggaggtcaagctgccaaaccagagggatccagcatcagtttttaaaacaaaggataaaaccctcaccatcagtagttgccacaccatcatatctttcttcaccctggattggaggaactgcaccggcagacagcctcctattgggttggggcttagggtgattgtgacgccctttataaaccacttcagtaatctgaccatcaagcgaacgctccaatagcttttttacatcacagttaggatgtgtgcacttgtaatagcttctcgggttctcacttcccttaacatgcttttgcccatatttgcgccagttataaccatcctctgcagacttttcagccacactttcaggctgtgactcctgcatagcatttccagagctattcatctgatgcaactcagatgtaccaacttcagcaggtgagctgtcagttaaaccaaccattccaaccagttggctcggggcacttgaaatattgactgcgagagttgactcacgagaacatagaggtatattgtcgatcatcatatcgtcagatgacagggcagtattcaggctttcatttttcatagaagtttcatgctttttgggatcattgatagcagaagcctacagtacaagacacgagtacagcaaaaggttatacaatgcaaaactaagtacaagagaaaacaaggtgtagggaaaaaaaggtaacaagggcacaaggcatagatggatcacacaaaatatgtaatgaagtttgttttccaaaaaagaatccaccattacaagatacttgtctgtacttgtgagaactaaagaagaatgtggaattcggttaacaacaaaatgcagaaggacctgatttcatgaacatatttttatgttaacattaattattctaaagctacagaactcattagattggtccattcaattacttgtattctgacctcaaattttcacatacttctataaatttgcagccagactagcaccactcaagtctcacctagcaaggaaatattgtgtctgttataccctattctcatgatctcaccaaagatctcatttctcctttcacaattaatagcttgtatttatgttgcaagaccctgctataatcaaatcacacaataaagtcggtgtgatcatttattagacttgaagatgtaaccagatccatcccaattttggcactgaaatttcaagacaccgaaccatggactagaaataacacagcctacaataataataaaacgaatttattgtactcctggtgaggtttgcgattcacgtgagaatattttgaattaaacataggaaaacttaaatatcaaaagctggaacctcagatagatttaccaagtaaaatgcaatatagatccaataaatagcataccgtaaggtaacaactttagatcatggaaaggaagttagcataagcacattagaactttacactccttttatgtacatccccaatataaattccactgttttggcgggaccatttgtaaacaacaaatgttattattttctatggaaattttttcaaactctcaaatacagtatacacaaatgaagaattacacgataccaggtaatcactcaaagaaaggatccataccgtcgattgagaggatgaattcagatgaggcttgaattcaaaatctcgagagccaccatcttcatgggtgctaccagatgttttatccctaggcgaaggaagtatgtctggatttgcactcttgttcataattgcagccatgctcagagtaccagttgtcggagagggttcaacctaaacagggaaattttgataattagtttgcaagcaaggtaagcataatctctataattttttgaacattcaacaatgcgcaacagtattacagtgtacatgttgaacagtaacttgcagaaagtatttatgtcatgcttagtacaatacttatgcctctagtatgaaaaattatccagaaacacttgtcaactaaatgttaccttcataaattcttcatttaattaaaacctgtttgccaagcatccctatgttttggaaaaggaaacatcaagaaggtcggcaaagtaacgaaggaaccaagagaaagcaagtgatatgaagctgcaaacaagcactctatgctcagcaagtaaattccaatttgtgggttttcaccgagaagaatcagaaccgccaatacaacacctaaggccagacccagcactcgatatcagtgaagcaatcatttctaaaccaagcctataaactaactctcttgcagtgcttggtgcttcccttacgaaacagcagcattccttagcatgcacaccaccagcacaatagcagccaaagccaagggggcgtttccttatgtaaggccctttgaggccgcaacaagaaaaatgccacatgatgatttgttcccccgagccaccaagtgtgtgcagcacagaataattcccccgaaacgcacaaacaacagctcccacctcactccacagaaaattgacggcgcaggggcgccccaaaaggagaaacagagcaaaaacaactatatccgcgcgaaccccgccaaaagtcagttccagaaaccgcaaggcaccaccagaaatgcgaaagcgcgcagcaaaagcgcattattccgacgccacgagccaattccgcggtgcaaatgtctcataaactagaagcataaagctaatgcgcgcatcggaatccctcctttcccccccgacacagattaatcccccggcacgatgcgggcgccgaagaaattcgtagatcccgcagtaactaggcgcgaggagatgggtgggtgatagctacgctacacgcgcggccgaggtacacagctcaccttgaagttggtgaggaggacgggggactcgaggagagccgaggggctgaagcccgcggggatggtgaggcagggctcccgcgagatcggcagccgcgcgggggacatcgccttgtacctcgcccccgcgcccgccgcgcccgcggcgagcgccgcgacgcgccgatccaccgggggctgcttctccggcgacccgccgacgcccgcggggtggtcaccggagctagggtttggcgaatcggccattgctgcggttgcgctgcgctgcgtgggaagctgtctcgtgagagtgaagaggaaggagggtgaggtggtggtggttttggaggcgatggtgcggggtggggaggggaggggcagtttggggaaagtggggtcgtcctgtagccaaggtagcgtgggctgggaggctgcggttcgtgttgacttaattaattgcggcccctgaaattactcttccacccctgcaatgtgagcgtaattacgggggtgggaggggtagtacgcgagttggaacaaggggaagcgaagcaagcgtggtgtgatgtgagcaaccggggcacgaaaccggtggtgggatccgggggcagggagtgacgacagcgacccgggctggctgcggtgcctggcggtttcggggcaccgagtggtttggcttcatgcgtcactggagtgtgggcccccacgtggtggtggtcccagctgtcagtgaggtgtttgcgttgtttgtgtagggggtggtgggtgtggctgggaaatatggtgaaacaagataaatgtggtgggtttttaattcggcgtgggatgcctgtcagagtaccccatgatctccttgaaattgaatgagaacctgaggagtggtgaatctaaattgaatgcaagaggccatattgcgaatgttttttactttctacatgcggttaaatttgtttcgtcatatagaagggaaatatttgaatgctggtgcctaatactccctgtcatagatattttgtcatttatgataagattttattcatattttaaaattacgaccatagtttagtgtaagaataaaagaaatagtatatatggcttccattttttagaggggcgtgatttatatctatagtgggatatgtgtatgtgccttccatgcaattgaacaattttagacgtctctcatttgtaaagatgtcgtgtcatttgaagagatttaggtcctgtttgattcagtttatgattattataatctggattgttagaagtaaattgaaacaaacaaatagcttattatgatagattattataatctataagcacgatttctataatctgataatccactctaaaggtgcttttttagattattgggtggctaacaactaacaaacaactaataattcagagaaacaaacagttaacaacttattctatatcggtttattataatctagcttatagtaatctagctcaataatatagattacaataattttaagcggaaacagacatggccttatttggcagcaatgtaaattaaatctgactatgtccattttcagtgggagtttcatcttgtggtttcctatagtgctacataatctaaaaatatgaaacaaatgtctcaaatgcataatttcattttcgtgattttatattcatataatttaattattgaatggtgttatgaaactatttggtcacagtggggtttcatttccatcttttaaggcataggataaaataattcagtcccaattgggttttattcggtcttcaagcataggtaactgtataaaccaagttttgtttatatgttcattctttatctcttttaataaaattcatggcatgtcatcagtttagtctatatggcatctcatttaccgagattaaaactcaaatgaaacttgcacagtgaatgagctaagaacacgcctgagagagagagagagagagagagagagagagagaatgatctggcagggaaaaatcgaagaaaaacttcgaggaatctacaaaagtcttgggccatcagccacttatcgtattggaccatacaacctcaaggttcactcgtgtacttgcattgggccatacccgttgttgcctaacagcacatggcccacatccctcccgaccgtgcccagcccattcaattgttccgtaggaattgatctgcaggctggtctacaagcagacgagccgttggaagatggtacagagctgacgggttcctattttctactaacatgttgtttcggaggcgagaaatactgtagtacctcctccatttatttccgtatgtgatcagtgatcggttggttaagcagacaaataggctacttacattatgtgtgttaatatgcatatgtaacagtgtagcaagtcttcttttaagcatttttattaagtacttcctctgtcgtatattaagattatttttagctcatcccatttatctcaaaataaattgatttttagtaataattatatcaaagtttataatagtaaagaataattgcattggaagtagataaagtgataaatagttatattaagatgagataaagtaatgatattttagtcttttgatgtttgtattggtatgtgtaggatgagtgaacaatgaacttattttggaacatctgtattactaatatgtatttgtactaatttttttaccaggtatgcatatgtaaaaattactccctttattttaaaatgtattgagatacatatagatataattatcttctcaaacaatcttttcaatattatactttaactactactgttttcttttgtttattatcaatacctacagaatcgatgccatataaaaatagctaaataaaaatctaacaatactactttattatataatgatataaaaatcaaataaaaagtcataacattaatcacatatccaatcctgtacttttaatccattcattagacaagtttttatgttttgatttttctcaaaataaaaatgccttatatattttagaatagatggagaaacaagttagtattcctttatcatacaataatactctattgtcataatatatgacgtttgttttttcttgagcaaactttcaaaatttttcccatcaagaagatctcaacggcagggcaccgttggcctgacctatatatacacatcttttaaacgggtcttaagagccacgcaacacgtggcttatgtggctagtttaaaataaagctacctataccgcttatgttttgtttcacaagtaaagatatttatccatccactctctcatctcaacctattataactattcttattttaatctccatttattttttttcacatactttttctttttaatcaaccgtaactaatacatgtatctaactttaaaaagataattgttacgagtacaataaaactggaacgattttagtactatactaaatagtatggttatcgattgggtggaaacatcttggatcgcatatttaccgcatgcatttgagactactaagtatcgtcctctaatagtttatagcatgcttttttttaaaagaaaatgtttatgttttaggatggatgaaatactatttgaaaacacgggaggaataaaatcaagtcttgtaccgaatcttttgtgcactaattaaccatgccacagaaaatttgacgagttattacacccagaaacgatgtagatccgcctgcaagttgttgcttggtcattagatacagtccaacgaattgtgcagtgtgtactggtgcggaggctatttaaaccgagcccccatgtgttcaagtacttgttggctttgttgcctcctccatgaatggtgaaactctcttgtcacgagacattttgctccaaaaagtcctagtttatgagtatcgggttgagaaaatccacctcgatcatccaagcttgcgaaagcggaattctttttggttgctcaaacctacaagtccatgctttttttaatgttattcaccgaattatttgctcaatggttttatttagaaaatacagcttctaaaaaattccattatattacatttcctatacaacttggttcatttcttaaaatatttaatctacccatataaccagtagataatccgtaacaataaatgttcaataatctaaatcaaataggcattagattattcactgtattaattgctccatagttcaaaaattgcatttttctaaaaaaaattgtattattcaaactgcttattttaagctattttataaagttgatttaccaaaacatctacacatttaagttatgtttataattaagttgataatccacggtcaacgagatgagattgaaaaaaaaaaaaaggccgacgctagcgctcacgatttgtccaaattgtcgtttggaaattgttactccccttgttgcttggccatacatatcgtcttccgtagcaaccaatggccaaggggctgatgacttgatgggtctgtgtgtttggctgttgttcttccgggtgtgtctaatgtgttctttttagttaaggactaatttgatcgtgccattataaattgattatttattttcaaaataccattataatttgtaattttaatcgtgtcattggaacactttcaaaaatgaattataacacgtagtacgtgtggtacgcatgttgaagcgttttttaacttccgcatattcgaagtaccaaaacactctacctcacttccttatactccctatgttccaaaatataaggcacaaccaaccttaacccaaagactaagaaacaattattatcatctactagtttgaatcatcataataaatataatgcatgcatccaatagaattagagatcttgagggtggaggatttaaaaaagtaataatttaatagagaagaggttctaattaattgtatgcatgcatatatgtcttatattatgaaacatcaaaaaaagtagttgtgctttatattatgcaaccctaaccctattaaagcagcgatggcagcacataccattgcctgcatgtggtggcggggacgacgatgaggcacaagtctaacgatggtgcaagcagatttagacgtggtgaggtgggggacggtaattgggcgcggtctggtggtggcagcgacacggtgaagtcggggacgctaagactgggtacaatagcagactataagtcagctataaacacattttaaagagataaaaaaaagagagaagagcaacgggctacatatctgtagccagctgcagcatgaactccaagacacaatgtgtgtatgacaggtgggaccatgcattaataatgtagtaagcaactattgtatgaattggctattacattggctatagatgatttggagctagtagttgtgagagcgctacgcgtcggacgtacggcgcgagacgaaaaatcggacgcctcgcgcgaccgtccgatgcagcacgcgcgcgccagccgtccgattggagaaacaactcgcgcccgacgcccccgccgttgcaacacctggacacattaactgtttcattcaatgtgtctgcccgttgaccgctagctcgaggggagatttcggtggcgcgactggcgctgtgctgccaccggcgattctctccggcgccggcgaccctatcccccacgcccctatcctcctcgcgacgccgacgaagcctacaacaacgccgacatgccgccacaccacatgccgccaccgccgccatggctcatctgatacaccaagttgagagggattttccgccgagctcatctagtgcaaatggaggaacaaccccaattcataatgcaatgaatttggtgagtaaaaaatttctagggttttgcttgttttacttttttttttgacaaagtttcaataaaaaattgaagcatagatctgtgaaacaatgtcttccctcatgcaacatttatattcatgtcttatttttaattttaacttttgtataaatttggactggaatttgacttgaacaataatccttaacttgctgaaacataactgtacaaactaatgaaacaaaacaaaatgttacagatcgatgtccaagcaccaagctcatctggtggcttccttgatgtgctattatccgaatccactgggcatgaaactgacttggtgagttgtccttggatttgaaacattgcaaatgtaggggggaaatattttgttttgaaaacacagtatgtaacttagtgaaacttttttgtgtactaggttgtagatgtggaaagtgttgacaacacagatgtggctgctgtgactgttgaaattgatgaacaattggatgaagatgcatctgaaaatgatgaagaagaaaaggatgttgtttattccccaccaattgttccatacattggaatggagtttgatacagtggaagaggcaagaaatgtttacaacgcttatgcttataagctaggatttggaacaagaattgcatcatctagaaacagccaggcatcatcggggggaaaaagcatcgaagaaatgtaaagtatctgaaaatggagacaacaagtggagagtcattgctttccaaccagaacacacgcatccgatggtgaagcgccttggaagaaggagatattacagatctcacaggcatatctcaaatgaagactatgaattttctaaagactttgcatgatcgaaacattgcaacatcgcagattttggcgttgttaggagatttgcacggtggtgtgaggaatctaactttcactgctaaagatgtctcaaatttgaggacaaaattgagacaacaagtttcactcaaagatgttgcaatgactattgattatttccaaaaaaaaaaaactcaagcagataacccctccttcttctatgctgcaagatatgatgaggacaacgtgttgaaggcgctgttttgggtggatggcagaacacggaaactgtatcaaagctataaagactgtgtcttctttgacacaaccttaatgactaaccgttacaacatgccatttgcacccattgttggaactaataaccacctgcaaacaatattgcttggatgtgctttgatttgtgatgaaacaactgaaacattcatatgggtctataaaacatggatgcgagcaatgaatggacagaagccaggttcagtgatgacagaccgagataaagcaatgagagcagcgattaaaaaggtgttccccggtacaattcatagatgttgcttatggcacgtgacaacagaagcagatcagcagctcctgcccgtgtatacttcaaagaaaggcttccatgaagctttgtatagatacatatatgactctaaaacaatagcctgatcccttcattcaatgaagcagaatcttgagcaacaccatcttgggcaactgttaacaaccaaatttggtaatatcagcatcgggaaagaaaattagatcgaagcaaagtcggaggcggagatcgagttcagaaacagggcaggaatcggctggagtccagatcggctacgattaggatcggctgggtctgagtcgggctaggtaagccgatgcagccgattccgacaatgcaacttggtgtatgacatcgggttgagttgaggtgtttcaaggtgattgccgcacatggatagagtcctgagaaggcaattgtatatattaattaggatgttttaggtaatttccttagagatatgcttgggcaaaagtctgccgcaaagacttatggtatcttagagtttgttagagatagtagtcgtgtccgttatggacatatcttgtaattttcgggtataaataggcccgagccctatgtaacttttaacacacatgttcaatacaatctcggcgcatcgccacccttttttgctttagttttatttcgacgagttcttgctttcggattgagctgcatcggtttcgatcttcaacaagaggtaaaacttgttatggcggcttgcgttctcgggattagtgcttccatttttatgacactctaatcttgtttatgtaattcgtcgagttatcatatatcctacataatccttggcaatatcgatatccaacctacaatcggctaacatccgtcaatagaaggcagccgattaggttaaataccgatgttgacttagataatataggatatctaccactctatgacatatccaacggcttgattgtctagatattgtccttcttttcatatttatagctgcatcagttaagtttgatcttatgagtcgtgattagaatctcaatctctagcccgcttcttggttgctgattagggtagtatcggagtttcagccgatcttacctgatttaactactttttatcctatatgcttgattgacatgttaaatctgccctttacgttaagatcttgctgcatttaagtatattaggcttttgtttagtatattctactcgctttaatatcttaatatagagtggtatcggagtattagccgatacatgctagatctatctgatcggctatgctatgaacgtatatagtctcattattaatatatatttcgatctaagtgatttatactgtctcggcatggcgaccgatctatctcaatcacttgatttaagtatatatcgatataaagattatatattggtaatatctgcagccgatcgagtagattcagtccttccttatttattaatgactgccgatcgatgcatatataacatcggctcaaagataaatgatatgtcattggcacctagccgatcggctatcatttatagatttaactgtgatttctttgcttctatttcttgttcattacatgatcaaatcaactggcacgctcatacattcgaaggcgagctttggacctgcactagagttaaacagatctcccaggcctcgtgttttctgtcaacaacaacaccagccccaatgcctacaccatcttgaccagcaccaattggaacatcttcagcccttgcaaccctagcattctcagcctcagacccaccagcaacaacatgaacttgggctagatatgggatctcattctgtggacggaactgaagaaataaaaagatgaaacatagtcttagtaagtggtgaaacacaaaatgtatatatactaaaacattcatagttgtgaaacataccgggcgagacccatatgtgacatagccaaggttcatcctacaacggtctacaacaacaatatactcaaagtcctcatcagtgacatgacaaaatcttggtgtgctgtagtcaatgatgcggagatgcagtccagttgttggcatttgcaaatgatccatgtaagcaatctaaaaaaaaggcatttgatataggtagttagcaggagcatattggccaaaaaatatgaactagaacatatggcagcggtgcatgaaacatatcatatgtgtaatatgaaacaattgatatattttgctgaaacatatacataggtaattagcatgctagactgattatttactgaaacatatgacaacagttgtgtgaaacaaaacatatacgttaaatgagacaaatggatgtattttgctgaaatattggatcaagcacatgacagtgaaacaataaaaaaatatatatagcaaggtgaaacaataaaaaacttacaacaagcaaggggaggcactctccaatctgaaaaatggaatctcgttgcttagtagagaatccatgatatttcttgatttcccgcatcaaacagctcgccacatatgtgcaccaatcatactgactccacatctggacatcaaccaaagaatgcacatagtcgagattcacataattgccagtggcaggacacaagatggtggcaagcaggtacaaaatgaaagtcctcaagaacttctcttcatcatgcagagaaagcaacaatttctcgcacatgcctgtaccaagtctattgctgacaaaatatggatggtacagggtcctgatctctttcacaacttcactgttggcaccactaagcttaacaggtagatcgccatcatttagcccagtaatcttctgtactaacaacttatcaaacatgataaccttgccacggaacctaaactcacaaatctctgggttcatcttttgcataatccattctgcaagtcgactatggaccttgaaattgcttagcgatagaaaagattcaaagtcattatctatgatgaattgcttttgatcgggttccaactgaagcatagtgcgcttaaacctcacaccaccccatctatgcttgaagttggaaccactacaccaatcaggcatccttgaaaaaaaacacacagaaacaaagtctgagacaaaaatacaacatgtgctctgcaacaaaaaaaaatgtgtgtactactatgtaaaacaaaccagggaatactatgaaacataatattaatgtgtactgcaacattgtatatgcatggatgggaacacaaaaaaacaacataaacacaaataaaaatgaaaaaataaaaaaaatgcataatagattatcacagtgcaaaaatggtaaaacaaaaaaaccaccatatgaaacaatcacagtgcaaactcatattatagattatcaattatatctcataatagatcatcatagattatccttctgtgacaaattaatgtaactaatagagcacaatcacatctaggagaccacatgcaacacagacaataataaaaaaaaaatccattcacatctagggggaatctcataaatgcatcctcatagattatacctaaaaacattctgaaaaaaaattaatgtcattactagaacacattcacatctagtagaccaatgcaaaacacaaaaaaaaaagtcaaaaatcatttcggatttgagggagaaagcatggggtagcaaggtgtgagaggggtggtaaggggtgggggtggaatggggaacgggggtaaacgaagccctcacctcaacgctgggaatggagacagccgccgccgccgctggtcggaaccgcagcaacacacagccgcggggtgagtgtgtggtgggggtagagccgtagaggggaatgcgacgattggagaagccgctgcgacagcttctagcttctccagcgccgcctcgaacatcgccgctgccggtcggaaccgcctcagccgccgccatcacctacccgctagacctaactccaccgccacctctccgcgcgctctatccgattgtgttggagcggttacggtggaaaaaagggaaacccagctgtttccctttggatgttgcaacgggctaaacgcacggagcaaatctcagccgtgcgttctgtcctaacggatcgaacggctcgcgcgtgcgtctgacgatgcgcctcacatcggacggccgattataagcgttttcgtagtagttggctatactattaaacttgctctaacagagcgcaggttcaactgtggaagcaacgtggcgagatcaggcggtattcatcgacgacgatctctccatgagggaaaggggaccctcccctttataccgtgttaattatttttacctagatttaactatttgtaatttgatttggcgcatactgcataaaaacaatatcctctttttaaatggaagcaaattaatttgcaatatccgtctagatctttttggccgaatacaaatggagactatttttcttccattatcttccatatattactttttgcccatatggatctgaaacatatgcaggggtgttttggtttatagaaagaaaatagcaattaatggactatgtattactctctctgtcctaaatataaatataaagagattttggatggatatgatacatctaatacgaatctggataagaggatgtaactcatgaaactcaaaatttcttatattttaggacggatggagtagaatttgggaacatgttatttctatctttatagacaccacttatatggtttatatgttccttatctcctgtgctgtgaacaggaaaaaaatgtgcattgcacggtgtgatcaggacgcgaatgtgaaaaagaaaagaaaagaaatctctagaggtggacccatcagtgttttggtgtacctgagttatgctaagagcaaagccggccccttattattattaaactcgtattcgtatgatgatgtggaggagaaaagaaaagagagaaagaggagaagccaggtaattttcacacatacttcaataaatgagagagaaagagagtactccctccgtaaaaaaaaaagacaaaccctggtttccatgcccaacatttaaccgttcatcttatttgaaaaaattataaaaaaaataaaaaagacaagtcacgcataaaatattaatcatgtgttatcatctaacaacaatgaaaatacgaattataaaaaaatttcatataagatggacagttaaagttggacacagaaacctagggtttgcctttttttaggacggagggagcagtggattgacatactccaagtgtattgggagtagtgtaaacaagtacaatctattgtaaattaatgttactctctccattaaaaatacttaggattgaatgtatcatatcctaatacaacgaatttggactagatatatgtcacatccaattttatgtttgttttttatgggctgtagatagtactctctccggtttcattttaattgacgctttggacaatgacacgctttacaagatatacctttgatcttatttttctattataatatatacaataaataaatgcatgtttacttttattatagtgttttgaaagacatatctatatatgtttttctaatttctttaaactaaatatttttaaagttattgatggttaaagttataaaagtttaacatcaatctttttctaaatgtcaattaatatagaaacagagggagtacatgattacctactctgtccagtaaaaaaacctcaacctagatctggacatcccatactaactaggttggattttttttttgacttaggaaaaaatatcagaaaacctgctctaaaccggcaatataccaggaaaatccgcagcgtcttgccgaatggaattaaattgttcattcattttttttctcaggaatattcgggatacaaaattttctacagaaatataccgtcggtctcgcatacgcgttacgcgaaaataacgtggaataacgtcgcaggcggtatcgcgccatgaaagtgcgaagagaccgttcggtatcgctgaagcaaggagcgatactggtgccatgatgatttaattagccattaattaacgaattaattaaatcactgatcaagataatttatcattaattattattagttaattgttaattgagtgattaattactggagatattggtcagtgtatctgtttgatttcgtgagagcgttcagtctcacattccgcgagacattttcaccgcgcgatatcgtccacgacgtcacgccttcacagaacggttatgggatatcgatgttatatttttaagaaaaattgtatcacgaatatttttgagaaaaaaattaaataaacagtatattttcaaatttgactatcgccgaacggcgatggtatcgatcgattcaattcccaatctttggtttgatttccgcatgtggctttgcccactgatcctccagacctccaccaaccaaccccaaaacaaccggcgacgacgaaatgacaaaataaagaaaaaagaaaagtgccgtcgcgtacgaaggcaagctatctacggtcaccccctataaattcggaaagaggcgagcgaaagacgaaaaaaacagcccgaaaacagaagcaatcgcgacagagaagaagagggccattcccttcgtcctcctcgtcgcctccgctttcccaatccaccatctccccccacctaaatccatcgaatcatccgcccccgaattccgccgccgacgcggtcgatccctccccggccggcgcatggggatcgggcccaatcgccgcctctcccgcccctcatttggggttcccgggatttgacggctttttgcttgcttgagcgcttgcttgctgattcgatcgggtgggaagatttccgtgcctgcctccggtggtggttcgatcgggcttgggggggattgatgggtttgctgttcgtggagtcgctcccggggccgaaggtgttcaagtgcaagttctgcggggtggactcggcgtcgccggacgccatcgtgtccaaggagttccgcggccgccatggccgggcctatctcttcgacagcgtgtaagctgggctatccatccactatttccatttccccctctcttttgattattgcgtttctatgcatgacagtgacgcgatcgtggcaatgtcgctgtcctggaaaggattagcgtgtccatggacggggaattgtggaattgtcttgtaacagtgctgtttaatgatggatttctcgcgtattgttgttttgggatgggagggaaaacggcggtatcttatattggtgcaattaagctagattgcaagcgttcggaagtagattcatgatgtggttgtgttggatttgatcagtactgcgtggctagggcataagaggctaataagagctatgcaaattatgttccacatgataaattgtcttgttcttaatttttttggtctgtcaatctagacacagatggaactgataggaaatgccgaaatgttgatggctagtgttaagctacagagctatagtttggagattaattagccacaatctcttgttagatattacatgatggaaaacaacatcatgcttggtaaagaatgaagatgaacagagcaaggtgtgagttgagaacttaattcattgtagctatgtcaatctgatatgttgcaaaggtggctcttatcttaaacctagtaggacaagggttcatgtactaatcctaataggattttggttcctgcttctatttggactatgtatgccacaatacccaatccagtccagtattgctgctcacaaaatagggtatcagagtataacatgctattatatagtttttcttagtctatttttcatatctttgtaactgacctactactggatgttaaaggcatgcgaaggttatgttttgtgaaatcagttgaacatgtaaaccatatgttgttttctgaaataggcaagcaatataccatgtacttcgtttgtttaaatgaagtatccttgtctggcgtttatttttgtccgatccaacaaacaaacatgataattagggcaatgttgttaatgttgcatcaatttacatcacagtattagttaaggcataattggtcattcaaattgataatttgaacaaccactctcaaccaattcttgtttacatgttgatccggagtgaacatgacatccagggtgaacgtgagccttggtcccagggaggatcgccttctcatgactggattgcacacagtgaatgatatctattgtagctgctgccaacgactccttggttggagatacgtaagttgccagtttccatgttgtttagtgagaattcatttgaacactacaaatgtaggacggtctatgccttcatgatggtcaacctgttaaatattcgatactttatctatatctggataagttaatgtcctaacagaagactgtgagagatttgactaacttttcttattgagcatgatcatatagcattcatgtcttttgaaacaataggagggtagagtttgctacataatgtatgggaatctccaaggcataacctctgcatttctggggagcacataactaagaattatgttggctatagattgcatttttgctaagagccaatgcattaccttatgattcatgggcatcgactggttgtcagactttctatttcctggatctctttcgtgttatcatttctttgatgtgtaaaactctattaatactatatgccttaattgtgaggcaaaatgggcagcaggatgtggctatgctttctgacacaagacaaacatgatctggtttttttgtttcctcattttcgaaatttgatgttgtcagttgagaagatgcatgatgaatccatgctccatggtgcattaccggtagaagtctaacaagctatcactccctctacaaactcatctatgctcgtaggcttttctgttagatcatgtttcatgagcttccatgcggcactttatcgtttgaatgcattcttctgcaacactcaaagtaggtagtaatgcttagtgttcaagtcgtagcttaaacctgggactgtccagatcttaataatatataccgagactagtcgatcactaccctatagttctgagctttataaattaagtacacctcattttctaccactgtgtagtttatagttattttttcctggtgaatttttttttggggaaaaaacaatatgttgcctatgttatgtggttgggaacatctagtccatagtgggtcttttcagctaaggagcatatgatcaatttgttcctccatttctcccttagttccatggtcaggctgccctttccacaggaatcttgcaaattgttaacttaatatgagatttttattgtttggttgcatttgtagtgatgatttcctccaggagcattggctggatgttccttcatgcatgactaattatacctctaaacacttgctactgccagatggactataagaccaatcctgggtcatacacacttgggcatttgatccaaatgtcagcaagtatgagtccataagcgtgaacgaacgaatatgctctttaatgttcatgccatttctctcatgaatgttggttattttttctggatcagtcatcatcatgtaactgtgctcattgaacaatatgcaggagaaagcttatagtgaggaccagaagtacaaagaaggcaagtatatattagagaagcacatgatgctgaaagaaggatagtgattggaaaaccgctgaactattaagtctgcaaatgcaggcatatgaaaccatgtaaaatatcgctgaatattgggtttcaattctccccaaaattgattatctggcgaggaccatcgtcattaaattgcatttatgaaatataatgtcatgtgaaatccactgttctttcagctgaacctctgaaaacttcttgacagtttgcttggttaaccccattcatgaaagtttgcgaatggggagacggttcaatcccattcttgacatttgtatattttgatctcaatcgtcttaaatggccaaggatgggattgagttgcaacctttgactctttgaggcctgtttggtcggacggattttttttttcgcgaacgctctcataggcttgctgcctaaaattgaattcctacatttctaacaagctgcgagcttggtcagattagctcgaaaactagagataaagttaatgtgttccctagcatttctattctgggaatgaccgcatgagcagaacacttggcacaaatgaaggaacagagcggagaatcggcacgcgccgcctgctacgttgatgcatccaaatggctgcattctccgagacgaatcacgccgaaacagcgatcagatcgcgacctgcgtaagtcaaacagcgctaccaacggataagattgtaggattaccgtctgataaacgcggactgcacgttgtgcatatgtcactgcttagctagctagtaggctactccctccatccccatatgtagcaagcacatattaggactacgaatttggatatatcctatgtgactatgttcagattcgtagttttaagacgagtctaattcatatgttcagatttatagtcctagaatctatcctagattgttatatatcgggacatatgagggtgtagtactttggtagtgtttgaatatcctgaagatgaagatgaagattaagtgttttatacaaaacgaggttataataatgtgtaattaattgagttttaattattctaaacttaaaaaatagactaatatgatattttagaacaattttcatatagaaagttttcgtacgaaacgtaccgtttagcagtttaaaaagcgtggcacgagtatccaaaatttaatccaatttttgttggagaaaagaacatggcctttactccattacttgaattttcatctaatatcagtatggcgtaaagtattcgaaaatccctggagaatggatgagcatttggtatctgtacaatcgcctctgagtctcctctgacctgcaccatacccggcctacctcaccttcgccttcctagagagcactggccgtcggcttaactaactccagatcgagtcccatactcccatgggccatggcccatccgtgccacgtgtcgcatgctcctaccggcgaggcgggcccaccaagcttggtcaaccctccagtccgccgtagaccgtagcgctatacggacgtagtacgagtacaaatacgtcacaggcttgtactcctataccggctctgcctggtgcaggcgcttacctgcgggtggcccaaccgcgacgcaccacgcgttcacacggccacgtcagcctactacgcctgtctccgcgtataaatagccgccgcccccgatttcgccgctgctgctaacctcgccccactttccccgcctcgggtcgcgccgccgcgtccccgccgcgccgcgacgcgacgcaacgcatgccccccaacccgactccgccgcggcgcgcgacgacgacgacgacgagggcgaccagcggcgtccgccggggggaggaggagcaggggggcatggcggtgtcggcgtcggcgggggaggaggaggaggcgttcgaggaggtggacccgacggggcggttcgggcggtacgccgacgtgctcggcctcggctccgtgaagaaggtgtaccgcgggttcgaccaggaggaagggatcgaggtggcgtggaaccgcgtgcggctgcgcgcgctcgccgaccgcgacccggccatggtggagcgcctccacgccgaggtgcgcctcctccgctccctccaccacgagcacatcatcggcttccacaaggtctggctcgaccgcgacgccggcgtgctcaacttcatcaccgaggtctgcacctccggcagcctccgcgagtaccgcgaccgccaccgccacgtctccgtcaaggcgctcaagaagtgggcgcgccagatcctcctcggactcgaccacctccacacccacgacccctgcatcatccaccgcgacctcaactgcagcaacgtcttcatcaacggcaacaccggccaggttcccccccacccctcattactgcatccagtttcttcccagattagcagatttgacaagctcacctatcccaaaaatttagggctagaattaattacaatcaaaatcatgataacgttcgatctgctagactatattaggagcaaagcaatagcttaattaggcctttgaactgccatttttctttttcaaaatgaaatgtttgaaaactgaaatggtattcaaattttgaattggtagacggtggttggaggga

SEQ ID NO: 59325 - DNA, 8271 bp, Oryza sativa
gccgccgccgccgcccccgcacccgcccgaggacccgccgcctcacccgccgcaccccccggaccacccgccgccgccgccaccttgccgcgtcccgccgcctcccgggtaccgccagcccatggcgtggcccgcccggcgtgaccgcgcgtggtacgcgaacgtggagctcccgccgctggccccggccaagctggccggcccccctgaccccgtgcgcgcccgcggcgactggctggtgttccccaagggggtggggacttacgtcgagcagctggccggcatggttcctctccgcggcggcgaggtccggaccgcgctcgacgtaggatgtggggtaaggctaatccaatcatttctacgagctttccgtttcatatccgagacgttgagatttcaatttgtaggggactgaactgaactactgatagtgaatggtacaaagtacaaacagttaattactgtcacctctgaagttaaccactgaatcaagtagtactgaaaatttcagtgtcaaagatgactctatcaagttaaaatttgactaccgaatagtgaatttgaatgtgatgtctgtctctgtgctacaggttgcgagctttggagactacctgttgaactatgggatactgaccatgtcaattgataggagaaataggcataaagcacaagtgcagctcgccttggagcgtggtctgccagcgatgatcggagcactcggtgttcgcaggctgccttatccgacgaggtcgttcgacatggtgcactgcgcaggctgccttgttccggggaattctcatggtaggacatgaaagatacatactctgtgataattcttgatatcttgttgatcatgaaactcgtctccatgtatagcttttgattggttgcatatatcaatagctttgaaagttggcagatgttgtcatcagtgagaagaattattgtgtggtgaagtgctttagtttgttctcattcacctatagctgatttcagatgaactctacatgctggaaattgaccgtcttctccgacctggtggatattgggtattggctatgccaccaatcagctggaaaacacagtatgatgatttgaaccgtacagccaagggtatgccaggtgaacaattagctttggaagagatagtgaaaaaactttgctggtcgaaggtttcagagaacggtacaatcgcggtttggagaaagcctataaatcatattcaatgcgagcaagatgctaagctcttgaggtcaccaccgttctgtacaggagatgatgcagacagtgcttggtaaagttttcctttccaccttgtagctctgcacaattttattttctgttatctgatttgtgttaccatgacgtctgtctatttcctagtcatctattgctttcaggagaattgtccttgtaaatgttaattctgaaaatcagtatatagtatctggggtattttaggagagttaaaaatttgaccagatcaaagtttatcttaagttgcaccatgagtacgacgtccaagtaagagtattagcacagtaccagtgcacttcacaaggagcttactgctaaatttatgaaaataagaagagagaaattggttactgtagtagtatataactctatcgactatagattatattggagaattgcccattcaattcgtcagttatgtaaaactcattcataacaaatgcattttgattatattgcaggtatgtaaatacttcaatgtgcctaactcgtcttccaagagatattgctggtggtgctgtggagaagtggcctgaaaggctcactgccataccaccaaggatagccagtggagaaacaaaggggatgcccatacagacatacaaacttgacagtttggattggaataaaagagttgatttctacagaacatatttgaatttatctgatgggagttacaggaatgtcatggacatgaatgccggctttggtggctttgctgcggctatgtctgaatatcctgtttgggtcatgaatgtagttcctgcaaatctgacggacaatacacttggtatcatctatgagcgtggcttgataggaacatacatggactggtaagttacagatcagattttgaagcgttatttctacttttacactaaacataacagatagctcaccatcctgaatcaattttcttcttttcattgtcaggtgcgagtctttctctacttatccacgtacatatgatgtgctacatgccaatggagtattcagcctgtatatggacacgtaagtgacgactcctatcaagtagtaactcaaattgttctcgttctgagagaagatatcattcagaaaagagacatgacatgcattgctactctggcatgcaactcctctggctcgcttagcttgatagtgccaaaactaatctcaatgttaagacgtaccgattcctttacaccaatctttgtgttgttcaggtgtggcatcccttacatcatgctcgagatggatcgcattctccggccaggaggtgctgcgataatccgggacgcgcctgatgtggttcacaaggtgaaggatgctgcagacaggctacactggcacagcgaaatcgttgacactgagaatgggggcctggatcctgagaagcttctcatcgtggacaattctcttccattcccagatcaccctgcatgatgttgataatttccacatcttctctgatcatcatcttcagaatcagaaaagattgttcttggatgcttgtatacatgcacagatgaagagtataagaggactctacacgcaatagttacatatccagatgaccacatagccgaataatccaatgtatttgagctgtttactccactagacactgtcagattccaataaaccagtataggtaacttaatctcctgagctctgtgttgttcccagcatggtgttggatgtgcagagatgcaaccatgctcgattctgtagagatgtagtatctaattgctctgcatttgtatattgtatactagctgtgtattatcggtgagatttctgtgaaattccttcagagtttgccttgctttgcttgctaagcaatggcatgattcatgtatgatgatggaatctgtagcctctacagttttgctcaggtacttccaaatttttcaggctaaaggatgttcaaaagatgcctatgcttgtttgggatattgtacaagtaaagtgaagctgcagctgatcgaatatggacatgatattttcgcctctttattgaacattgaactgaaaagtttgagcttactacgatggcctctgctactactgccgaagtagtagcaacttggaatgactgaatagattaattaatagcaattagtactagcatgcaacatttttgcatgagaatctggaaaatgtattaatcttgtggaacacataatcccctttgctaatatgatgctggaaacatgtatatttatttggctatctatattcacaacacacaaggtaggttaccagtacagccaactgctactccagggccttgatccaagttaagcagctgaaatgtgtatacagtcagcagtcagcaccaggtgcttcccataattcatggctataatttatatacaatgaactggggtatttccttccaatatagtagtataacataaacttattattacatataaacgatacatatataatcaaaaggcaccactggttcaacgaaccacttacacttatatctctacgggtttctaaccagaaagcacactagttgctgttgttatttttcatagttgcacactagttggctataataataataataaatatagttgctgtttttttacatagttgcagactagttggctataatagtaatatagccaacacgcccctataataataatataccgagctaacactgcctgcttcttttgccacaaaacttgttcgagacttcctccacagtgagatccgcaaatttgtttgtacctagtgtgcatttgcagcaaccatattttttcacctgttcagcattgaacttttcgacatactggacagtagacttgaatacctcaaagcgataagccttctctgcctcgtctttgtaattacggttgaacttgttcatccactcttggaatctcaccttcagggcctgctcctcgtcttcagacaccttcttggagccctccatcctctcatcactgtcgcttgtcttcagatacttgaaagcttctgtaattatgaggtatagtagacatttcttgttaattatgaggaaacaaaaagagatttcacttcaggcaaagctgtccgtacctggttcccctgcagtgtttgtggttgccatagacacttccattgtgttaccaggccttaataatttgagttcacgttcccctgaaggcaccctgcaaaaggtaacgaaaatggaacatagttaaaacatgtagggtaatgagtgatgaaatgctagatttttttcttttgctctaacttttctgttcgtaaagttgattgcacagatcagaaaataatagacagagatatagtaacttcttttttcatatttttgctctagcttactgaatccttaatcgcttgggtctttaacgacgtgttggcttgttaagggcgttcgtaatggtaccggtagcaaataagggacagtttttgggtccgcttggcacaacttttcttaaaagctgcaattgatatttaaatttagaatttggttttaaaaattatttcttgaggttttcctttgccacttccattgcctagctctcttttcatgattgatatacatatgagtaaaacctacctaaaattagtcttaaaaaacacatcaaaatttgtcttttttaagaaaatgtgcttctaaaagttttccctccacaatatatatcttttgcctatataattaagttactctcctggttcagtgaagatctaaccatcatggcaataacttgtgggttgaagatggcgtgtgtgtatcacatcataacttagttgataatcattatatgacaataataggaacgccgaccaatgcttttagactcatggttattgcagggtcctcgaaagaaagaaagaaacatggtgtaatgaatggcagaagcacgtcggaagctattctccatggtttagcttatatgttctcaatattgcttacaaacagaaacatctcaataaataaaaataagtactatgctatgagaataatcaattctattgctaaatgcattctggaaaacatcaatcagatttattttagtaagtcatgcgcacaatctctctttctctgtggacattgtatatttgtttacattcgaccaagatactatctttcagttagcaggacatgaacattaaagggaaaaaaaaatcaatgcaatggaaagaatggaaccctgtgcttctgtacttgctgtttataataagtttaagattataaaaaaatcctgtcataaatagccacaatatcgtaattataatcacctaatcgcacagaccaatccaaatcatgacacatcaatacaagccatgacgaccggtggacaagtcaagtggcaggctattgtaccatcgttgattggtggactcataagcatcaattactactccctccgtccctaaatgtttgacgcctttgatttttttaaacaaatttgaccgttcatcttattcaaaaaatttaagtaattattaattcttttcctatcatttgatttattgttaaatatacttttatgtatacatataattttatatatttcacaaaagtttttgaataagacgaacggtcaaacatgtttaaaaaagttaacggcgtcaaacatttagggacggagggagtattatggctgtgtttagttcagcgcaaagtttggattttggttgaaattggagatgatgtgactgaaaagttacgtgtgcatgacaggttgatgtgatggaaaaagactgaagtttggatccaaactttagatctaaacacagcctatgtaaccataacattacataggaagagttgagatatcataacattttttactgaaaagactaggaaccaactgatcaatggtttaatagaacatgattgagcaaaatcatataggtttcacatcaatatttacttaatttgtgtaaattgtagttaagaaatatagcttcttttatttttaacagagtcagcaagaagggtaagtagtaccttagaaaagagccctgcagccttgtggttcttcctgcgttgtaagcacggccctgaaaatcatactctcagtaaagtaaaatcagtcaattgaacatttggagcgggtttgtgagagtaaataaataaaagaaggcatacatggaggagaagacttgctgctctgcgcagaatcctcatggagaaggataaggatggatgctagatgacctaacaagaagacgaattcaaagattcagggcctattcagactgtagtcaaaataaatattactaaatattgtcaaaattttagtaggattttttatatatttatcaattttaacaacaaactaaacgtagccaaaattttaacaactttataaaaaatagtatgattaaaaatagcatcaaagtgaacaggtctcaaataggaagggaaatcagattcgacttgacaaatgaacaaaataaacacgccctaccagcagcggagcggatttggttttcgagggaactctgaaaggcggcggcggcgatggaacacggaagacaggacgagtatatggatgagatatgggccttttagcaaagtgggcctttcctttaagagttataaaaggttcactttggatccctcaatttgtcaccgagttcgaaattcatccctggaccacaaaaccagatatagcgtattccccaacttagaaaaccaatgcaatgacaggtaagctcacacagaaaagtgacgtgtatatctttggagttacagtattctcttggaacttctgacagggagaaacccagtggaccatacaatgcctagagagggcagcagagtttggttagatgggtaatgttcacatctatttatttttcttgttagatttgcttgatcacatctgaatatctgatttaattaacaatgtcaacaactaaggggggtgttcagatcccggggtgtaaagttttggcgtgtcacatcggatatacgcacacacatttgaagtattaaacgtagactaataacaaaacaaattacatatttcatctgtaaactgcgagatgaatttattaagcctaattaatccgtcattagaaaatgtttactgtagcaacacattgtcaaatcatggagtaattaggtttaaaagatttgtctcgcaatttacaccaaactatgtaattagttatttttattgtctgtttaatactctatacatgtgtccaagtctctatctctctctatatatacacatgagtttgacgagtcatggcacaatccgagacgcacctgacctgatgtggttcttcacaaggtgaaggatgctgcagacaggctacattggcacagcgaaatcgttgataatgcttctcatcgtggacaattctcttccattcccagatcaccctgcatgatgttgatgatttccccgtcttctctgatcatcttcagagatattgttcttggatgcttgtacatgtacagatgaaggaagagtataagaggactctacacgcagtagttacatatccagatgaccacatagccgaataatccaatgtatttgagctgcttactccactagacactgtgtcaaattccaataaaccagtacaggtaacttaatctcctgtgctctgtgttgttggatgtgcagacatgcaaccaggctcgattctgtagagatgtatctaattgcgctgcatttgtatattgtatactagtagctgtgtattatctgtgagatttctgtgaaattcctgtcgggttcgccttgctttgctcgctaagcaatggcaatgattcatcattcatgtgtgatgatggaaaccggtgaaatgggttgcatgtacttgtcttctcttaatctcttcatctaccaatcgttggacgatgtgattgggtgatgttcttgcttgtcctttcgtcctctcaaaattccaatttttccccctttgcttcgtgcaaaggacatcataactggttttgttagacgcacacagtgctatacatctccattctccagttctctgctttgcttattctattacactccctccgtccctaaa

SEQ ID NO: 59326 - DNA, 8841 bp, Oryza sativa
  unsure (1)..(8841): unsure at all n locations
ttcttatcttggttggggagcctaatcctggccctgtagtcagtcttgccctctgcaaacaataacaaatgagattaagtacatcaaaacctagctatattacaagcacagaatgcatgagccacatgaaaggattatattgaacttacgcctccgtctcttgaacttgacttggaatcgcttgaagtaggcatgggtcttctgggtcttgacaaaccctccctggagagacattatcacattaatacaacagcataaaaactgaaggcaagcaaacatgtgaactagacttaaatttgagaacttcctaaacgcatatcaaaacactgcagttttatcatcatgcagtcagttaggatagcaaatgtactgcagcaactacacgactgaaccatctaaaatccaatatccaaaacacataaatctctgatgcgtaggagtataactgatagaactagacaagcatgtgaaatttgtgctggttgtagcaactagatagtgtttgtgacatctagtatacttccactacagggatgtggcaatacacctaagtggatctactgaacaaaacaatcaatatggatgtcacgaactactgcagaatgttaccgcaaagagaagagatgctagcaaccatcaaatgggaagcacgccgaccgagatggcacaacacatcgtcgtttaagcaagaaatctatatgacgccatagatccctaccggatcgaaatggatcccaagaacccagcatcatatccatcgccacaaacgcaaaaaacctcgcagccgctctaccaatcacccacggagctaccaccacataaaaccttcacgaaccaaaccgcaacgcggcgaatcgagaacgaaacagcacagcacagcacgcagcgaccgattcgagcacgggccgtaacgaggtagagaggatggagcagaggatcttaccatgtcgctcgcctgctgttgctgctccgctgcggcggcggcggagggggaggagcgaggagaagggagaaggtgggagaaggaatggttagggtttatagcggcggctgcccacgagcccttttatccttcctctcgaagaaaccctagtcgcgggagcgcatcgggcggacggatgcggtgcgggagatggatcggacggctcagatcgtcttgaggggttgctctccgcggcttgatgggcctcagtctgtgaggctgggaaaggaaatgtttcctcgttaccagcccaaataaatttgcaggccagcattagtcccatcttctacgaacggatggcctgcaggggattggcgtagagaagaacgaaattcattttatagaaggaataagttcactttacatctctcgtatcttcgacgccgagttttaattatgtttttttaccataataccaaatataacgctcatcttttaacttataaaactggtgtgaggtccaagatagtacccagttttagctgatgcaacgagtgagccacatttgtcatcggccaactcttgttcttccccccccccactcactctcttccctctcttccacatctctcatactctcacctagcctcgagcgacggcgagaagggtggataccgacttggagagggccaaccaacaaggtggactaacgggtgagcaacgagtagcaaggagagggacgaccgccgacttagagtggggcagtgggtgcggcaaactagaaggacaatggtcttcaaactagaagggcagggagcagcattcttcttcctctcttccctatcttccccatctatcaccaggcctccgagcggcggggataagggcaatcgctgacaagccacttgttttgtatggcgcggcaaaaggcaccactaatggatagcgtcgcataggggggggggttggggacaaccccgcgccggggcagcttcaggttggtcatcggcggctatcgtgctcgcaatgcagcccaccctgatcgcctccacctcgtgaccatggcctcctgagtcccgaggacacgctcgtcatcgtctagcacactgcatacctccactagtagtcaacgtgctcctgccagctcatcctcctcgacatcatagaatttcagccccccgaggtgggccgcctccttggaaaccttccacggtcaagctcctgcgctcatgttgaccaccagtgtctccctgtcgctcgccgccccccctcctggcttgaagaggattggggaagagaggggagaggagggagagagaagaaacaagagtgggttgttgacatgtgagacccactcgccacgtgagttaagattgggcactatattaccctaggacctcaggtacacctattttgcaagtttagagacacgctatatgtatctagtatcacggtgtagtgatgtaattcaaacttgacgtatggagatctaaactgaacttattccctcgtagaatgtagaattggatgggctaatgactttggcagtcaaaaactcgttgaattgatcacctaccgtgcatttgcatttggtttaagggatgggatggttggcttggatcgagtatatttcttagcgtgtctggtttaaattgttaaatacacagttttgccataaataaattgctaaatatattatagnnnnnnnnnnnnnnnnnnnnnnnnnnnnnnnnnnnnnnnnnnnnnnnnnnnnnnnnnnnnnngaagtggtgtttttagttgcggacgtgtgagtaaacttccttgggagaggaacaacaactcaaaatggttgctagtttcgctaagggaaaattttcatcaatagtctgataacaaatttagcgacgtatctatagtttcgcaacagtttggtttaaaacaaaatctacttaaaaaaaactcaaatagcaaaatgtttgcccccctaggattcagaaaccagcactcgtagcccagtggatggatgatggactgtgagcagcagcagcaacaacgaccaaggagctagcaaagcaaacagcggtgaaaacgaccgggggcaacgaggcgtcgaacatgtggcgcggccgcgcggggcaagcgacgcgccggggtcccacgcgcgcggggaagaaaccgaagaatccacgagcaccaatccgcgcaatccccgcctccgcgatcaccaaatccgccgtcgcaccgtctccactcgtcccggatcaacaaaccgcctcttccacacaacacgccacgccacgcctcgccgcgccgcgccgcgacgacacgcgccaaccaaacgggtggcaggcaggcagcagcgagctgctgatgccgctgccgctgccgctgacaccccgcccgcccgccgccatgctgctccccgtctgctccgccgcgcccacctgctccccgctctgcccggtacggaacaaaccaccaccgcgcgccgcctccgccgccgccgccgttgtcgttctggtagtcgctaatgcttctgtttggttggctttggcaggtgacgtcgtcggtggcccatgtcgtcggcgcgccggcgctacgagggagggtggtggaggtgagcgcgctcaggtcctacgccgatccgctcgtggcgcggccggtgcccgaccgcccgctgctcgcggactcatccatcctctccccctactccgcgtcacccgacgacatcgtgcggggcctcgccgccgcggaggtgcccagcgccgacgccaccgcagcaggtgacgcgctctgctgcggcggggtcgagccggcgacgctgacggccgtctccgacctcgccgccaccacggccgacgcggccgtcaccgacgccgcggagcgcgccctgcttgacgcgccggtgcccaccacgttcccggccgacgcgtccgacgccgaggccgccttcgcgaggctcatcgactccctcgggaagaagatcttccaggcggaggacgcgctcaccgaggggtacgacaagctgcggctgtcggcgtaccagtcgctcagcgcctggaggaagtccgtcgacggcgcggttggtggcctcacggcgtcggtggacgccaccaagaagcaggccgccggtggggtgacggacgcctccggcgcgttgcaggacaaggtggccggagctggcaccgtcgccgtcgatgtccttaggaaggctattgttgctgccgaggattcactgggcagcgcagcaacatccattggatattactatggatcaaccaagtcgtcgttgccaccgaatgtgaaagatttgctgaactcctccgaggagaaagctagtctagttctgaaaccgattggaggtgcccttcaacaggtaaatcagtggcaagaattcagctcttgttcttggtatgccagttagcattttactgaaattgctcaatctgttgttgcctgctatgattcaggtatatgtagtcgtcgaaggtattgaaaagaatgttggtttggacccaagtgatcctattgttcaattggcagttctgcttggaggttcaaccacaatcgggtaaatgagattttctctttgccatttatagctgacatgttcataccaaatcttcttcttaatccctgctatgttgcaggttaacttactggctcttcgcatacggtggctattccggagacttgtcacccgaatccacactagagctgttgagaaatgatgacaaagccgtacttattgatgttcggtctgaggcaagagattgtaaatctcactggcctattctttctttgatgtccgttttcatcttttatatccggtccatgatatattctgcaaaccgtagaaaagataatattgtttgttagccacctacatgcctttgccaatgtagaacagtttgttcctgccaagccattcagtacaaacatttttagtactgtagcactacaactctttgatgcgtttcctctagagcatgagaatataagcttacatgcagatgtacctgaacttcaagtgtttgattcatcattagtatttcaaaagcaactgtaacagcttatcatggaatcctttttgtaggacttgagagtgaaagatggaattccggatctacgccgtgcagctagatctaaatatgcaactgctgcttcacctgaggtgtgtctttgtttgaacttggagatctgaagtgctaccagccattgattgctggacagtttatatgtctacttaacctgaactcagttccaattttttatgtatatccgtgaggattgaagtgtatgcaatgagttctttttgttggaataatgttaggagttgttttcattctagaaaaagaaaactgagaagtaaacttatgcaactctagcagcagtcagccatttcaatttcaaacgggtgagagtacaaaactgattttgcttactgatattaagttcacatatttttctttagattaaaggttcagtaaagaggctacttaaaagtggaagagatgttgatgatgcgttgctcgcagttatcatccgcaacttgaagttggtcaaagtatgatgtttgcctgaacttggatttgatatcttcagtctaagatttcttcaaaataagtgaagtatgttttcaatcttcttttatagggtgattcaaaggttataattatggatgctaatgggagccgatcaaaggccattgctaggttactgaagaagcttggtgtgcaggtaagttccaatgcagtttctcccaaaaatatttcattttcactgatccgagtcctgcctaaatttgactgttttgatggcagcgaccttaccttgttaaaggtggtttccaatcttgggcaaagaaccttcgagtgaaagaattgaaacctgagaccgcattaacagtaataaatgaggtaaaaattcagacaaaaacctcatgtttgaatgaaaagaagcgtataaggttttggtcacaatttttctttgttcctttccaaaaatttgtatgtatcagcgttgaatactacgtagaggtagcactttttgttatcactatgtactattaacgtcgaaaactcacaatattgttttgaatgtatgcaggacgcagaggaaatccttgaagacataaagcccactccaacacttgtccttggatctctcctggtacataaacatcaattggtctccttttactttcttttgcctctgttggcagtcggcacactgtcctgtttctctttgattattggttccattatatttttttaagaatggttcttttaaaagttgtactgaatcacgacatttctccctttgtgcatttgaagccttacgtgcaatatttcttcctttctaaatttggttcttttgtgcagggcctctcagcagcagcgtacgctttgctaggtaagaggggtaggaaagcattaagtgtggttattgcattgctttgctatacattaaatatattgcaagtcatatgattttcagaacagtatgttctcttgtcagagataagggctctttcatattctctctcttttttattttgtcctgctctttggagctcctaatggtctataggattcacagttatgcaaaaagaggacaggtttttaatctctctcttttttttgggcgggctggccgaaggaggccgagtaatttcattaagatttggaagagtacaagttacagaaaaacagcaacagaacgctgttgaaaatagtaaatttttaatctcagtgtcagtttatcaacagaaagcgatgctgcattcacaagtatgatattttagggaatttgagaaggcatttcttagtggagtgtttgcaggtcgctttaaacaccattttgaataattcataccctgggaagcttactggattactaggagtcatgattgtttttatttgtcattttacctaaatgtgcataattgatctttttgactggatgcccatcatgggtatgtgctattgaacttttataacctagttaggaaaagcagctataattcaaccgtttcaaacttgtattcattttgaatatgcgattaattgatattgataaacaactgcagaatgggaaacgactctgcaatacataggtgttctaagccttggtctggtaagtattttccattttcaaactgtcggtacatatcatatattcttctgttcaattgcctggaaagtaaagcaatacagctttgtgccttttatattactactcactccgatccaaatatcatggcaagcggaaacaacacagtttacatgacattcttctactcttgtagactatctatctgcgattctctacgtacgagggttcagaggatctggagcaagatctaaagtaagtcatcctagtatcatccgttctcgtggtgtgcttcttttctgtagtacaaatttacagctcaggtgctcgaaacctgccatttttccaacacatgacaaaaaaaaaaaaccattgcaaatttacaagttccccttactcctctccttgtgattgcctagactgctgctttccccgttaagagtaggcgcggaggcgttctcgtgggcggccaagaagctggagccaagcaagattggcttggcgacttccccctccacgacggcggtccaagaccgggttctccaggccgccgcgaagcacgagtcgcagccgtctgacgccgaggcagacagtttggtctctgaagcgtgagagtttcaggtttcagtggccaatgtgatcccaatctgtgcagctgagtgaaagtcgttagccagtagctacacgcccagtaaattctgtggaaaaatttgatgttttctcatgtagttgattgatctgagctactgtgagcagccgtggtgatgaaccggcactgtaaatttttataagcagcgttcaacaataatgaacacatgttagcacaagatgatgttaatgttgtttcacttctatgtggagttgatccgtggggcccatggtccagacagtactgtactgtagtctgtagattgatccatagcgttgttctgacaagctccacatcagaagcattttttaccatcgtagattaaattttacaaatctatagatatttgaacaacctttttctatggatatctttcgatttctggtctgccagagataaaaaacacagaaaactgcaagaacggggattcgatcctaggaccaactggtcgcacgcatcacgactcaaccaagtgagcagttatccaaacttgaattaaaacaaaaattacacattacttaaactgtaattacatagaaattacgctgtaattacatataacttacactgtaattacatttgaaagtttttttctaaaaaatctgtcgccagaattttagatagtccctttgaacaatctatcacaatttacagaattaagaaactacagatttaagaaagtgtatataagaaaatttatcacaaaactatatatttaaggaatcataatagaaacatatagatttaacattggttttatcacaaaactataactttgataatctcaatagtgctatggatatagactctaaaatctgcagttgtttgacaactttattattaaatatgtagttgtgatatgatgttttaaatttatagctttgtgataaatttcacgctaaatttgttgatttatgatacccatttttaattatatagttttgtaaaatttacttgaaatttattaatcaatgaactaaattactccctcgagtgaaaaatttttggcgctgggatagctaaaacatcaacatcaaatgaactgtgatgacaaatacttgacgttgggagaattgaggccggagagtatgcctaatacatttgcatcaggaattcaggacacatacagaaatacagtgctgcaaaaaaaaaaaagaatgaaagaaagaaagag

SEQ ID NO: 59327 - DNA, 18565 bp, Oryza sativa
aaattattttctgctgtgatattatttactgagtttcttccattctccagtaccatacggcagcagttgatcagcactgaggatataaggcgcattcgtaaaaaggctccatgtacccgttccgaaatatggatgatcgagaaaggttccttagaagatgatatattccatgagcccatcttttcctgtaagctacttaaattggtttttattctctgcttcctctttacacatttactgtatgttcaattcaattaggaaagaactgaaacagaagtgaaattagttttgatatatgaggataattagtggttagttttatgctctgaaattctactgatgcatgtttgtgttcccaactaggcatgtgcaaggagctaaacgatttgcaatatcggacctatgagattgttgctcatcccaccattcataatatggaaatacatgtacggctagacatgtcccaaactatggcagatggcagcaatgatgttggcacctctggcgcaaaggacagtggaaatcaccaagatcatgtagtgctaccagatggagctgagtcagatgcgatgcatcctgaagcaactgatgcagcagatactagaactgattttgattcacacatgccatctgacaaacaggttaacaatgttgaaggagtaactgaacaattaactgataatgagaaagaaactgcagttgttgagaaagcaaccactaatatgggtgacagtgctcaagttgattcacttgataaggaatatcttcaagatgttccagctgatctgcagaggagcacaaatacaaatacacctctgtttgtgctagatgacatgcctggtccagatgtggttctggatagctctgatccagtttctgcacaagcagtggatgatatgaaaggggagttgagtgacattgtccatgacaatgtcaatgcatttgacaataaggatatgccgacttctgagattaccgtactggaatttactcaaaacgcttctggttttcctcagccaacagaggatgaaaatgttctgtccgcaatgggtgaaaattctggattgcaagaaaatcatgtaggatctgttatggatctggacaatatggggcatgacttttcactaaaggaatgcagtgtaagtccatatagaagtttccacttgtcttcagacacttgtcagatgacttgtgtttctcttaattccacaatgtagcatgctatacagtacttgcactattttattcagtcgttatttgaagtccatggcataattggtatgctgttcacattgcaggattttggcagtgcgattcagggtgttgacacaggtattgccttttgttctgatacataagtgtaaactagtgtagtagtgttctaatataatgtggattatgtgtacaatgctttgtaggtgcagcagaaaactagctaaatacccatgcacagattttctaataaatatatcatcagttcgaaactcaaaaagtgagcatatttatcctgagaatcatatgtaatttgcaagacgcatattacaatgtcaaaataaaaacaatcttattacaagacgcatgctcagatattctaattattcacagaagggtcaggctgactcaagaagtggcggtgggatttcagactcaccataaccaccattcctaggttcttttgtattagtagaaataaacatgacattaaccttcatgactagtgcaatatccgttcttaattgtattttatatgcaaattttgtgatgggaacttccacacgcccgtatgtgacactggtggatcttactgttctagtgttgcatcgcgagaggtttataagttttatgacttgtgtcatatttgtactctacactttcagattttctgatgtatgatgatgaggtggactgtgatgaggctaatgatgatgagcctaatcctgaggaattccagtctcttgataacagtggatggtcttcacgtactaggtacgattggatttcgtgataatattctcagggtttaatgctcaatatttttttgagttctataatgagttgttacaattgctcttcaggggtgttgcaagatatctcaaaactttatttgatgaggaatctggtctgggaagaaagagtgtggccattgatcatctgttaagtggaaagactaggaaagaagcatcaaggatgttttttgagacattggtaagacggttatgcttttctgtttctccactcaagaaatggaatacctaccttcagctccagtgtgattggaggcacctagaattgcatgatcaagaatacgccattcattttatattgcatgtttcgattagccatcttctcattagacaatcttactggcatcaaccaatttctgtagtcattgtcaaactagacctgcaatggtagcttaaattgttttctcgaatcatttctgttgacattatccttggtacttattgtgttctgttccattcacaggttctgacaacaaaggacttcataagtgtggatcaaccaaactcctttgattttgtcagcgttaagccagggccaaagctcctgaagtcagatttctagatcaaaaaccagctagcgtggcgcgatacatacaatcttaccatatctgtcacattaccaacaacatacagatctcgcatcgccgtgaccgtcatttttgttttgttctttttaatttatcctccctctgtagtatccccgcactaatctgtgtttactaggcttcttgggtaggattctgttgtacccccctccgtgttggctattcagtgtatatatgattagctcttgtaaagttgcttgtgtaatgtgatagcatcagctcctaagtccccgtctattgttgctttgaataaaccttcaaacctgtatacttctctgactttgagcaacctgtcgattaatttcaaatttattcagattcgtaggtcaatcgtgagaaaagagataacctttttttgtttgttttgcctgaagtggaggggaaaggttgctcaaaattctgtattggtattatatcattacaaccactctgctggtgatccgagtcaccagcatgaacgtctgagtgaccattgagcaatgtggggcgtgtgattaaagcagctttgatccctttctagcacatacgtaaagtgacacgctgctgtgtgctctcgctattcgcagaaaatgtaaaagcatcagcaaatgcaagacagaattggcagagaataaggtgtttggaaaatggaaattcttggaaggatgacaagtattaatcgacggccaaaaggacaggggaaagccgaccagaaatgaagaacggagcagcgaatgtcggtgccgaaattgtttttatctgcacggttagcacagggttttcgtgtcgcgcgtctcactagctcactgctcatgaaagactgaagtgaagcctagcaagcattgccacctgacgagtgacgaccatactttgatcgatggatggatgtatgggcgccgcaaggcagtttgtcccattgtccggcattgctgccgattcctttgcctcgtgcgcgcggcatcctccaccaacaacgtccgcacgaattccacgcccaaacaccggcaattcccgtgcaaaatcacgcgacacatctccgcgaactcaacgccacgcacgcgcgcggacgcaaagccgcgcgcgcgagccacgccgttgccttgccaccacggcgattttcatggcgtcgtgcgcgcgagatgccgagatccgcctcgcgtgcccagcgccatcctgtcggctacagtacgccgatcagtggagttcccatgggttgatcagacggacggcgagcccgtgcgtgaacagtagggtgacaagccacacccagccagtcagccacacgaagtggcatatatctcgagctatagcctgacctgacctgctgtttagcttgttactacctgtagcgcctcggctctcaccaagcaagtgtcggtgcattgtttttttttcccttcttcctctctcaaaatataagagtttttatccagatgtgacatatcatagcacaacgaatctagacagagattatatcccgatttattgtattaggatatgtcacatctaataaaaaaatcttatatttatagacggaaggagtacctgttattcattaccattagtagtacaactcgattggttattatttcttccatgagaaatgtcctatatatatagctagtttggaaaatgtttgcttaaattggaaatatgagattagcttaattatgtgatcaaaatcgatgccctttgatctagaggtgtatatatatgtacatatgtgtaagcatgattaggcgaagaaagttcaagtgtgaggtgtaacctgttatcttattcggcggatgcatgaggcgcacatggcatgtgacgccgtacgccgatgttggttgatgcacactagcatggatgatgtgtgcattgtcctcattcctcctccattatatggctagctcttcacaatgattaacaaataattaagctataagcacgtccctcgtctctcaattccttccgatctgagcattttgtcaccacttccctgttccgtctaatttaatgacctaatccaagaccgtatctgggttagaaaccaacaatctcaacgtttcctctcaccttaaaagggtactagtacaacgatgtaaaattgtggtactactacctcttttcctgtcgtcaaaagggagatttttacattaattcccttctcctgtcgatcatccaactcatcaactacttttgacctaatattttccctttttttctctctttttttttccaatgtgcttgcattacatgattacatccatgaaggttgggctgtctgtacggcactcattcattcgttcctctcacaaacactgaagcctgaaaacgattgagaagcaacacaagctactcctagctaggaaggcatgcagacctaacataatccagcatcacttagtgggtctaataaaaaagaaacaaatccaacaagcaaacaaccatgcataacaaaatgctcattgccaccacaactgctctaatctcactgtctctctctttctctcctttctgcactctgtttgcttacaacacaagaagaggaggagggtttcggttcagcagtcggcatcaggctccatgcagagacatggatggatccatccactgtgaaaagggtagtatcgctttgtgattaaagagagcaggaacaaaagggcctgcgaaagctggcccagaaagtgccgatcgaatagattctgtcattaccagcagcggagtatcttcctgcagacatctcacatttgcatgccttctctggaaaagggcacgcgagtttgcatcgtcactgaacagctcgaggtttaccaaaccgttttgagtagggttatcgtcacctacggttttacggttatcgtggtaaccacgtggttatcgcggtaaccacgcggttatcacgatactttggttttaaaaattgaaaaggtggttttgtaaactctgcacagctcataacattgctggcttctccagcctctagtgtcgttgtcaacaagaacaacgaggttgattctgatttctgaaatgtgaagttgggtagtaacagcgaatcagcgatctgacatgcttgctcacttccatggtgattttctgagccaaaaaagagtgaactggaagacagagcgcccaatgcaaatagttgcagttttccgcgtagttaagagggtgtttgggaactagggactaaactttatccccactttagtccctccaaccagacaccacctaaattctgttgtgggggaacctagaggagcaagcaggagtgactcgtgagcaccgaaggttccaatgtaccagagttgcatgcatcggccggcgtccagaagcaaagacgatcgatcggctagaaaaattgaagttcaccgaaaccgatggccgttccatccaccacccggagcgccagaatttttcgtggttagcaccgtgaagaaaaaaaggagaagaaaacagtcacacggcgcagagcgacatgcgtccactcccccggcccgcggtgctctgcacctctgctcggcttcggcgaaggaagtcgcggtcggtcggttgccgccccacgtcgatcgcgcggagaaagaggcggaatcgcacggagaaattgcctccggatcacggtgttctcctcctgccccatcccgcacgcgcgcgtcgcgtcgcccagttggttcggttgatcacctgttggatgcggtgcggtttggtgagttggcctcgcgcgcatgagttgcatcgcacgcgcgttggctgacctagtgacctgacctgctgcgcgcgtgccatcgacttggtagcagttagctactactccgtgcgccgtgcatgcacgccaaggaataatgcatagggaagggaagggaagggaaggctgcaggctgtttgcggtgtattccctctgtccctataaaatatgaatctaggatcaaatatatttagatttatagtttaaaatatgtaatgtaggttagttttttttaaaacggaggaaatatgttttagacctaacgaagtataatagactgtaccggccggccggccctgcagctcacgaattgtactagtacgtgacatacgtgacaggaaagagatctacactccgtatatcgatatcataccaatcgtacacaggtaaaaattctgtatagtagattagtactactaccgagtagtctagtacatggtgccgtcctgcggatcgagcacggcactcgtcaacgtttatctcgagtccacatcgatatttctgacacaccaagcatagagcttactaatttaattactggtctctaggtgcagagacacagatcgatggagattaatccgtctgacctccgcggatcgatcggccttcgcgtacgacgcagcgaggagagaatcacacgggaaacttctgcggatgacggcatttcttccgtgagctaggctccggcaacagcaagtcggcaacagtgttaaactactcgttatacagtacacaacgggagtgagccaagtgaaggctgtgcctatccaccgccttgcagatcgatcgatcgatcgatcgaacgcggttaatttgtactcaagcctccaggtttacctgcagtctactactacgagaccgcatctgacaaagactagtactgtacgagcttactttactcatctcgaggctgcaaacttaacctctgagggacagaaagatagcagcgattagtttagtactagtactactccatagcaaagctaatactgcaacagtaatagtataatcaactagtgctaataatgcaccgtgctgatgatgtcacccagattagcctagctgaataattttccgtcatattatctgaacgccacgcaacgtgtcccgtcgacgcctgcgtagtacacacacaagacaagacagctctctcaggtcgccatggcgatcaccggccatggccatcatcggtctcttgactctcgagcagccgacatggctatgcacagcacagcacacagtgtcactgatctgtttgaaatttgtacgtacgtgcagtgccattgggtgtgtacgttgctgcaattaacggtcgggagtcaaaggcgagaagaagaagaagaagaagaagaagcgagaaaagccatctgacaaagacgatgatactgctgctttaggtgagtaaacccacatcattaagcagcttaatgaatgctctatctaacatgattattatctcatctcgtggcctgataaagtgagagacgaaagtcacatatactactagcagtattatgtgtgcgtgtcagtgtcaagagttatcatgctttagccggtaagagtggctatcttcgctagctacatgtatgcaagtatcatcaagctaatagagtttatatatattgctctagctagctggtccgtcaggtaggtcaagtgtcccaagcgtacgtacgccatagatgtgctcgtgcggcgaggtcgacgcacggccgtgtcgcgctccatcgttattatagatgcaccatcatatctctcgtctatttctccggcgatatgatgcgaccaccatcatcgagccccatatttccatcagattaagcagaccaaggcagcctgatgaacttgattagaggcaattacaaatttatcactgctttgaatcgttattgtaagactgccactagaaaattataaaagtactactagaactgtcattcaaatgacatccttacaaaattaaaaataaatgatagtaaatttgcaaatgtcccgattgattaggagtactaagtaacatcagaatttctgtacgtgctactgtgcatagctacactactgccttggtcattcactcattcacaatgcaattaaaagagtacttttccatattaaaataaattaacttcatatcagacatgataattctactactacgaatctaactaataaacacgactcgtcctagggttgtgttcgcttgaggaggatagaaatgcgcacggaaaatggagtagtccattagcgcgcgattaaataagtactagctattttttttttctaaaagtggatcaatatgaatttttaaacaactttcgtatagaaactttaaaaaaacgtaccgtttaacggtttgaaaaacgtgcgcgtggaaaacgagacgggagtcttgcaaacacagcctaggtttatttaacggcgccccgacctgcctcctccggtcctgcacggtagcctggtatgcacgggcacggcaattcaatgcacgcatccataatagatcgatcgccggcgcgggccacgcacgcacggcggcggcgtttacgccatatactacctcgagtgaaggtggaagaatcgcgtacatggggatcggatcgcctggatggtttgtgaaatccacgggagagtacgtactctatctactgtacagaccgcgacgccgacgcgtccgggctttttggcattggcaggcggacgcacgcagacgcagggcatgggttgatggagtacgtgagattcacacgcagacgcacgcggctccggcctttttttctcacgcgtcccacgttggggggctctgggacgttggactgccaacggatcccttctgtgccgcttgtgatggctgactgccgaggttttcattgccagtaacatctcactcacacactgcagtcgctgattaaatttacccaaaatttactacgagtactacagtaccacgacgactaataacaagtggaccagcaaggaccgtacaatgtaaatggagggggtaaaatcttgagtaattagatgaagaggagtggctatagctcgtggagtagtgtatgtgactggaccattgtatcatatcatccagtaacaaaaaaaaggaccatccggtttgtttgagtgtttcctcacgaactcgatggatccagccacagtcaaagctttcggctttcgtttgcatgcatgcatgcttgctcgatcgatcagctcgctacttactggataccaacacgtctcatgtgtctgccctgatttctagccggctgtttcttcgtaccctagctggaaatcagatgagctcatcatcctcaccgactaattatactcgcttccatcgcacatcaatttgcggcgacgatctgaaactgaaagtaccaattaattaacaacctatacatcatttatatgagtatattcctacgtgtgattgcatatttgtatatatattcagttgctaactcagaacgcaagcacgcttctagccaacaaaccgaaagaacacctaacatttggagacatctgaaccaaaaacgagctcaattttttacactccttaatatatataccactgatcattcagtccccactctaaattatatatataaaaaaacagttcttttcagagtacaaaatacagttgagttactagtagcattctgctcgtgcttgtgcttctccttccacactttgcctatgctctctcacttgtcttgcactcttctccaactaccctcttcatctccacattattaaacagcccaaaaaacggacaaagaatgagaacaaaaccaagcaagccatcaaccaccacctctctccctctccctaattaatatcttcacccttcactaatcacctaccctcatagtgacccttacttagctaattgcctaatcacaattagaaaaagaaacaaaaaaagcaaaaaaaaaatcatcaaaaagcagccaaaatactcctcctccatgtaagctgtatccaccacgacgacgtccactcctcttcttcctcctctcctcctctctctctcttctttctctctcctcgcgagatctgtggcgtcactgacctagcttgttcttgctagctgctgctgctgcttcggcggtggcggtgtgtgtggcaatgccgtctctccggcgattcttggagttggtggtggttgggattgttgtgtgtggtgtcaatggcgggagtgatggtttggaggttgcggtggcgaggaggcagctgcaccagccgttcttcccggatcagtcgtcgtcgccgccgacgccggcgccgcccggccccgctccgccgttcttcccggcgctgccggtgccgccgccgccgccggcgacggcggggcaggagcagccgacgtaccccgccctcgtgctgcccaacaccggcgccggtggcgcggcggcgacggccgctccggatggaggtggtggtggtggtggtggtgcgagtaagtccaagagcagcgcgtcgaagcttgtccctgcgattgtgctgccgctgctcacggtggccgtgctcgggctgtccatcgcgttcttcttcacgcaccggcgtgggaatgcggcgcgcgggggaggaggaggcggcgggtgcgtcggtggcggggacgccaagttcttgcacccggagagggcgagcctcttcgcgcgcgacgagttcggcgggagcggcggcgccgccgcgccgccggccgcggcgatggattaccgctacgtggggaacgccggcatcgggcggatggacgagaagagcagcgagacgacgtcgtcgggcgacgaggcgtcccggagcaccggcggatcgccggagctccgcccgctgccgccgctgctggcgcggcaatgcgggccgatgggcgcgaggagccccggcagcggcgtcggcgggttcgcgtcgccgtcgtccggcgacgaggaattctactcgccgcaaggatcatccaagatgtcgacctcgcacagaacgctcgccgccgcggtcgaagccgctgtggccgcgcgcgaccgctccaagagcccctcgcccggctcgatcgtgagcacgccgtcgtacccgtcctcgcccggcgcgacgatgtccccggcgcccgcctcgccgcctctcttctccagccccggccagtcgggccgccgctccgtcaagtcaagatccgatagcgtgcgcaccttcggccaaccaccggcgcctccaccaccacctcccttcgcgccgacgctgccaccgccgcctccgcctcgccggaaaccgccgtcgccatcaccgccctcctccccactcatcgagaacacgtcggcgctcagatccaccaccaccaccgacaccaccatcccaagaaacccattcgtacaaccaccacccccaccgacacacacccacggaccaccaccgccgccgccgccgccgcctccgccgccggtgggctactgggagagccgcgtgcggaagcctggcaccggaacgtccaaagaaacccggtccccggcgctgtcgccgccgccgcaggccgccagcttcaagagcggtctacccaccgacgcgttccccggccgcctcgcggacaatgcggaccacgccgccgccgccgcggccggcggcggcggcgacaagtcggaggagacgacgccgcggccgaagctgaagccgctgcactgggacaaggtccgggcaagctccgaccgcgtcatggtgtgggatcagctcaaatccagctcgttccagtgagaactccacccaaattcacaaccttattcagttcttgatctgtttttctttttgtctaaatcattttgtggtgaattctttgcagggtgaatgaggagatgatcgagacattgttcatctgcaatccggcgaactcggcgccaccgaaggagccagcaacgaggaggccggtgctgccgacgcccaagacggacaacaaggtgcttgatccaaagaagtcgcagaacatcgccatcttgctgcgagctctgaatgtatccaaggagcaggtctgcgacgcgctctgcgaaggtgaagaacatgatctttctcttaacttactcatcacaattttgccagtttctgatgaactgcatactgcattgagttggggatttttttgagatgtttgcagcagtatctgaattgatgataccttctaactaattggattcatttttctcgtggttcttggttgaacacacatggagcttgtgaatcgagatgtttgtccgtagaatttggttgggctttaaatacattgtctgaagaagtgaatgccagcatacacccgttggtggtcgttgctgaatttagccgtttttaagctgaaactgactagtaattgcttctggatgactgaattaggtgcatagagttatacctgcggtgaagatggttagagataccattgttctgatgtgaaaaccagtctttcgatctactagtattactaccgtagttgcttgatatagtattactacttctctgcacatagtcttgacttgggtgcaaataattgcaagatagttgcattattgcaccaagtttctagtcaagtcaatgagattgatccttcctatagtattatccttactaacgtggtaccaattcactgagcaggtaacacagagaactttggagcagaattgttggagaccttgctaaagatggctcctaccaaggaagaggagatcaaattgagagaattcaaagaggagacatctcctattaagcttggtcctgctgagaaattccttaaggcagtccttgatatcccatttgctttcaaaagagtagacgcaatgctttacattgctaactttgaatcagaggttaattacctgaagaagtcctttgagacccttgaggtgagaattatcgtttccgagtttcctttcatacttattattatattgacatcttacctataactaagtacatgaaacttttcttaacagactgcttgtgacgagcttagaaacagcaggctgtttctgaagctacttgaagctgtcctgaagactggcaacaggatgaatgttggaacaaatcgcggcgatgcacacgcgttcaagcttgatactctactcaaattggttgatgtcaaaggcactgatggcaagactacacttttgcattttgtcgtgcaggagattatccgaacggagggctcccacctctctgctagcaaccaatcaactccacgaactcaggcaaaccctttacgggacgagctcgagtgcaaaaagcttggcctccaggtagtggctggcctcggaaacgagctcagcaatgtcaagaaggcagctgccatggactccgacgtgctaagcagctatgtctcgaaacttgctggaggaatagagaagatcactgaggtgttgcggttgaatgaagaagtcaagtccagggaagatgcatggaggttccatgattcaatgcagaagttcttgaagagggctgatgacgacatcatcagggttcaggctcaggagagcgttgcgctatcacttgtgaaggagatcaccgagtacttccatggtgactctgcgaaagaggaagctcaccctttcaggatcttcatggtggtcagggatttcctctcagttcttgatcaagtctgcaaggaagttggcaggatcaatgaccgcacgatcgctagctcggtgcgccatttcccagtacccgtcaacccaatgatgccacagttgttccccaggattcatgctttgagagctggaatctcagatgatgaaagttcagccacttcagcatcatcaccttgatcaccagtagtctgccaatagaaatttttcgcagagtactgtgggaaacctccatagggcagagggagaccaacggcgacggggtgtcaaatttttttttgaaccttttgtacctgtagattatagaatgtaagaagtttttttgcaaatatttatttctatatataagaggagataaaatctagatcagaggaggaaataagcagttcatgtgtttgtcatcttcagtctgtacatgacacgaggtagtgaaacagcctgtacaatgtactaacaatttcaagtatggccagtctgcagaattcaaaggtaagctgaactcagatgtacttggaacagaaaacaaaatacattgaatcctagtgctggactgctggtggtgccaagaagaaagaatcgattgtgttttgtcaccatctttcctgcacaaatggtccataccacatacatacaaccatagactttacctgacaatttcatcattttacagtaaaagaacctctcaattacttcatactctgttcagttcagaaatttcactgacgctcaactcagaggctgacattctgaagccatggaaggctcaagtaatggctggattttcttacattctaacccgtttcaaaaaacttatttcacatgtagactccccaaaaaaattatcacaaaaatagacctagaactcaatgccagagtcctcggctcgatgatggacgtctcaatgccattctcgttgacgctgaggatttgggccagtctccatgcaacagatctcccgcaccatcatcaccatattcaagtctttgatgttaaaaatataaaaaggcaaataaatcatgatttatcaaatttccccacaaatttgacaacctaataacaaattaaggaaagtaaatcaagatacattgattcatcaattttccatgaaatttgacaccaaatcaaataatagggctcggagaggatgtggagaagagaggaaagttgttcataggtgacaaagggtcggcgccaaacaaactagcactgaccctcgagtttcatcgccaggatctttggcgcggaaacattccacttcggtccaatagccttggcgccaaattatgggtctattttacaataattttttttaaaaagtctatttaccaaatatgtttcaaaaaatgaccaaattgtaaaaaaaaaaaaccagcaagtaatggttcaatcaacttcccattttgagcatttaaacatacataatgcctgtagcttaactaactgaacatttcattttccatgtgagctagaattcccatggcttcatggcatgcatagtagaagtagtactccggggagagagagagactcaggcctcgtttagttctcaactttttcttcaaaccttaaacttttccatcacatcaaaacttttctacatacataaacttctaacttttccatcacatcgttctaatttcaaccaaacttccaattttagtataaactaaacacaccctcagactctcagagacggtggtttgggtggcagctttcgttaggtccccatccccatgtgagggtgacaaccatgccttgtagccatgcccacaaaacgttgtggcatggcgccccctttcctaccaaactctttccttgccattttgcaaaccccacatggctcactttgtctcctacaccttgtggattctcttctctaatggactcaaatcattggaccccaaagccaagaaaaaagctctttgttttggcctccaaacacacacacatggatcaatttggctgcaaatgagatgcatatgttcgtcagagactatgattaaagaactatgagcatgctaaggagaggaagcaagaaatagtcagaggtgatcagggtttgcatttcctttttgaaaataaacacgcttctcaccatttactgaaaaccgataaaaactagcaaaaaccaacaacttttggtaatgccatacgaaaaccagctaagattggtttccacaaaccatccattagcggtttcacgaaaaccgatctgttttatgaatcttggaggtgatactaggtcttagattagtggtagcagttgggagttggaaggtagagaggacccggccatggcaatctactggggtagaaaagattctgaattttggaaggagagaacaactgaacaagcaaaagaggatgaatgacaggtactgagtactagtatgatttggagatgtgctactcaattcttgcaatgacgctaaaccttttaaatattcctccgctacatcagtctcatgagttgcatgtgcaaactactgttagtaacaatatcaatgatgtcttatgaatgtgctgtgattgcactgtccatgaaagttaagcactctgaactctgaaggctttttgctgtgagctcttcaccggttgtgaatgatgtgtgcacaaaccataaatcagaaatcaactagagtagtaacatccagtaatatgtttattttttttcttcagaaacttcttaatcggggatatgagcctgacaggttacaaagatgtcaggtacttgaacagaaaacaaaggctgctaattaacttattttttgctgcttcagtccaagcagagctccttcaaaagaggcaattgatccttcagcctgaatctacctctacttgatctagctactactactttgcttttcacaagtagaaagcaaggcagcttctgcaccacatggcattcctgataaaatcagggatgctaacacaagaaaaggtggcatctttatcgtctaatcagaataattacgtacttgaaaatgttcctccattgtactaccatgcaatgcaaaattgcaaagaagaaaaaaaatgctttggcctgtcacgtgaggaggaattgcccacgaatcaaagctttttcatgcaccatggttctcacttttcgcaaagaagaaagttgcaaggtgtgatgccttgtttacgtaatctttaaagggaggcgtgtctcctgaacgggctcccgttcttcttcagatcagaatatataccagatcgagctatttctctgagatgctctgagaaaggttcaggtttgtgcatgaaccagagcaaaggaagccaaaaacaagatgcaagagagtaataaaaaagaagaggacatcttgggcctgcaaatggaggtgatcactggacctaaccagttgacaagaggccctaaatgaattagttattgcaggccgagtgtcacactgtcactgatggatcagatcattgactagtttcacacaattgacatctaagcacaaaagaaagaggcaaggaaatgagagcagaagaaaaaaaatgtttagaaaaatatcaaatagggatggctgcggtggcttaaccttcatggattcttgtcaggcctactctagttcaaccaaatgaactaaaattcatactgccttttacattggttagttcaaatatgagctaaccatcagaaatttcagaacagagagagtacttcgtagccagtgttgtgtatttatactttatttggttaaaaaccagagtggctcaacaggtagagtccatccctgtagcaacccctctacagaaacagaaagagtataaccaacaattctaagagtgccagcatcagagtacatctgaaagctctgaacagctaggcccttgcaacggcctgattcctgctcctgacgctaccatcatcaaaatccaaagcagcaatgcaacggcatgaagctccatataaagtgacgagagaaccattgcaattttgcaaaggggccatgctcttgatgagtatccgtagattcttgttgacagaataaagaggcaaatcctacaacagataggcccctgaacagaaaagaaagtgaaggggccaatagcttctatacaggttccatggggggcaataatggcaggtcactttgtccttcaccaaccatcagtccatcatcagtgacctaacagagaagacctcggcccaccatcatttaaagataaagggatattcagagactagaatgttaaacacaaacttttacagttttactacactggtaattgcttactggggcctactgaaggacaaccaaagactgatacaacagcagcagcaaagaagcatggagattataagcgtgagggctgtaaacatgagtgtttggcattgattcagattttattggtatgggcaaacctctgaatttgatcaatgacaaactaaatagcacatctgagatgtatatcaatataagatacactattatgatgatgaatagatacactacatatatcaatataagatacaacaacagcagaaacgattactgtgtaatgttcctttactttcttcagaacctcgtagttaatgtcagctttgttgtcagcgtcatcgccctttaagaagcgcgagacccaccggaccgctgctctgggatgccgggaaag

SEQ ID NO: 59328 - DNA, 19844 bp, Oryza sativa
tgatgagtacttcttcaatattgtatctgcagtcagcattaatgtgttttaaatgaactgcagtacaattaccaaaactggcatattaaaacaaaaactcataaaagcagaattagcttatccatgtaggtgagatcttaagacataatcacagctttgcatactaactttaccaaaaaaaactggtcaactgcatccagaacatgtacaaaaacagacttcaaggatattaaaaagtaccattttaagagtcaaagggaaaacgtacctgcatatttgaagaaaaatgacgataatatgccctgagcggcattgttgcaaataagaaacattgtggcctttgaatgcccttccagaatattaaagctactaggacctggacgaaattacataataagtgatctttatagcaccgagtaatgcatgacacaaaagaaaagtgcatagctatagtggcatcgtagaagtcaaatggttgatacatatgtacaagaggacatttcagagaaaacacagttaaggtacaagatttcgttgcgcatattgtcatcctaaaagcatagttgattgaataattgtgacaaaatggaaagcaagaagaaagagattccattaattaaactattgaagcactttattatgatctattaaattgtagccataccgaggtgtaaagaactaaagatatatatcacaaaatgactgaattaaccaaataagtaccctatcaaaatccaagcaggcatagggctagtaattaaaagtaaagttattgacagcagatcacaacacataatttggaaactataatatgcaaaaaaaatgcatttcttatcatgagatataaattctcaacaattaccttggatgatggcagtgatcacaagccctaggaaattaaatattgcaccatatccatacagaaataagttctgtaaacatgatatgacagtcatgacccttgaaaaacaatagctttaggagatacaggctgatagtttagtacattatcattgagtagcacatggtgactgcaggataagtatgcatatggtcatacctgaagatatatactggtatcaaactggcttttcagagccttttcattgtaaactgaagccaatgcaggaactgttacctgattgcagaaaatgttagcatggaacattagattgtgttggctatttctgttatataggaaaaaaattgagcaatcaaatgaaattaagcttgtttccaatgtgaagtattcaaaagcaataatgtaatcccatgtgctgagaactactgtagctattttactctgtcagtttaccacaagttcttaatcctaccatgctacatatttttaactatatgtgaatcaataaaatgcaaaacactggttcaaagcacaacatataagagttcaagcattgtatcaataacccaaatgtctgctcgtctataactatatgcagataaagagcaggccagatatagcatcattgtatcgtaatctacggactaccagaaagccttgcttgagctgggcatgaaaatgaactctgaaaactaaaagttaacctaccttcccaaattacacagaagatacattagtctagtctaaacctacatgttaaatagagtagcacaccatgcactaatcagatataagaggatgaaaagaggtacaagaaaaacgaatgaacaaatgaaccaatagacagaacttacgaaaaataatgtgtataggtaggcaccagcagcaacaggaagaccaagtgtactagaaccttcaggcagtgatttgagctgattaaccgatataccaatcaacaaaagagcaagggcttcccactgtcaacacgccatagtatgatgtcaattacataaagtttgtggtgttgcaaaaatatttattaagagttagatattaatagatagatgtaaagaaaaacaggaagccaatcggcttaaataaaaaaccacatttggaccacctctacttttaaatcctgaaaaaaaagctcaaaactgattaacatgacaaatgataattaaaaaccaaacctacctgaattgtggagaaacgcctcctcattatcacctttaggagcacagcaatcaccagaacctacagaacaaatgtgtgatgaccaatacaatcaaaacgtaattcacatgttgccaaactccaaagaaatgatgaaaatcaactagaaaaatcacaaggttgggagttgggactattaggagcttaatagcttttctgaaaacaacatggacaagtgtgtgcgtgtgcacgtacatacatgtgtgggaggtgggtgaatgcaccaacgttgatgctatgtagctactacgacagtaagataatctttgaaaaaaaaaaagagggtataacataccttgagattacccaacattttcactgttgcaggattaaaatatagctgcacaagacaggatcaatggttagaagagctgcatcagattgaaggtaggcaaaagaaagatctcacagattggttcaaagaaagtcaagttcccacacggtctgtaattaagaggtctttatgatcctatacctgcattacaaacttcatgtaattgttgatagcatagaaaagagcaggaactgcaagaagaacattgttgcgagcagcctgccaagtgaagaagaataattatgatggcagaaaaaaatcactaacttcttgcaacaaatgggagcatatggccagtaagaagtaacacatgattaaaagatagctttctatgtaagttttaatgctttctgccaaatgacaagttgccccataatgtattcgcgtgcggtttatactgttaggcaatgaggattgactacctctcttcaaaataaatagtgagtacttcaactgtggggtttgcaagagaaatcaatatttgagatttagaccaggcaaggaatcacctgatccaatcagtaagcatggcatacttgatggttatattacctgcatgaatgttgaaactgtgagaaatggcttctctcccacctttaggcgcctggcctgcaaagggcagaaaccgatttgactaggatatccaagaattaatagaaacagaattctttagtaatcaaggttgcaatgaagttctaagacatgaaaaacaatcaatattccacttgcttagcagtacatgaagaaaatgcatcttgcagtcaccaataaacaagtataggaaacaaccgtataaacaaatacgcttaatggaacaatagaaggttttacatacctggatgcatagcatgatgatggcaaatataatttttgtaatctctgtcaagaagtttacactaactgggctaaatttgaacttcccatccactttacacatgtacaccaatataggctgcagaaaaagaggtagagatgcgtcaggcaacataagagttcataaagtggcaacagagtaatgacttagcaaacatttctatggatgtgctcagatggctaaataactcagcaacaagttgtgtttcaacagaatgttccaaagtttaagatctctagagatatctaataagcaatgaaaatgatggaatgataatgacagtagtaactagacattcattcttttcctagcagctagtatgtgtatctagacattaacattagctcaggaaagaatacaagtcatcaaaaccccaaataactactgcttgttcacgtacacagatcaatgaaaccgatcatggtgtgatgtgataatacataacactagacatttacatgacgctcattttaccagacatcagcacagtttaataacattaacacattcatagaaaaagtagtcacagactcatggctaattagtaagtttttgtttagcatgaactgtagctaaacaaatgcaacagaggcacaaactttggtaccattacagtttcactgagcagcaagctactaatcctaaatctaaatcctctcaattcattatctcacgcaatccaccaaaaccaattcagtccgcgcgcaacacctggcggcgattcgggaccaggcacgctgatcagaccaccaaaacccagtgcaggaagggggggggggtgaagcattatccacctgtaggccggcgaggacgcagtcgccggagacgaggaggacgttgagcgcgcgctgcctcgacgacacggagctccggtggatgtcgtacgccttcgacaccgccgccgccgccatcggcacctgcaccttcgcgtggcacactctgcattccacctccccgctcatctcccccaccgccgcctcccccaaaaccctacgattccgatctctcccgctacaaatcacccaaaaacatcagcaaaattcaccaaaaaaatcgagaaaaaaaacaaaacaaaataaaataaaatcagaacccgccctggccgggacgaactagggtggggggaaagggaggcgaggcgagagaacctatcctctggaggccaccatgggagggagctcgttgctgggccgaggtgggaggaggcgatcgcgattcgaagattctagaaggcgcgagtcggcgaggtggggggagacacggggagcggaggcccggagagggagaggagtgggaaaaaaaattatgtaaatataaaataaataattattcggaggaatatcccacgagaacgaaaggggaagggacttttatgtgaggttcgtgtgtttctaaaatggacccttgaattttactgattttcaaaatggtcctcgtagcatttttttttctccttttttttgggtgaggtttttgctgatttgggatggaatcaaaacccaggatatgtgtgatatccaagtgtcagtagagactttcggtttagagggaatgtttaatggctagtgctaatagatgagtattagctgttgtaaggtcttgttttgtcgagtgctggtggatgatggatgaaattcagtttatgtcaattgttggatgttataaatgaatgaattagatgttagagagttaagagtttgttttgtaaagttttgaagaaatggttatgaagaaagttgtcaaagagataataaacttttaggccttgtttgaataatgggttagggaaatgttttttcacccaccaaaaagcatctttaaatcctaaccatttattcttactcttccatttaatcctaacatttcattcatttccctatctcaatctcaccccttatttcccattgtccaaatatacccgtaggagcttaggaagtagccatgataataaaaaaaaatatcttaagctgaaaaggatgaaatttaaaaagcactaagtggtgaagaggattttgatgctacaccatattcgccatgattacaccattaggcatatcatctttctataaggtggataattagtatatcctcatggaatgttggaaatatataatttacgtttttctaatgtgggcaccaagcaattaccaaacagacaatattgtacgaatgtgttatactatagtgcattaccatatatgcattacagcataaaattcattagctgggtcgaaatacaaatctgtaaattgattttttttaaaaaaaatattaatgcgatcctttttcggaaggagagtttgttcgacccatccagcataaaaaaatcaaataagcaggaatgcaaaggtctaaactgacaattgccacggccctttctgcttgttcaccggtcaccaccatggacgagacttgctgagagaatcgccgatagagacgacaaagtggagacctcccagacatggagacctaacattccgaaactgccacctatcctcctcaatcaattcacagaaaacggggggtactaccggtatttcgccactgcacaggtgcagtcataccgaacaggtaggcaggattaaactcaacccgtttcatgcagttgtgagtttttatatctaacgtttgatcatctgtcttatttaaaaaatttatgaaaagtttaaaaataataaattactcataaaatattatttatgttttatcatttaataaatataaaaatattaaatataaaaaaataaataaaatagatagttaaatgttagacagaaattcacaactgaataggataggggagtatagagtatacacgacgcttggggatgcgtaatccagagtcaaggctccacatggaagcttcggaaatcatcgggacccatgcgcgcgccacgtgtccctgctaccagcactggcgactcctcaccgacaaaaaaacgagagcctcttccccctctgtacagttgtgaatacagtggttttctgtaaaactgcacaggaaatgctattgaatcttacaactacagcaaaaaggagatcttacattggaactttgttgttcttttttataaaaataaaacttagtagtagattaatgttggttggttgcttggtctgtttgggcagatattttaattcctaaatttaatcttaagagttgagtacgaagccaacttagcctgagttcggtagaacaggttgggaactaatctcctccgcacggaaaacggagcggtctattaacgcgtgactaattaagtatttgttattttttcaaaaatggattaatttgatttttttaagcaactttcgtatagaatttttttgtaaaaaaacacaccgtttagcagtttgaaaaacgtgcgcgcggaaaacgagggagacgggttgagaaaaggtggacccaaacacagccatagagcaaccagaatctaccgtcacctttttagttcaatttgtgataacacttcagcatattacagttctttttttttagctgaaactgtttggagaggtggaagttggaattctgcaaaacaagcccttaggtcctgtttggctcatgggatagggaaatcattttccacccactaaaagacatctttaaatcttaaccattcattctccatcttccatttaatcctaaccctcatttcccaatctcaatcccaccccacatttcccattatagtttgtggcttacccaatttttgctagagttttgagggtagttctgaaattaccaaaattttaataagattgtgttcgtactgatatgtgtttggtttgttgtcttgccaaatttttataatgttaaaaatgacaataaagtgaacacaccgtgaatctgacaataaactggatataagctctgaattgctaatagtaggatctgaattggataatttgtggatccaacaagttcatgcaacagtgttatcccagcagcataatccaatcaaatcttttaccagtctcaaactgaaagcattgagaatggggatacaggcatacaagttcagtagcatcacatggtagtactacacaatatcagcagctacagtttattgttagactgcatggataaatcatttttcggagcatactatctgcaaactttgcagtatagcagaatcttctacttcaaagcaaatgaaaattaaacagaatatcagaacaaagccatactgaaactgatccacccatggatcagccaaacccccgccccacccggtacagtacagcaattggtgctcctaaagatcatgacaagagcaaaaactagcaggtctcgcagttgcaaaccctgcaccatgcagagacctccatgaggaatgacaagcttctgatgccttcagaaaagctcggaccacggatcaccttgagttttcttgctgttccgtggggtgaccagtctcccctttgaagttttgcgaaataactgatcgatcgtgttgcctcgataacacgaggcataagcacctcatcagtgtatttgctcacctgacctcaaaaccatataagtgaaattcttcaacttcaaccaccttcatttcctcccgtcagtaggatagacattatgagatgaaccagcagacagccaaccaccagtccaccactaactgcagagtttcacagtgcatgccactgcctgagcccaatacttcagtctagccttcacttcctttgggtcatcacctataagaattcagaacctattgatcagcaaagaacagtatggctttcatagagtagatactattatagtttgccacacacatctcaatatcaaacatctcgattaaacggacagtacatctaatagctacagagaacatgcttaggtactgtttattttagaaataaaattttacattcttgataggaagaatagaatttcttcaaatttgtttttgagagaagaaacatgtgttggaaaggagagaagcataatttcctgtggggctactcttgctttgcttgcttgtgaagactgttttgcagaagacagttcgcacttactaagaaaagagacatcatgaacaaagcaaatctgtcttttatcttgagtgctctacctgagaatgtaagcattttttccttcatttcctatgctaaaacttccattatccctttcctgtatgtgtatcaattcagagaaccgtaactttctaaaaaaaattttagagaaccattgaatttacaacaaccaaaaggttggcacaatttgcagtcttgagtgtctaacatcctcatttctttatgaaacaaagcaaaagcaagcgaatctgattctctccgcctaaacaacttgtgctgtatgtggtacaagatgcaagcgtcatcaagacaacagaaatcctaactccactctcccccaccagagagagagagagagagagagagagagagagagagagagagagagagagaatgattgaatcaatatcctaagaataagggttgaatacaggatacaacaattggtattaactgtgcacgagaaagttggcaaattttcagcggatttccttaaagagctacaacaagctggtatccaaaacatatatccagctggaattgctgttataagtttgttataattattacaactgtgcatcagttgaatagagcaaaccatcaattcatatgcacagggcaatcaaaatcgaaattaggcatccagtaatctccaacaaaatccagggtgttcaatatagcctgtaaactgggcatcgattgtctgcaagcatgttgcttgaagcctactccattccgttatgaatatctcatatcttttattcattgcgagcatcagatttcaggatgtttattcattgttagtgccatcctatagcaaagccacttgttaaaaaaaacagtggtgtaatctacacaggattcaacgagcaatctaatggagaaacccacctgatataatattgcaaacatactctcatcctacctgggtagaacataggataatcaattctttcacgatcaactaagtctatactacttcgctacacatatctcaatatcaaacatctcacacttcaaatggaccaaaaaatccaagagatgcacttgatagtgcattggcaacgggtgtgtggtttcaacccaagttcccgtgttcaattctcgacacgctgacaatttgttcttaaaaaatgtttggagggacgtctctcccttcaaatctcgtttttcttttttggacccaaaaatccaaaccctgcatctgacatcccaaaaattcacctctaaacctctcaaatcatacagctccaacaaaacaacagaaaaaatcgatcacacaccttcacaaccaagaagtaatcaagtatatattcacacaatcccaaacctagaacattatcagaatcaaaatctgcacggggggaggggaaagctttaccggggccagagattctccagttggggagcggcggcgtggcgggcgactccggctcctgcccgggcgccctctgctcgtcgaggaacctccgcgtcatggagtagcagagctccagcgccgggagcgtcccgcacagctcggggatctcgtggtaggcgaacccgaacccgaggtcgaggcagcccttgagctcctccaggtcctcctccgtcaggctcctcgtcctccccaccgcccctccccctccgccgccgctcccggacgccgccgccgcctcgagcatcacgaagctgctccgccgccgctgctgctgccgcccgccggacttggcggcagccgtggcggggagctgcggctgcgaggagaagtaggcggcggtggtggtggagatggccgccattttttgctccgatgctctgcctgatcagggggggctatttataaagaggtaaaaaaaatatttcctggttaaaaaaattgctttaattaggtgacattttttttttggattagttttaggtgagtgctaatttagcaaggatttcttttttggagtgtgtttgttgtgttttatttaagctggctctattttagtcatgcatccctaattgcagttatctgtctctacagtaaagagcagaagttgttttatttttctcatgttggtataaataattgtatcattttactttaactgcttagttataaaggaaaaaaaaacttcggtataagcatattacctggtacctggatgctcccaccgtgcacaaatataacggatttttggattgttcaacacaatttaagcttaagttgaaattgctttgatgtcactaattaagattttacttgattgtaaaattatgatgtctagcgaagtagcgatgcaactaccagtgagcaataatagtggaatttataatcctaattttcgtagataatttttaaatcataaaatgcccaatatttgtatttgtgaagtagagatcacttgatagtgtagtggtgaggatgtgtggttttaacctgagatcttatgtttgatactcaacatgctcataatttcttcttttaaaaatttagaaaattttctccctctaaattattgtttttaatttgagaactgtatatatatatatatatatatatatatatatatatatatatatatatatatatatatatatatatatatatatatatatatatatatatatcacagttgatatgtgcattttgggatattaagaaaagataataatcctagtactaaatctatatgcattcagtgcacgtagatatatgtatacacaccacttgcccatgcgtacgtgccagaaattatgtcggagcactcgaccggaggaaggtgacgtggactgaaaattacgcgcaccttgactgcgcttgtcgtgggggacgggcccacctggcagggagccgggcatcattaactactagtggccgcatgctgagaggcataattactccgtctgttctctggtgacgtggcactgttttccccctgccattaattacatctagtagtccactgtgatgacactatcgacgcatgcatgcactttctcatcgatcttacgtggtactcttagctacagtagataatatacttacacatgtaaaaatcacatattttacatgtacattatacagcattgaacttgtaaatgtttttgttcagatcacttggaattggtatatatactagtacttaatatatagagaaaattccctatctagcataaaaaaatgttgctcttccctctatagcacccaaacttaaaaagttacctatctagccacttataaaatttcccttccctatatagcacttccgttagtttttacacttgacggtgttaactagcaagagaaaagacggttctgcccttatttagttttcagacttgcccgtacatggtcgttggtattttagacgtgttttctcttgatttaacgtaacactgcaaatataacatgtcgatccactcttttgaaaaaaataataattatcctcttgtggtttcacttgtcattaattaacttaagcaattaataaccaacatgatgtataggcaagtctgaaaaataaagaagggcaaaaccatcttttcttctgctagttaacatcgtcaagtgtaaaaacaaacggaagtgctacatagggaaggaaaattttagaagtgtctagatagggaactttttaagtttgggtgctatagagggaagagcaacttttttttatgctagatagggaattttctctaatatgtacttactctctgctttacaatatactagtagatgttttgggttttaagtattaatattttttaccctaaaaaaataaatattaatattttggcaaatttatttttgacaaactgatatacagtagaaaataattaactaattgatactcttgctggttaaccctactttcgagtttcgattccaatatttaatttctcaaaaagaaaatctaatatttaatcacacttaaagctataagcttaattactccgtaatatacgaggactcgatcgatcgcgtgtggctgactctgctacgtgtacttaggtggggcccacgggagaggaaaagtgggcccgcccgcgctacgtggatggataagctcgccggggaagtttgtggcggaggagcggcgaacgccggcgacccctcgcacacggcgggtgtcggcgtcggcggcgacgacgacgacacagcaatgcatgcatccacgtggcgcgtgtgggccccactcgaacggcagaatcttcctctgacgtgccgccctgcgtgggttcgaccaatccgtagccaactctcttagatccacgtcaacctcgctgctattggacaatttagttgatcagctgccaagcaggataaatacatgaatcaatcgcatggataaactcataaacataaatctgttttttttaattagttcacaacaaagactcattgcgtcacatcactgcacacgtaacaccacattcatactcccgtgaataccctaacacacactctaagtgatgaaaatcaacggtacaactttgaccttactaaaattaaaaatacgttgaaaaccaacctgtatgtacgtaatatttgtgaatatcaggatttaaattctcttgggtagagtcacgtgcctacgacaccaccaccatataccaccatatcgctgatgtttcccaaagataaatccattttctactgacaaacttaccatccacttgcatagaacttgctacataagaaacatagccgtagtttttttgttcacttttcatgacgaagtaaaacgatatgattcacccgtagttttttttcacttttcatgacgaaataaaacgatatgatccatccatccatcgatagtgccatgcatactggtaaagtgggaagtcaccatcgatatcaaaaaaccagctgcaattaatcttgtaataataataatccagaaatcgattaatttcagccacgcataaaccggcaagtgaggattcggccccacaaaaccccttttcttgtggccaaaagttaatcccaattttaaaccaaaaaactttaagccaaacgggtcactaccctctttttttctatctccaaaagattctccactggaccaccactatatcactagctatatagtcaaataaagtttgttcggtgaattcaaccttttgtttttgattcgacgaactacattacaatatatataatgtgacgtcgacttgtgcatgtcttggtgttcacaataaatttatagcaatttaaccacaagaccaaataaaaagttgcaaacgctatcaagctagctagctaccaatttcaaacttggaagatttgtcggcaaaaaatggcacctgaatttccttgaccactagcctttttactgcacgagatcaaatgcgtgatggatatttgctatgcatgcagctgttcttcagagatgtgtgtgcttcacaaatctgaagaactcgaatgcatatcttcttcagtatttgtattaattaaactgtcgctgttgatcacacacgtatgtgtgcttcagtaagtgtgaggctgagagaaatcatgcagagagtgagagatcgatcgatcgatcgatcaattgatgcagtcatgtagcctgtatatgtatgtgtactatgaagtcactgtcaggttcagggatatacagaggaataattctcaattacgattgatccgtttcttaattggggttaattaattgcactgatggatggatcacttgtgtggctcttgtagctttcgtcgtgtacagttttgcatggtcatgtattagccttcaactgaagaattgaggtgctagctaagctagctatagcttctgaacctcacttgagagagaagtgtgccatttgaaggctgaaagatggcataaactggtgatgatcattatcacagatcggcactaatcatcattacttccataaagatgccatgcattattttccctgctttaggggcactaattaattagtttaagttcatcgatgatcggcaggtggctgatcaatatggccctatatggtcaacagccaccatatagcggtgctactagtatgtactatcatgtagtgccaacaatgagaaagttttagattttatttagttccaaaaagttcagtaagtttcatgaatatttcaagtttcactattcataacttactgaacttttcatcaggtcctagcaagaagattaatcctttgttatctagtatcatcatagaattttgaattaatcacatattcgtatcttactgaagattaatcccagcagaagttatgagtattttatctagtatcataatatttcaagttttatcaggtcccagcaagtttcagttagcagttgatctgaataatgcaaatgttttacttgtgccaatattatctatactcccaaatctaatttgctatcaacctatcagcttgaaccacattttaaacttcatttcacactcatgacacctctgatttcttaatcctgagctgctaatcactgagatagccgcatgcggcgcatccatgcatatgcagagcagttgatccctgcacattattctaggcaactagtagtactaatcctgaagataattagggattgatactactcaatagcactaataatcaatcagtcagtcaatcatgcatgaactagctagtgctgcagtttttttttttttggttgcgcctgttctatatggttctagctgttgaagtgggtctcgagattgtaatttaagcagcaaatggtgcaagccgttggccagtttcagtttcagtatttaatctgcttgtctccaaatccaaaaccagccaccctaaatccctaaataaatctgttttagtttggtcccatgaacttaaaaactatcatcattattctgccgactttccgttagatacagaagagaaacacaagagaagaaagtctgaatatggattgcatgggcacacataactagataaacagaggggagtagataacgacttcaaaggattaactatgatatttctgagcatcatataaattttattgcataacaagaagctgtataaattttaagaagaaacaactctttctgttcactgaaatctcagagcttatacagttagagctaacagttggtacatgttctctgaaagtctgaaaaaacaaggtcggtacaggtcaagttcagctattaactgttggatgggggatatatatcaatatatcatactgtacaactatatatgaggccggtgcacatgcaggaggatatcgatcatctctgacgtgcaagccaagatatatatctgcaacgacaagaattatagcgatgggccggcacaaaactggctcaactcaaccagactccacctatctatcttgctgggaacttacctgaatcatccattgattgagaaacgaacagaggtcttcttgctagcttcacaagatggtggactagacgatctgggttcgaagcctcatctcttctaattatttgatattagttcattccctaatattcgtgtttttttaatcatccattgaaagatttgtgctacatgctgcatgaactgtctgattttgcagtataataattaatgcattcatgtaatggtttaatgtgcagtgaagctgtgcaaagattttcatgggtctagttgagcccaagaaggcaagagtggtctgaaactgaaagcctgaaactgcagtgatacagtggtagtatctctctatatgttgtgccaagcaaacctcctcatatgatatttaatttgatatctagatatgtatttggtccacctttcagtagtagcaatcacatcagggttagtttagctcagcctgtttagagtggtatacttaattatgcaagccatggccaagacagggtgttatgaaaaggtgtagtgtggtggatgtacccaggaggtagccacattgatgtggaagcttctaattaacggtactaagtaccacactaataaagaaagaatgaaaggtcttttcttgtatgtttaattagaaaggaagcatgaagcaatgattggttgagctggaggagacctaggcctgcagcaacaaaataatgtagatcattggaaggaaactgtctggttatagcatcactgaaacggccatttaagatttcagagaaaatgatatagtagtagtatggagcaccatatgaataccacacctaagtttgcagacatttaatactaaccaaaatgctggtaataccaacaaaccactcgcagaggaggattgttgaaatcacacacatgcatatgctcatcgtttcgcttatgcaggttataagtcataatggttcatcaataaaaaaaatgaaaaaaaattgttagtaaaaccttttgtatatgtgttcttaacgatttaaatgtaaatgctgagaattgaattgcgatgaagagatagagatagagatagagatagagatagagaagagatttcctcccccgcaatcccgaaacaattcaatactaattgcgccccccaagtaaatctcacgccctgtctactgcgtgcgtccgcctccgagatgggaagacggagagcaacccaactggcacgcctttccgcttctgcatccgggtaacgtaatttctgcaatacgttttcacttgcgacgcaatccgaaaagaaaagaaaaaaatacaaaagcttcatgccaaatttgtattaattctacacggacactgaaagcctcttgaatcttgataatataataccccgatatatctaacagaagccaatccagaggcttaattccggcgatctcccaccgtttcgtctcgtaactccggcggcggcggccatgacgttcatagtccccccgccgcgtgcccgccgggtcgacgatgcggaggcggcggcggcgctgctgctcgaggagctctcgatccgcctgatggaagaaggcagcagcgccggcgggcatccacctccgacgagctgcagcgaccacgccttgcgctacttcatccgggtaattaacatttaaacagctcttcaacaacttgaattcacttctaatttattatactctctccgtcctataatataagggattttgattttttttgcacggtttgaccactcgtctaatttaaaaaatatttagaattattatttactttgtttgtgacttgctttattatccaaagttctttagacacaactttttgttttttatatttgcataaatttttgtgcaaacaaaaagtcaaaatttcttatatcatgggacgatgggagtagtctctttcatcataaatactcctacttagggtagattcagccatttttttaaaaaaaatttaaccatcatttttaaatttaaaaatcgagatcttttactgttccccatgtaccgtacattcgcggttcattttttgagggataatttagaaagggaaacaatgtaaacaggtgtagtttggtactcctactttttatagtcataccatctctaactcatcttgtatatactttttttttacaactatcaatgactaagccggaaactttaaggctttgttcttttcccctctttcctaactcactttcccttgttttacacacatacgcttttcaaactactaaacgatacattttttttaaaaaacaatttatatgaaagttgttttaaaaaatcgtattaatcaatttgtaggctaatacttaattaatctcactatagtcgtgtgctttgtttttcgtgtcgggaccgagcacagccttttagactatgactaactactaagttaaggcttttcacaaatgaagtgtcagtttttcacaaaatttacatgatgatttaacacaatttaacaagattttgaaggcaggcctaggcttaatagctgctctaaccctttctccgccacaactaccatcgagctaatcctcgtaattatgttctccttgcgctcgttgctggtttgcgttttttatctattgtaatatttgacacaaaattacatatttaatctttcacctaatcttttaattaagttaatatctagcccacatttttaagtacctggggtttaaaaaaacatttttaagtacccacccacacataccttctcctatagatagttggattgcatcctatcaacggatgtcatcattcccaagcaccatagcaggtctctaaaaaattatattattcttatattactcttcaattaaatgcacgcatatttctttttttaaaagaaaaactcaaacgtttgacaaattattgatagctagaatttcaagaggctgaccaactctttatcctttgttaaatatttatttacagttggacagagtaatccttaacatatcttttaattagatggttaatggaaatcaaattagtgtacttagaaatacatactaggcaaaatttactagaggatcttcaaaatttgtataatttactagtagacatcgtaaaaacgtatgacggccactataaaaaaattggtaatttgctagagaacactttcggagagaaattcttaaaaagacaagaataaccctatggtcaaaagctcttgagcttaggttagagtgaaaattaaatatgatgtatgctagtgatgtacttggagtgatggcaaatttagagttgcataatttctaaatttttacgctaacattatgtttgaagcttgtggccctaagggcattcttgtctttcttaagagtttatctttttaattgagccaaaagtgttctctagtaaattatatagtgtcttttagctttgacacgtttttatgatgtccaccgataaattacataaatttcaggtgtcctgtagtaaaatttgccaacatactatttcctccgtttcatattacaagacttattaacatttatatgaatatgggcaatgttagaaagttttataacctgaaacggaggtagtatatccttagattagatgaatcttggtcacatatcctaatgcaattgttgtttacagggatttacgactattgtcagcttagtaatggttgcctggctaatctatgcgagatatacgaccgacgattcagagcttcatgaccccgcaaagctgtcatttttaattgttctctctcttagtttggcggcattcggcttctgctctacttcagaaactgagctacagagactactagattgatgagtcctagcaaaagtggaacacagtgtcatagtgtgcatggtcctagaaggaaaacttcattgtgttgatatatactctttccttttctttaatactaattaatactagataataccgttaacttttacatacacgtttgattattttgatcttattagaaaaaagctagcgataatttcaccggttgatttgaccaaatggcacaataattttctgacacgtgtcataagagactgttaacaaccaaccatcaactacacaaaacaataagttgacatacacccactaaaaattgaaacagtcatccagcgaaacgcaatgcaaacacaatacgttctgacaaactcaaaatttagggatgatatgtttca

SEQ ID NO: 59329 - DNA, 39351 bp, Oryza sativa
aaagctggtaataccaaacaaaccactcacagaggaggattgttgaaatcacaacaatgcaagctcatcgttttgcttatgctgattataaaccataacggtttatcaatgataaaaaaaaatattgtagtaaacctttttatacatgtgttcttagcgatttataagtaaatgctgggaattgaattgcgatgaagaagacatagttgtacaatatttgcaaatacatcgggttgtataaattcaccattacaatacatagttctacattctgaacagacaccacacatcacacagatataggtagtataaactttaccaactagtgttttttgaagcaaataaaagcaacattaccactactgtacaaagttcttatttttaacagttcagacagctatttcacaatacaaaattaattggcttagtaggggacacgcaatcctatagatgaacatgagacatctgttccaaggatctcacgtttcaattgtgctagggcttagcatccagcttcatgttgtggagccttagcttcctctcgtctgaaagtagctttgcaaaccgtgtgagcatatctgcataggtcgtcacatggtcaccatgaaggtttggctctggctcaatgttgttcttctcacactcttccttgcttagtggcttcttgagaaggttttcgcctatcttaaccaacagttgaagatgatccttcgtcgagaggtcattggatattgcccctattgggatgttgtgatcctgtaatggtgaacaaggtataaatgttttttatacaatattttttagaacatgtcaacaaataaataactaacttggatggcacccatgacaatagattgtaaagcatgggtcgcgtacctgaatgcgcaatagttggtgtgaacatccgattgcttgaaagaggtctgcaacgagagtatcggccatatctgagctggcatgaaagaacatgttgagcaacggcattgtatccttatcaactagccatcgaaaaatgccccatttggcaacatttcttgcatcaaacatgatatcgtgctcaggcagacccgtgcccaaagatatcaccagatacttgcggtaatccaagggctcggctttcgggaactcctcgctcttccgcttgatctgctttgttatctcacccatagtcaccaaagtctgccaaattagagacatcaagataagttagcatcttaaatattaccatgtccagtttggcaacaaaggttgatgtgaagtctatacaaaacacataatgaaaaaaggcatattgcgttactgggtaaacattattgttgaaagacaaaagtatagagtttttacacaggaatttaaacccaacaaaagttgacaatttcagaaaaatgatgaagaaaaaacatactggattgtttgctgccatgccaccatcaataatgttgaagctttgcgatgcacccgtgtgatccacggtttcaaaatagtgtgcagggagaaaggttggtgctgcagatgtaccaatacatacatcagcaagacaagcattcttcaagggcttacgtctcgcctgcattgtagcatatacattagttcacaccactccaaaaaattgtcatgtgaaatccacacgctaactcagtttagagaagggaccttgaatgtgctgaatattattggcttcacacacttcacatcaaaagtgggaatcacaacatttgtcaatgtttctttcatcctcgtctcgccaagaagatcattgattagtctgtgaaggtattttccatcatactttggcccaatggccatctttatgatgcccaggatgttgaagaaccaaccaaaaaatccagtcctggttgcaaaatccagttgacaaaataccatttatattttcatagctagttaaaaaatcaattaacaagagaacagttcaactcagaaattggttgaccataaacacttagatatggtcatagcttctctactgacctcagacagaaacatacaactacataattgcaaagattgttattagtattaactgaagcctgtaatacatactttacctgtgcggaaagatgtggggggaatgcttgaggtaaaatgggacaatatccttggcatagcatggttgattggcattgcccagtgatggagctgctagcatgcctgcaataagaccacctgtgcttgtgccagcaatggcatcaaagtagtttgcaatccgagcatccttcccatcaagctcctagaagagcaaagcaattcaacaagtaagttactgccagacatgcgcagagaaagaatgttacccaaagagaagaatgactcttaatcatgtagtcgaaaggccagatgaaaatttcaaggtgagaagatgttacttagaaaggctatgaattccattaacataatttacccaagcctactgatcactaagctatacacaattatacatgggaagaaattaagaaatataggattgacctgaagtttagattccaggaatgagaggatgacagcaggaatgatacccttcaccccacctccatcaatactcagaattgtgatcatgtttcccttgcttggtggtgggcatgcacaattcttctccatggcagaggcaaacaagtcagctgttgatcacttgcaaatttctctctctggtggtctttctcaacaaaggagagctatttataggtgatgagggaaaagataactcaggatgaaaaaaaagtaaaatgttaactttgaaccacaagcaatgtttgcacgtattttacactcaagcattcagcatctgccaaactgctggcaagcttatccaagcttgttcatgcgttgtatgtatcttcttccaatggtccagtaagatatgaaagtctcatatcttcgaccatctacgtgttttgccacctttaaaacaccacttttatgttctaattttggctctagttgacaccccatatgagtacacacttttatgccctgcaagtcatgttaacaccaaatggaaactgacaatgcaagtaaacattcacacattctgtcacctgctccctcaccctgacctttaatgctctagacttgtcacattgttgcatcttttaacttttttctatttaattttgtatttagtaggggaaaaggaagaaagattgaaatttgaacattcacacccttcatgcatcatgaggtgatgcacatttgcttgggagtaaacctggttaccattttatggctgtttggggtggaaagaaacaacatataaaagcatttgcaattaaaatgacatgggaaacataacatgagactaagccaagttaaactcatttcaacaactggtgtccccagaaaatgtgaatgggaataactacagtctacagagatagcattacactacaagaaggaaaactagcaacacaacaaaatatctgagtcaatttggctgcccagaatagttggattggttaagagaacagatacaacacaaacaaaaaaaaattgcaatacaactagatgtactaagagttgaacatgatcccagtacactgtactacaagagtatgagacctcaggaaattatgttccatattcttccttgagcttcaagtctaaattgcaattagcaaatgtttcatgttcgaattccaagtcagaaagaacatgattggcgttgtgttcacctgtaaaaaaaaaccaataggtttgtttcagaagttacccaaaaaaaataaagatttttcatgcaccagcacacgtcgaacatcccaagcaactttctatacagaagtacatttaactagttacaaggtctgctagaagaaaggagagcggcatgcataaagtttctagcaatggcttgttctctttggagaagaaacaaggctctggattgatgaaagccgaatacagtggctcaattcatttgtagaaggttactagaaaatcattcaattttgtaaattgccagccacagatatacatgtgccagtgcatgtaagaggtgcagaagaagagaacctagtcttgagcttaagtatgacattggaggaagaaattctgtatcaagatccagttctgttttatcttcaggatccaccatgcatgcctgaaatacaaaaatagtgcaattatcaactgaaagtacacaaatgcatactatattactatacattatcatgtgctcatggcattaacagaacaagatcagcttgtacttatcaccattcctacacgctaataatccatcttataagattcacaaaatggtaggtgaggatagaaatatcaaggcagcctaaccctaatgtaattcgagagtgccgtgctaagatacccgctaactagagagaaatgcttaaaatcattgttggcaacaattcaaaacttctcaatgatattaattcattgccactaatacttagggtacttatgaaatccctcctctccattctggcacatcgccgtgattacgttttgccactcttgaaccacactatacctttgaatgcgcatcgatgcggtaaagactgtccatggagagttgcatcgtccccattgccttctccaccttcttctgtatgcctaattacatacccccaataatacacataaaaaaaggcagtagtaagtactacatcttatcatacgcgaatactggcacaaaggcatccataaaagtaaaataaaaaaacagaaacatacgctcttccagcttatcactgagcagtttctgcatatcgttcccagtaaaactggcagtttcaaccccatccttcgcccactcgcagcatttcatccaatcctcatcgctcaggtagctaggcttcaccagattcttaccagatcccccaacactggctgctgcagtagctttccctcccgtggagctcgccggccgagctctccgggccttgctgagatcacctagggctctgcgctcctgccgccccaccctcgccgccgccccggccttcttgccatcgatcccttcgcatcaaagagcaaagaaatcaaagagcaagaaaaaacgctcgccgcggattttcggagacggtggtgggataatcaccgcgaaagatcggcaggttctcgttttggatggcgattggagcccgcgaagccatcctgtgaaacctaccagcaaaacaaaccgagaagtttcagcatttcttggagcatttttggtgaaacagcctcggtgatggatagtgaccaccgtaaattcgacagaaaccgtcaggattcaagaaatcgcaccgattcggtgcgcgttgcgcgaaatgctagtgcaaagttgggaattttttcgaggcttaccaggaggacaggaggatgaaaccgccggagtggagggagtggggttttgctgcgggagatggaaccgggacatgttcactttgatgcgaaaaaaaaaaatcttactaaaatttagcattatcaaaattttaacaagatttcttatatagttaactaaatatagccacttttttagcaactttactaaaatttgataaggttgaaaatatcattaaagtgaatggccctggaagatatcagaggagtggtgaagcgtattgtgtgtagtagatcaacatgttacgtaagcctagtaggaaagcgtaaaactagattacgtgtttctctctctccaattttttattatcgcagggcctataggaaatgcggcccatgcagcccgtgccaactggagtgggctttgcgtgctttgttgggcccaagagggagtagcccatatgcccactcagcccaacactttagaagccaacgtatatggtgatgtttctttggcaggcagcccaggcttagggtaagcacacaacactgatataaaagcttaggacatcgagaacaaattgggaaatataccctttttatcaccggttttaaaatatacacgttttgaagggactggtagaagtatatcattgtcgcaaagcggagatgtgaactcgcgtatgtggatatacaaacaaggtcacgacttcgcatcccaatatgcgaactcacacgtccgccgcgagttcgcattcttgctttgtaacgatagtatatttttgctaattctttttaaacgtgtatattccttgctttgtaacgatattatatttttgccaattctttgtaaacatatttgtaaaaagaagggtatattttaaaaaaaatccaggacaaggcagctgtgtaccagcaggcagagttggatcatggctcgtgagacatagggttggtttggtttgtggtttaaataggtattactaaattttatcagtgccaaattttggcatgactaattttggtaaggcaaagttgtgtttggattgaagccaaaatagcctaagttcactattgaaaaggcctattttcttaggcatgccaaaatttggcttcaaaccaaatagacactaaacactattaaaattgccaaatattgataagcctaatttaggtctcaaaccaaaccagcccataatgtaaatccgtgtgttagggaatgaattgaacacgtagattagtaggagtacctaagggtgtgtttatttgggaaaaaagaaaatttttgggtgttacatcgaacgtttgaccggatgtcggaaggggttttcggacacgaatgaaaaaactaatttcagaactcgcctggaaaccgcgagacgaatcttttgagactaattaagccgtcattagcacatgtgggttactgtagcacttatggctaatcacggactaattaggcaagattcgtctcgtgatttcctctataactgtgcaattagtttttctttttatctatatttaatgcttcatgtatgtgtctaaagatttgatgtgttgtttttggaaaaaaaaattttggggaactaaacgggccctaaaagtggagtaaaaacaaacctgttaggtgtattggcactcccggttggtgctggttgccggcccctaaaagtggagtaaaaacaaacctgttaggtgtattggcactcccggttggtgctggttgccggcacatggagattgattagcagcgctggcaggttgtgcgcctgcctggtaggagcaggaggagcatccgctttgctgctgaataattcttcttcttcttcttccctacaggtacacaggctgtgctgtcctgatgctcattttctagataaaaatacagcacgtatgctgaagaaacaaccaacagcttgccacgtttccaggacaggtactcctccttccggcatgttttgtagtcctgtcacgtcgctgactttgtatggccacaggtagcaacatttttgttttgttttttttttccttttgagcccgtgtcttctctcttacgcagtgcaggtagacttttgggccaatagtttcttttatattttataataaacttatatacaattaaaacttgtgcacaaaacatatttcctccgtttcacaatgtaagtcattctagcatttctcacattcatattaatgttaatgaatctagacattaacatcaatatgaatatagatatgctagaattacttacattgtgaaaaggagggagtattgcttattatttcataaagcatatgctcacgaaaaacgagcaaattaacgcaactgtatgaacacatggtaaattggtgatctttttttttcttctgtgtttaggaggggtttctctagcacacaaaatgaagcatatattagcgtatgattaattaaatattagtaaaaaactttaaaaaaactaatataatttttaaaacaactttccaataaaaaaattctcaaacaagtaccatttggcagtttaggaaacgtgcgagctgatgagataaaatcccaatttaacttgtcttgttatgacttcgagtttgtaagtcaatttgacctaagtttgatactgatatgagcaaattaagccacgaggtttgagttttttttaatgcctagaacatcctagtttggagtaatcccttcatcaaaattcgttgtgttagcagtggttgggctttttttttttttaccgagggtgtgtactaccggctaaccaacccccaacaatgcagggaattgaaggccctgggagatgggagaaggacgcacaggaggacagacgtgacagcaagcgggccccaccacaccgctcggaaacgcaggacacgttcctttctttgaattggtgacagcctctcgggcgaagtaataactgacagtgaagagcctcggatctcacgcaacaacaactccggacgacgtgagaaccatccatctgcaatccctgcagtccagggacggacggacggagaggacgacgcgattgaccattctacccctcccttacccacgccatcccgctgtgttcgggaggcctaggcgcctagcacgcgaaacgaagtactccaacgtttagtatgattttttaagtaactttcatatagattttttttttaaaaaaaacacaccgtttagtagtttgaaaagcgtgcgcacaaaaaaaacgaggaaggtgagttgggaaagtagaaggagtattaagaacataggggctgtttggattagggactaaaattttagtccctatcagatcggatgtttggacactaattataggtattaaatgtagactaataataaaactcattccataacctggactaattcgcgagacaaatttattgagactaattaatctatgattagcctatatgatactacagtaaacatgtgctaattatggattaattaggcttaaaaaattgtctcgtaaattagctatcatttatgcaattagttttttattagtctacgtttaatacttataattagtgttcaaacatctaatgtgacagagactaaaatttagtccctgatccaaacaccaccttatctccaccctaaattataattatttttttagttggatacgggtattaaagaaaagtaaaattaaataagaaaatatcgtgatcaattgacaaataatgtagataaaaaagattatatttgaagttgttgtagatcctatttgacagtcaatgctacaacaaccatagctacagtatgttgctactataggtgctggctgtggtagcactcaacagagtagctgaatgtgtctatattttaagacggagagagtagtataagtacttgagggagtagtatggtagtagtaacatcgaagtccttttgtaaatacttttactctatacaaagaaattagagtaaatttcacaaaactacacgtgtaagtccaagttgtagaaaaccacacacactttaacacttggcacttaagtaaatatattttagtagtgtagtttcacaaaacacactatcaatgaatggattcaccgcgagatgatgtgactattaccagccatcgcacgaaattaataggatgccatgtctttatcctagatggagcgaccacatcatctcgcgggtgaatccattcatcgatagtgtgtttttgtgaaattaaactaccaagatatatgtacttaagtgttaagtgtcaaaatgtgtgtgattttctgtaacttaaaaaatatagtttcgtgaaatttacctttttttaatgtcctacagccaattttgtctaagaaaaaaaaaggaaaacttcacgagggcacgcgcgtaatttcagggtcgcctcgctgccggcagcggcaggccggccggccagccagccgcatcgtgtaccgtgcctacctgtcagaaaagttcagaggaggaggaaggaacaaacaaggcgcccgcctttttttccgaaaagccccctcgtaaatcccctttttccgcaacatgcccacgcatcgatggagaaagaaaaccgcgacgcatcgggtgcccatatgaaatgaatgaatattccgccgccgctccagcttccgctgcagccgcagcttgctgccaaatttaccgtgaggtgaccgttgccttccaccgcccccacctccgccgcggcctcaccctcacctgcggcgaggatcggtgctctactctagtagtagtactctagagtctagtctagtctactctagttgctgccttcgctagcattcggaggcgatctgaggaggaggagtggggagcagcgaaggttttgatcttttgggaaggagttggattcggctttctgggttctgtctgtcgcttgattccaattcggatttcttgctgttgttgttggggtgttcgcggccgatttgaccccggggaatcgctgcttttttatttttttgaaaagataattctacgcggattagatttggtcaagaagtcgtagtacgaacgcgaggtttgatcttggtttcgatccgaagggtctcggttggctgcgtgggaagggggaggaggaagaaggcgacctgctatctaatcctctaccccctctgctgcgaaaattctctgctgtttgctcaagcatcttgctgcttggagccttggatcgaagagagttttagttcttggagttctgagaattgtgttgcttgagccgaattcgatcccaaaaaggctcttttttgggaggctttgaggaggaggaggaagaagatgggggtgatgtcgcggcgggtgctgcctgcctgcagcagcctctgctacttctgcccctcgctgcgggcgcgctcgcgtcagcccgtcaagaggtacaagaagatcatcgcggagatctaccagcttccaccggtatggcgattactgaatcctgtcttggcatttcagccatttctgatgcttagttgtagtctctgcgatttgggtctgtggtcaaatagttctagtttctgcgaattggagtctgtggtcaaatgtgtggagggagtttgttgattgagggtgtgatgttgttgctgtaggatggtgaaccgaatgataggaggattgggaagctctgtgattatgtctcgagaaatccgacgcggatacccaaggtaacacattttgatctcctctctgtttttactagaattgtcgcgcaatctgttagcttgaatagtttagactgaatttccagtatttctgaaagcagtctttataggtaccgagtagttaccacataatggctgatttacactgcattgctttagtgtgatggtgattccttttgccagagtacaaccgatcaactttcgctagcaccgatcactagctggaatgattttaggctgtttaagtaggacttaccgagatgaatgaatttgtggaactcggaactgattttatgtctgcagatcacagagtaccttgaggagaggtgctataaagatctgagacatgagaatttcaccttggccaaagttgtaccatgtatatacaggaagcttctgtgttcatgcaaggatcatacgtaagtgtaaaggctctattctgccagtcaagcacccatagcaaatgtttgctgctgtactgaccatattattcttgattcagaccattgctggccacaagcacattgagcattattcgtactcttctcgatcagagaatgaatgatgatttgcgggtcctgggttgtctaatgcttgttgactttctcaacggccaggttattgacgactgtaacaaattgcacctacttggtttgctagaaatctgccatctgtttggtttaatttgagttcatgtaggttgatagcacgcatatgtttaatctggaaggcctcataccaaaactttgccaaattagtcaagaactaagggaagatgacaaagggttccgcctccgatgtgctgcacttcaggctcttgcttctatggtaagaaaagtttttacttgattctctgatgaaatggataaggtagtcttatatgttgcgagctagccatttagggctaatttacagtagatttgttggaccagaaataataatgtagaacaaaataaggaactacattcaactattatacaatttgttttgcaaatataacatttttttaatgttggttatattgatattgcttgagaattcccaacagataatcctatacttgcattactggttcttgccaactgatgccattaaatcagtctattgattaaatttaactttttaatcctaatatactcatttaccactttgtaatcaggtccaatacatgggtgaccactcacacatttccatggaacttgatgaagtaagtccttatcactctgtgttgggctagaatgttaagagttaagacttaattctcattcatggttgatagatgcctcctggtgaatatttgttctcttgttggaattgcataagattcatctttggagcatagacaagttgatgccattaatactacagatagacttgttgaataagtggaagatatttgattagtctatgaatagaaaaaaaaagtagcatgatagtttcatttgaagtgcgccagaaacagtaattcagtaagggttctgattagtctctgaattcattcttgaacccaggttgtgtccgtgatcgtaagttgttatgaggttaatcaaactctctcaataaaagaggttgtcaggcttcaagatgatgatgatttggtaatcaatggaagtctgactgggttgccagtatctgggcaaaatagtgccaaagtggcatctgatacaatgtgagaatttctgctaatgtaacggcccatttccacactcgatttgtgcccttgtcatcttaatgacttagtgtgttgacaggtctgcatctgaaaatccagcacattgggcaagggtttgcttacgtaatatggccagtatcgccaaggaggcaacaacagtgtggcgtgttcttgatcctcttttccgcctttttgatagccacaactattggtctcctgaaaatgggattgcattttctattctacaagaaatgcaggcactgatggacaaatcaggtgcaaaatttttcacccatgctatttgtttctctttttgtgccattttttttggttttgttagtgtttaacagcagaaagatttagtgctcttctaaatcttgtttcttaacagggcaaaatggccatttgctgttatctttcaccataaaacacatagatcataagagtgttgccaagaagcctgccaagcaaacaagcattttaaaagttgcttcgcttcttgcaaaacatgcaaagttgaaggcgtcggtgacaatagcaagtgcaacaagcgacttaataaagcacttgcgcaaatgcatgcattgtgctgttgaatcaccaaatgctcaaaatgatgttgacaagtggaacagtgcactttatgtggccttggaggagtgcctggtgcaattgacagaaaaggttcattatgctgtattattcctttgttacattactacattttgctttcatcagagagacattaaaggctgttaattcattgaataggttggtgatgttgggcctgttcttgacatggtgggagtaatgcttgagaatctctcttgtactgccaccattgccagaacaacaatttcatcagttttccgcacagtgcaaatagcagcttccatccacaagtcattgtacaaccagaaggcaagttttctagtgtgttcaccattgcaggagaattttgctattgaacaaaagtgttaattggcaattccttgttaatatttcaggcatttcctgaagctttgtttcatcagcttctcttagcaatgatgcacccagacaaaaagacaagggttggttcacatcgtgtcctatccaccattattgcaccttcacttctatgcccatggtcaggcataagttttcctatccctgtgaagggcaatgattcacagagcattactttgttggctctttctgccttttcttctgaggccgtaatggatgaagtccggatcaaaagcaggacccatgaacagttacaaaacaatgtaaaaccagaaactgtagttggctctgagaacggatacacacatacagaaccaaattcaaggaagagccctggtcttggaattccattgaaagatgaagtatgtactccaactagtattcttattgaacttggtattttctggtcttggtgttttcggatgtccagctgacacattttcttccactgaagcagaatcttaagttcatgaagctgaacagtagccaacttgttctcctcctttcatcaatttggagtcaagcacctctagaagataactcaccagcaaattttgaagcaatgtgccatacctacaatattgctttattgtgttcaatgacaaaggtaggtcacttaatctagttcattcttgttatacaataggcaaaaagaattgttcaagtaacttgacttaacattgttctgcatgccttgaaattatcaaagaatagccaaagggaaagataccgtcttttcccttttggcatggagttatttcatattatataatatttttttatactctatttttacacaagatagattctttagaatattttattgatgtaataggcatggattaacactttttttaagatttccctgctagtgtgagtttgactagtgatgtcaacttctcctttggacttgaaattgtgtgctatatttgtgagattgaccattgaattttcgttgcagagctctagtcacgcagcattagttcgatgtttccagttggccttctctctcaggaggatgtcccttaaccaagaaagtaagtttatcctcatttgcctgctctttaaagtttttgcttttgtatatcaaaatgatgatgcaaaaaaaaagtgacaactagctagggattttttccaaataggaatatcattttttctaataccagtatattttagccattgcgtccaacttcaagtttattatatttcctatcaatctagtcatttgatacctgcttgatttattcttacattttctactgtaaataaagatggtttgcagccatcacgtaggaggtgtttgtatacaatggcatcagcaatgctgattttttcagcaaaagttgctgatattcctcagacaattcctcttgtgaaagcagcagttccagagaaaatggttagttgattcctgattttgaatatgcttgctctatatatatctctaatgtgacatttttcaatttactctgaattcgcttattgatgtttttgtaggtcgaccctcatctttgcctgattgatgattgcagactcgttattagttcaccacagtcatctaacagtgggatagtttatggttctgaggaagatgaaagtgatgcacgcaattttctttcttgtgtaaataaaaatgatacacagttaaaagaaattgtgatatcccacttcaaggagaagtttgaaaatctatcagaggtatacattcagatttacattatgagagcgtgttttcttgatttctctgttcacaatcaagaagttatttgacgattaagtgtcttcactgcaaattgcagaagtttaatggtatagaagagcagcttcttcaggagttttccctggatgattcattccctctcagtgctccactattcatggaaacaccacactcttgttcgatgtacgctgaaaaggatgaccattgttttgatgaggtccgtactgattctctatagttaggtgattttttgttatttatgaattgctgttgtattaacttttttggttgcatctgcgtcccttgtgcttccaggaagtcattccttgtgagatggatgatgacgatgacatcgtttttgaacacagtggatcgcaatctgacaggaaaacctctggatctatggcttcatcagatgttctaaacgtcaatcaactaatagaatcggtatgcgccatttctgtctacaacaatggcacatgaagatcactcgctattttctagatctcttacagtcccctcatccgtttgtaatcaaacgacttttttttttcttcaggttcatgagacagcaaggcaggttgctaatgctccagtttctgccaaccttgtaccctacgatcaaatgaagagccaatgcgaagccctagtcatggagaagcaacagaagatgtctgttctcctgagcttcaaacactcgaggaccgattcccgtggctcgactgcagaaaatggactggaaacaaacgaggcatgttcatcttgacaggaaaaaaaaaatctatccatcactactgaaatctttgaaaatgtcctgaaaaactcatcaacatcttgttgcagtcatctgctcggtctgagcctgagacgcagtcgacgaggaaggagcgaatgcgacgcagcgactcggcatcaagcgaatctgaccggtcgttcaggctgccaccggcaagcccatatgacaagttcatgagagctgctgggcgataggctggtgcaatgcaatgcgatggcgccaaggatctgatactagttttcaagcctgtatacagaaatgtttttacagatacaagtcttctaaagctgtttcttttcattgtcgccttgtattttttattcttctgagtgtaaatttctcgagaaggtgtacaaatttctgttactgttgtagagacccagaataaataaaagtataggcattggtgcaatctgatggatgaagttgtattaaatatttaaatgtccagaaaatatattgttggagacatgtcacgagggcctttgaccgagcctacagaaacaggtctacaattgccagggcgaagcacggcggtaaagcgctgactgtcacaaagatagaggttatgggcgaagtcaccaggtggagccaaagacctttgtcccaagccgaaggactcaaagccttaaagggccaaccactcaatgaaggcccacttagcagctcaagaagagccctaaggctaatttgttcataattaccatcataaatatctcatatcatacgagtaaccatgtaaattttgatgtatttaataaccctagggcacatgaacctataaataggccccatagggcatgtactaggggatccaagaaatttccaatattaatatattgtttttacttttccataaagtgaaaataaactatgagctaggtttggcgaggagaggaataagcaaaagagaggataggaaaacaggaaacgggcctgggcctaaagcaaaatgtaattgggctcaaaaaagggaaaggagggctcacgtatgcggcccatatttttgggcctccgcctcctctcgtcgtctctccgtcccgagctaagtccgtaaaaggtcctcgtcgtctccgcggcgaggcgatcccctcccattccaagaaaccttcgcgccctccaagaattccaagaaccctcctcctcctcctcctcctcctcctccaatggagagcaggctactgcgctccgcggcgctcctcgcccgcgccgcgcgcctggcgcgggccgccgcgacctccaccggccgcgccgtcaccgccgagcacctggcggaggtggtggcgagcgccgccggcgaccgcggctttccagcggcgccctgcgccaggccgccctcgcgctggcccggtcttccgcccccgaggcgaggccccgcgccaccgccgaggtcgtccgcgcggccgccatggtgttccgggcggcgcaggaggcggggtcgcccggcgtcgcggaggtcgccggcgacctggcgcacgccgcgcatgactgcgtccgcgccctggtcgagtcgggccctgcggcggagagacctagatgcctgcttcgtctatggcgccgcaagaaccgccacaacaagaacgcggcgggagaggctgatttggaggcacctctactccatccccacgagaggccatcctcctcctcctcgccgatcggggcttctctatcggaggtaagaacaagtttgctcagagctttgtgggatgcagaatctgatgcatgttgcagtgaaaccaaagtcacaagctaaatctaacgcatttacatcataacactgtatagcttttaggcaaaatttgccataggataaggtagattcgtggcatttaccgtgggacaatgtaaaaacatgtctttgccatagaactctctggttttgtgataactaactcactgaaagatactatgatcaatgccttattatgtttggctcaaccaaataggtttttttttatagaaaagacagcttttagcccatgctaagttgcacattagtctgagaaaaataataaaaatatgaacagatgattgtatggtgaattggtgatcacagattataaccatgtatattaaatctcataaagaaccatatctcatacagattcaaactatattagcgttattgatgcacatgactttctgtttggaacagtgagcttaaattgggagtttctacttgcagattgcttccttttcattccttgatttgccaattgtataggtgattgcttcttttccctttcttgatttgccaaatgtagaggagcttgcttcttgttccttccttgatatgccaattgtatagtagtatttagttcttaattttatttgattttcgttttgcagattattgaattgtctgagagtgagagagactttatcaactatggaatgtttggtgcccttgccatcttcccttatttgacgaggacaggcggactcaagagcgcatactcccccttgagcccaagcacattccatattattttctgtacatggtggatatgtgtgggcctcgatgtactttgtggcaatagagggagagccatgatgaagaacatccttgccttcatcttggctttctatgctcgagcatctgctagacttgcaatcttgggcgtctcactgctagtgatcctttacagtcacttagagctagctcccaatgaaatctacacactgtacatccttttgggggccgctacatgtatgcatttactcgtttgggctatggttagttcctcaggccttgtttcttatttccatattgcaggttttgttgttttgtagttacaaattcttttgttctcacaggattacatgagcagggcccccggagatgctgctgattgatcccaatccaattggtatgcgaaaagagaggagtatttggacagtttttgtcaggaccaaaaattaggagtggctgattgttgataatttgattcattctttcattgggatcttttgctttacctacttcttagggtctagtacggtggcacaattactgatacatggcaaatgtagggatcttgccctttaccatcttagtgttctagtacagtggcacaaatactgatacatggcaaatgtagagttgctcgatgttatctcactcttcaaccttctgcaaatgagttgcgaacatactgatgctcgatgtacattgatggcataacagtcccaattcagtgttgatcctacaattgtgattatcgagtgttacaagttagaagtagaacctttgcatggtgtaaaactgcattgcttctggtgaaattcagcagttcatatattattctctctattctgtgataacattttattaggttttctgttggatatgtgcattcaattgtttattacattagcctgttacagattacacacccagacaaagggcgccattgctgggtttgtttgtttgttttgggtggggtgttagtatgtaaatacagcaaaaatttatgtctgattcggtggtagtttagttatcttgtgacttctgagctgattttagcattgcacttggaggaccttgtgagcctagcagcctgtcagtgccatttctttcgatatattctttgcccccctcttatttatgcagtggacccttgtgcagtcaatgaattgttaggattacttctatgtcttttatagatactactccctccgtttcatattataagccgtttgatttttttttctaagtcaaactttgttaattttaactaagtttataaaaaaaaacttaacaacatataaaatatcaaaatagtttcattaaatctaacattgaatatatattaataatatgtttgttttgtattgaaaatatcattatattttttttatagacttgatcaaatttaaagaagtttgacttaaaaaaaagtcaaacaacttataatatgaaatagagggagtacctcacagtgatatgtttgagggattcaaacttttttctccggtgctaaccgtcccattaatcatctctaattcaaaacatttccatcttatatctaaacccagcgcacatctaaccataccttattagtgatgggtattatggtcttaatttctccaaaaacaagcaacttttgacagtattttggggcgttctcagtaactttaggaggaactaatcaatttacataatgccttaacctacagatcttgttagttgttcacttgttatccggtcattgcctaaaaaatgatacttctccaacccccccccccccccaaaaaaaaaaaaaaagagtaaggtttcctacaatgttatggttagccaaccatgttgtggttagcaaacaagggatcctctttatctcatcttccttcgcgctatctctctcttgcttcgacagtactgacgtattgatctgttttttttaacctgacaccaaactacaagtatcttgaatatacgtcctgtttagttcacatcaaacttcctccaactcccaactttccatcacatccaaaacttttctacacacataaactctgaactttttctaaatttctccctaatttcagaaactaaacacagtcatagtgtgtttgcaccgtgcagaaatctgggtgagctcactaggaacatcaaccagtaaccatatactaatagaaaaagattacaaataattttgcatcaacaatctcagaaacatctgtctgggatacaggaagaaaaaccgttgtgtttagaattatagcgttgatttttttttcccgaagggatttactccttttaacaaatactgaatgataaaattcattgaagaaaaaaacgaacgaatggttctcgtgcgaaaaacggattttcttgggttagaaagaaagcaaatgctgcgggagaaagagagatgattattcgaagcgccagtgagtaggaactatcacccatcagactaaaagacaccagtattaagctcgccatagccccaaaaccctgcagaaaaaaatatttaaataaattagaaggtgtaagtatgtccgaatatgtatgaaggtaattgagataactggatttatatttagggtagtgattttcaatcctcatatgacccagaatttggcactaataattactccctccttattatattatacatcgtttgaattagatttgatcaagttaatagaaaaaatagcaacatttgtgacatgaaattagtttcattaattttaacattgaatatattttaaaattaaaatattacctttttttttgctacaaacttaaacaaacttaaaaaatttgaccaactaaaaactcagcagagggcgtaattaatatactagctgctcgtatcggttaagctaattaagttacccggacgaagcggcagccagccttgaccgagaagcaacgccggtcgttggctcgcgtttggtcgccgccggcggcggcggcgtcgtcgccttcttccatccggcggaggagtctctcgagcagcgccgcctcgctgtcgtcgatcgtcaccgtcgtccgtcgaggagcggcggcggcatcgtattgccgggggagcatcagaacgggcatggttggccgccggccgggaaggggcgccgttgagcggcgcgcgctgcggcggatggccggacggcgccggtcggtctggtcgtcgttgacgacgacgacgacgatgaacgcggcgcggcgcggcgcggcgcgtgcgtacgtgagcgatgtgagatcgatcgcctaaagcgcgcgtaggaagcaaaccaaacaagttatatatgaccgatcgcgtagtagtgcgtctcccgtgtcgggtcggattcaaattaagggtttatttggtttggagccaatttttgtcctaccaaaattttgttactgccaaaacattggtaaattttgacactaccaaattgggtggtgtttagtttgaactattgcaaataaaatttggtagcaaaccaaacatgcaattgctactattgaaatcaaacatgcaattgctactattgaagttaccaaaattttagtagggtaataaattggtatcaaaccaaaccagccctaaacttttgtgtttttcgtgaagattttgttactcgagttcgaaccaaaagacgtaccccacccccgttcgatctatgccacgtgcacgtcgagcactatctgaccgtccacgggataatcaatgccacgggagtagaggtacgagcgcacgcgtgcccgagaggccattgggagctaccaaattataatccctacatatcgaaaacggaacgatataataataaatgattaattgattaattatcctctgcctttgagatcaacggcaaactttaccgttgctttcctgtaggccacccatcttgagatcaacagctgcaacagcttggcctcaccagttactaattagcacctacttaatcaataaaaccatgcgtttctctgcggaaaaagaatcaacaaacaaaataagcggtggcagggtgcgcataacaaaagagatcgaattgctttaagtgaacatgggttcttttaactgaataatatgaacaagagctttggtaaatcactttttatagtatgaaagaagctagtaaaaacataaaatatagatttaaaaaggataacaacgaaaggtacaatatggtgacatatcaaataaagagaatattcttgcatcataaggtggtaattaagattaattggctgctccatcaacgaaggatttttttttcttttcatgttatttctaaatgaatggagattggatgttcattcatattgttggcgtcaaaatgcgagagggaatgtattgtgtattcctcgtgctctgtcatcacagattttgtttcttgatttactagcaaacatgcccatgcgttgcaacgggtgaaaaatcgtaatgatatatttttcatgcataaccatgtcgatgacaatcagaaaatcagaaaattgaaacatgttaaatgtaatagcccaacctcgatgatggttatggcaaccttacgatgtttgctttacctaaaataattgaattattcatataacaacatgcatataatctaaaatattcttttaatctcattcttacaaccaatcaaatcctacactgcctcgtatggtcaagtctacacaaaatagagtcactatgcactcttctctaaataacaattagaatatgtttattttctaagattatttccatataacatgttatcaagaataataatagttatacttcaaaaaatagtatgataattatctacaaagatgtgcagggtctccactatagaagaatagatgacgagtcctggagatggaaaaaaagtggttgcaacctatccaaccagctgtccataaatttagcatttttttctaacggttcttttcctcgtatgcttttttttttttgcttttttctcatgtgtttttttggactattgaacttttttttctagcgtgttttcttttgcgcttttttctgacacttttttctcacgtgtttttttaaaccgtttttattttctcgtgcatttttttctttattaatatacggtagaaacatagttacattagattagattagagataaagaagagatataaaacgacgaattagactttttccgccgcgctttttttcgccttttttttctcgtgcatttttttacgaacggttttttcaccactttattatagtgtcggacctttctagatataatatgattcgatttgttttttaccgcgtcacatataattcctttttctttagaatcagacattttatttatttttttcgccctttttttactgcgtcgacgaagttggattcgtttcgatttttcttccttttttttgcctttttttggatcggacatatttgtttttttttcgcccctttttttatcggaattttttttattttttagcccggtttttttcactcggttttttccctggtcgatttttttttaccgcgtcacatgcaatcaggaatcggataattttttcgccctttttttactaactcgtttcgtttttttgtgccgtattttttggagcggacatttttttctccccttttttttcgctccgattttttttggtcggactttttttcaccgggttttttcgccctttttttactgactcatttcgtttttttccccatattttcttggagctgatatttttttctcctgttttttcgctccgatttttttgatcggactttttttcactcgttgtttttcgcctgtttttttcgtccggttcgtaatttttgggtcggacagttgttttttttccctccgtttttttgatcggacatttttttctccatttttttatcggactttttttcgcctgtttttttcccggttttttttacggacaatggaagcacgtctttatttttaagtagtagagattttgcttgagaaacatctaattttatcaattatttagctgttaattaatcactgtcatgggctcaagccatacaccgttgattctactatgtcacgcatggataaaagcaacggcaaagtttgccgttggtctcgaaggcagaggatgcggacccgtagaactaccgaactaatccctacgtatcgaaaacggaacgatataataataaataattaattgattaattaagtgtcagccaaaaataaaaaataaatgaaaaaaaatgaattacccccataaatcgtggtcgatcaaattaccccctaactcaaaaaccagatattttacacactcaactatgcaaaccgaacaaattaccccctaactcaatccagagtggtttcggtcctacgtgacagttcaatcagcatttttttccaaagtcggtgggccccacatgtcatactcttcctctctccctgctcggcttgattgtagagagagatggaggggagaggaggggaggggagggagaagagagagataggatggggattgaggaggtatgggataaaggggagagaggaagggtatgacatgtgagtcccaccgatttttcaaaaaaaaattgctgactagactgccatgtaggattaaaaccacaccggattgagttaggggataatttgttcgatttgcatagttgagggtgtaaaatgtctgcttttcaagttcatggggtaatttgatcgacggcgatagtttaggaggtcaattcatactttttccaaaacaaattaatacgatgcatgtgtgcgctgatcttctaatcgataaatataagggattttaaacaaatgaaacatatatatctcatccatacaaaatcctccctcgtttcatgctggtgtatgctgctcttctaatcgaatcgtgtcgcgtcgcaagcaaggtttcccaaaccgtcggggtcggggttaccgcgccctggcggtaagcacggttaccacgcggtaactgcggaaaccatgaaaaaccgtacgaaaccgtgcaaaatttatcaaaaatttaaattactttttaaatttatttgaatttaaggagattaccgcggtatttcttttaccgtaccccgtggtaaaggagataaccgcacggacggttaccgacgttaatgtaaccctggtcgcaagtgaaagggtgtgtcagtcgttaggctgttctctgtcttcccatctcgaaggcggacgcacgcaatcgacagagacgccgatgccttcttcagtgtctctactctgtagacgatacgtgagatttactggtgtgcaatgaatagcctatcggttcaggattgcggtggaggaaacgatgaaaaagaacaaggtgaatgcgcacgctcaatcagaagtaagcctgaaacttttttttttgtttttcgctgggcggccgaacttgtattaaggggggcaagtaaaaaaaatacaaaccttgcaagttatcagttttaaaacgctgaggatgaagcatcccggcttgtaacttgcatattggtcacacactcaccggtcaaattaacagccaacaatcaactatatccattaacttgatgttctaactacggagtatatcagagaaaacatgcttctattaggaaaaaataagcactgaaaaatacatattgcattattatcgactgcaatataataatgatgcactaacgaacttgatggatatggaagggaatgctttttttactaatgaccaaaatatccctccttgcaataaatggcaaacgattcaaaatggagctaacgggggcagtttagtaataactttcaccatcaccgcaatccagcaatacgctggaaacgtgaagattgcaaataatttccatttgccaccctacttatcccttatttaccaaacgacccctcgtcttccacctcgagccgcgtcatccaaaaccgcaaaatcgcgcctctccgccattcccaaacccctcgcctcggctcgcctctccccatccggagctccttctccgcacacggccacgccattgccatctagcccctcctccttagcctcttcttcttcttcccttgccccccataaccaaaagtccgattgaaatcaagaaatcctcgacgaccggaggcgatcaagaatccaccggaagaagatgcggggtttccccgttccggtgacgagttggagctccgccgcgctcctgggccgctccatctcctcggccagggacgcggccgaggcctcctcccccatcaccgccgcggagatggtccgggtggcgaaggaggtggccaacgccgccgacgcctgcggagtctccggcaagaagctgctggaggctgcggaagcgctgtccaggtccgacaccgacgcggagccgaggcggcgcgccgccgagcggattttcgatgcggcgtccatggtggccaaggaggccgacgcgtcaggagcgtcgggtctctcagatgcggcccaaaatctgacctgcgcgacctacgcgttctcggtagccgcctcgggatgggggtccttgccggagtccagcacgagcgggagggacgccggcgacctcctaaccgagccccttcttgggtcatgtcaggacaagaacgagaagatgaccggcgagggcaaggacttcagcgagatgaggaatagtgcagcggactctgatccacttcagcaatcggaggtattcaacaatgttttcttgagttcttgattgtgcattcaacttctttctcttgagttcttagttgtgcattcgtcgggtcggtatcttgagttcttgattatgcattcaagactgttcaaggagtctctgcattctgacactttttgcattctgaaacgattgtctctttcttctaaaaaaattgcattatgaaacacctgttctgaaatgattgtgcctatttggtcctttgcagattaaggagtcgtccctttttggaaaatgcaaagaactcctcaattatggttttcttggaggtcctgccctcctaccctatctaggctctggactgaggaaaacagtgtcaccctgcagcccgtctgtcttccactacatcttctcgtcgtggtggatttgcattgttgtcggtgtgatttgcagcagctcagggagagcaatgtgtagagagagatatatggggcttgatcttatccgtatatttagaagttgcttctcgacttgccatgcttggcatcactttgatggttatactctataactatctggagctagctccaactgaggccatcggattgtatatcctttgggggatagctacctttctgcatttagctctttgggttattgttagtctcattaattgtttcttatttgcaagttgcagtttatgttacaaagtattaacaaagaaaagtttttatcccttttgcaggatcacatgaacaaggagacttgaagatattacatatcgatagaatcacttctcatccaaatgataagtagcaatgaattgttaggacaattgatcttgctccctcctactactactacagtcaatggattgtcttgtgcagttaatgaattgttaggataattgaccttactcttacttcctcttattgctgcagtcgatgaattgtttgttaggataattgactgcagtcaatgaattgttggtactattgctgtcccttttttaaagaacagcaagttaatggatatagttgttgattgtcggatggagttacagattgccatacatgatacatgtcaaactgatgttcatttacagctgcttcagaatttatagaatattgctaaagtgtctcatttggcaatggtttggaaagtagggaactctaggtcagagcatgcaagtagaaggtcaaggttcagcaagttttgagtcagtttttataatgccttaaactacttatctggctagctgttccagtcattgtccaaaaatggatgttgtcccagaaagtctgaaaacacttctccctagtatttccaaccttattcttctgaacacgccttgaaagccaatgggagcagcttactaacacttaaaggtttcttagcattcattgtaagcctgtaatatcgtggtaggtatacaaggaatcgtcttccgtagttttttttccccacagtaacgatgcattgctttttagctgataccaaattagaaaaccctgaacaaagcgtggtgtgcagaaatcccagctcatgttctggtcattgagcctactaggaacgccaaccagtaataaccatatagtagtaaaagatttcaaagttgcagtgcaatgggaaaacattttgcaccatcaatccctgaaacatatcgccgattggaatgcagcggaacaatccctgaagcatcttttttttttaagataatggattatattaacccggcttctacaccttagaaagatgtacacagcccaaaccacaatcaagagtatataaacaatccctgaagcattctattggagttacttgttcagaaattgaaccttcaaattttctacagaagttttaatttccaaaggtaacataaatatgtttgctctcacaatgagaaacaagggaacaagtagtctttttacaaatgctgaacgcaaaaaatgaaaacaaatgctggatggtgttcatatgaaaaccggcttttattgcgttagcatcaaaacaaatgctgcgggaagaagagggaggacgattagaaacggcagtggtgggcaggatgcagggtttgtacgatacccgatgataccaaaagacaacagcactaagctccccatgaccccaaaaccctgcaaaagaaaatttgttgtatcatactcctttcgtttcatattatataagtcatttttatctttttttatcaaacttatcaagtttatagataaatataacaaaataaacatattattaaaatatattccctctgtttcatattacaagttgttttgtttttttcatagtcaaacatttttaagtttgatcaaacttataaaaaatatattaacattttcaacacaaatcaaacataatatcaacatatattcaatgttacatttattaaaactaatttagtatggtagatattcaatggtagtatctttttcataaaacttggtattgaatattaatttcaacaaaattaatttggtgttggagatgctactatttttttttacaaatttaatcaagctttaaaaagttgattaggaaaaaagttgcgacttataatacaataaaacggagggagtattaattacgagttgtaattaactaagcatatctgcaaatgtacgagcatattgctaattacgagcacttgcagtgagagaagagaactaacgagacttgggatacatataattggcgaacatatcctatgcatgcaagcttcccatatacaccaactagcaaatgtcatgaaaaattctagaaaaaattgggcatttacttctagtactactacacatatatgcaaagtctcatattcaaacttattatattttgagagaatcccttatatgccactagaatttgaccagttcccttatatgccactcaaaattggcttctcccttatatgccaatagtttaagttttttcacccttttatgccactcccaccactatagtgttagttgactgttagtcaaaggttagtttttttcgtaaatgaccaatatgccctctcaactaaaaaaatgtgtaaacttcaaaaaatcataactaatttattttaaatcctttttgagtgaacaaaattttgtcagaactagtgaaaaatgctctttatattaaaaatattgttggaaaactgcatgtttcatgcttacatttaaaatttatttgtgatggtaatggctaaaattgcatgtgatgtagaaaaaatcaattttcatatgttgtatccaatagttatattagtactaaaatacctattattggttgtatactaattctcaagggcaaatgcgtctttttcaatgaagttaacgatcaactgacgatggactgacggcaatggcataaaagggaggagaaacttgaaccggtggcataaaagtgagaagccaatttaaagtggcatataagggagtcggttaatttagagtggcatataagggattctcccttatattttagtcgtaacaaaaaagtgaaaaaaaatgacagttttgagggtaaaaatctatcataattttattctttttattatggctaaaatataatgaatttgaagataatatttcacgcgtagttcggtaggtgtaatactattataagtatttgtacatttttttttctaaaaatttcagtgatatttgctagttagtatgcacgggaaccttttgtgacatttgctagccggatttgtttatctgtaattatggactcgggagattttttcgatcttcatgtggagcaagaaaagaacagccttaatgaaataattactagctgtatacatcggttaagttggtttacccggacggagcggtagccagcttcccgtgagtagcaacgcctcggagtcggagtcagagtcggaggcgaccgcctttggtcgccggcggcggcggcggcggcgccttcttccatccggcgcaggaagctctcgcgcagcagcatgtcctgctcgccgccgccgtcgtcgtcccggcggtgtcgccggaaaaagaagtagtgcatcattgcaacggccatggatggatggatggatggctagctaggcgcacgccggcggcgagcggatggccggccggggtcgacgacgacgaacgcggcgggccgagcagcaacaggagaaggagagatgagatcgatcgcctaacgcggggcagagcaaaaaccagcagcggtatgtgtatatgtgatgtgatgatcgcgtacgtggtcgcgctcgtgtcggattggaatattggacccgataacgagctcggtttcgggaggacacgaatcgaaggagtccaggttgttttatgccactgccacgtactccgtatgtggtgaccacgatttgaccgctggctaactgattcatgtaccatgttgaatcacacgggaaatgctccgaacacatgttttgatgtatcacatgaaaaaccaagaaatttagagctcatttggaacacaggattttgaaaacgcagtaacattaaggactccagcgaaacatcatatttacaaacgaaaaatgatttgtaaataaaacctttatatacgtgttcttaacgatctaaaagcaaagactgaaaaataaaccgcgatgaaaaaccctaaaatcaactcaaaaattcaaattttagcttataagtataatcataagccaaaaaatggggctacaaatatgcaagattatgatataatgttctacacaatcctgcaaggttccaagccaccgaaatactaattttggtgcattttggatggtaggaaacaaacatgggaatttaaaagaaaattgttcgtatgagctcatgttcattttcctatacaacgggggaggatgccaatctatataagtgttggcatctctattcatttgatccgaagagcccccatagggaagttcatctaaggattccaatcctttattttaaaaattcttcaatccaaaggagcccttaaaatttacgtgttgatttgttagaacaaggataaggatagaaagggagagaatggagtttcaaagaaaattgaaaacacaagattagacctcatgctagcattcctacgaaatagaggcaacttttttatcctatgtatttcctttgaagcaatcatataaagcaaatggcacgcataaagacaattcctttggattaaattcgtccatttttcctccaaaatttcttcgactcaaatttcgttaatacaccatcaaatcaaaccagtcccaaattgaatgtcttctgtttgtgactcgaataatgtatgctcttcaactttttggttgcaatcaaaatttaattttaaaacttaattttaatgttttgtctgtccatattcttatcgctggatcatatcaagtagttccgcttgatgcgcttcaagagtcatgctatgtacatgtggtggaataaaaaccttcgcacgagcaaggcgggggttgaaccaaggacctctcccccgacgagcatggcgcatgccgttgagccaaagacatctttttgtttagtcatgcccgatgtatagtagttacgttgtaactataatacaatgtagttaggttcgaaagttttttactcaaaaaacatggttcgaaagttttttactcaaaaaacatgctaaagacttttagacagacccataaatacaaatatttatactctaacagttgagtcaagttggtcaagctgagtcaagtcagagaaaatagaaaaaaagagaaagccaaccaaagcacaaccagagttctccgcggggtggagcgctaagaaagagaaaagcgttatcgctatacgaaatgaagcagcggctagcacgctaagataaaccacttgaatatatagttttacgatagacagatcaaatacgcgtagttatgtgaaatttattctaaaaattattatcaataaattattcttttagtctctaataatcgttaacttgtattactccgttaaaaaagatacaaccttagccacgaagctaatcatatttatgtccagattcgtagttatgattgagttttttttttttaacggaggggtacgtaattaacttgcatggccgagcccggaatgttccgcccctctctcaaaattcaaaatactacacgtactccacgtatatactacggggaaagaagagtcacgcacacgtgacaggtctcagctagtcaagcgagcacgaagccaaccgcagcagttgggagacggcgccaacatctcgcgagacgatccaacggtaaccacacaccacaccgcctcaaacccattacccatcccccatccaacggcgctcctccccccacccccaacacgatatcctgatattctcccggttttctcgcgagcggaagcccctcttcaaaaatccgctaattttacattaaaccccctccacccatcctaaaaaagtgaaaaacacatccacaccctcgccctcgtaccaacggtacgcacgcggagagccccgcgcgtaatttgtcaattctccaggggctaaattgcgaagcgtgcagcacttttgcttcgctagctgcctctcctcaagtcgctgcgagtgcgagtccacacaacactgtgaactcccccctctcgagaaaaaaaaaaagatccaaaattttttcgcccttgggttcgaaatcttcgtgccttcctcctcctcgcggcctccaattcgaacgccccagttgctcgcgccgccgcggattccccagatcccacctcctccccagctcgcgcggcccaattcgaaggcggttctagggtttcccggcacgaatttagggtttcgggggagcttcggggggtgttgttccttgttccgcctagggtttggaatttggggggcgtggagagatgggataaggagggtgttgggagggtgggagctttgcttggggtgtgtgtgtgtttgggtggtgctgagctgagctagggtttggtggtgaggtgctgaggaagggaggtggggggtggaaaatgttctactcgcagttcatcttggccaagaaggggcccctcgggaccatatggatcgcggcgcatttggagcggaagctgcggaagaatcaggtcgcggatacggatatcggcgtctccgtaggtgggtgattttgctgtttcacaagcttttttcttttcggatctactaccatttttttttgtttctgttcgagcatgttagggcctcacacgtagactgctaaagcattgtctttgctaatgctcgtttgtgctgtaggagggggaaaacattttttttctcgcttatttatggttatatgtattcttactgctcatatgttgcgattaattagtaaaagatgttagcttttttgggatagtgttagttcctagttgacctagttgttgctggcagagcaaccatatttttacaactatgctaatgagctgtctcttcatttttgcttatacgtgctcgtctgctggattatcactgttgtactacagtaataggaaaagaaaccacctgtatcaatgcagtcgctgattagcttcttacaactgatagattggtaaaaagtttcaaccttgagttgcactggtcatttggttgttagtattaatgcttcatgtggattttgttatgccatcactagagttgtaaaagctatatgcttttagatgtctgacaaattgcggatatagtgtttttgttctttctcggggacaaagaaaacactaactccctcactagttacaagccacttgttcactaatatgacacaatattttattttattatgtgcttttacagtatccatcgtcgtcgctagttgttttatagatttaatcgtaatagttaagtacagcttattagattgagaatgctggtagcttgccttcaagcagaactactactggactggttttatcacggatatagtggtagagatgagatctctttttttcctctgatgttgctctgttgctaatgctattatatgcaagtcaatccagttcaaaatctgggtttacgatgaccagaattcaatacttctgtgaaggtctcagacaacataagtgcacagggtctgtagagaaggaagcaaaattgtagcataggatttgattgcatgatagctgataatgcatttgtacacagtgaagcttgtgttaaggattggtatctgtgatgcatgtggtatgtaaggacttggttacggaattctagttgaagtgtagcaaacatgagaaagaacatcttttttttagtgccatgatcatgcaatattgtgaagttggttaaggctccgtgatattagctgtcaagtcgtgtctctacacagtgaagcttgtgttaggaataggaatgtgataatttgtaaatgaagcccagcgaacagaaagttatggaatttagaaaagtgtaaagctagttaaatgttgttttgaccaaaaaaaaaaactacacaagcatcattcggacaaatttcaagtaatattggagtgtatatggggaatgccatgagctatccatagattccattcacaactggattggggtgtatatgggaattttattgaaatatgcaaagaggtgcgcccaactaaacaatactccaattcactttcaccatgtacatcactttcctgccaaatttagaaagatatgaggattccaaatacagattaaaataatgttccaaaggtaccaactgatccgtctcattattttttaaagcataccatatacggtcaatatagaggatgcgaacccgacaataaagatatagagagagaggactcaagaaaacctccagtagctgtgtcctgtatgcatgtgcagcaaaatgagtaaaccagaagcttctttggttattttcccatttatttaaaggtaaaagcaggctagagtggcaatggtttgatggagatcaaggctgataacaacattatttccatctccttataccaaatttaatacgtgtctgtttcattgcatgcatattgaagggtgactagtatacgacttgaaccatgtaatttgtaaaataaaataaatacgtgcatgttaacccacttcttacttagaagatcactcaaacctacataagtgtatgtagcatgtaagagccatcgagcaatgtaaggttccatgccatatatgcatgagttatatattgaagaaggaaaagaaatcatgttttgttcgcatatgagaaaaatgcaagctgtcgttgtcttctcatttcgttcttaccattttgggatatatttgttttctttcgtgcaattactgtgtagttacttttatgttcctagcctttttttttccgtattgcttgcatgggttttagtaatgcctgtgtcaatgcatgctatgccaattggttgccagctatctttggtagcctttaattttctccaatggaaaaatgtgatcaatttacttttttatgaatgtaaatattccactacatcggaaatctagtggtgcggtgtacgcgtgaatgcctttggccttgtccaggcactacatatccttccagctgtcctacatcatcctgtagctgcagctgcagtcccacattgctcagtagatccacccctggccaccacatgtccttacatctaatatgttaatttcttctaaaaggatagcattgatgatagaaagcgctgtcacgccatcattgggcaagcaaaccagcttatagcagttaattggtgaaaaacattcaactccattcctttctccaaagataaaaatagaagtacttagatgccacatgtgtctgttatgattctaaatagtactccactatttagtagtataaatacaggaaaaggtttccattataagtttattataacatcaacacatggacttaaaatcttagagcagctgaagcatggcattaactctgcccatgatacagggcaaaccaccatgtgcatcactaaaacactcactagtgcaattcacagaattttgtgatggaaatgttatgttttcctaacagtggtcatatatctgccatatgtctttttttttttcattttgagcttagtattaataatcatttttttcctgcagattcaattatattccctgaagttccgattgcacttcgattatcaagccatcttatgcttggtgtggtcaggatctattctcgcaaggtgaactacctattccatgattgcagtgaagcgttgctgaagataaaacaagcctttaggtctactgccgttgatcttccccctgaagaatcaactgctccttatcattctataacacttccagagacattccatctggatgattttgaattaccggaggctgcatttcaggggtaagttcattggttttgttgtgataagtttgttatttaaaatgtgcccttcaactctcttaagattttccaccatgatccagtgacattgatcatcatgtaagcacaaaagaacagatcaccttgcaagacaacccagagaaaactggatactcaacatcccaatttggcttagatggttggtccttctgtattcacgccatctacttttcgtcatctacttttcaaaatttgaagccagccatttaatcatattaagcatatctctatttacagaaagatttggtgatggcaattcttcacatattgggttggatttggaagaggtaatctcagctaatatatcttttctccaaaaattcattgaaatgtttgtggtcttcatcctgcattatcttgtatgtgctgtttggatctttttttatcatctcagtcttctccgcattatcatagatgtacttccagagtaaatatttactgtcatgctccataacatggcagttcttcacatattggtttgtttttaggtcataatgatagggaatgcagattatgcagatgaaaactcattttgagttgtacaagaatgtttagagcatgaacattgaacataacaatgattttaccatgtaccaattccttgcggccattgtctatgccttgtcttctggttgtatatttggcagctttggttcattacctgttagtaatcaatatttcttttgagtatagggtaacacatggctaatagatgactgattaatggaagctctctatttctggttgttgtgttattgtgtcctatcacttgataaactgcaattccaaaacaaaactttgtatatcttcagcagctaaattttatttgtttccccctcaggaattaatgctgaacaaggaccagtcaattcaacttgaggctgatgatgggtaaaatcacctcttccacttttttttataaaaaatagctattcaagtcccttggaaattttatctacacgtctctgctcccatataaagggtctttgatcctatctaaaggagcctttgtgggttttcacagatgaggttaagtttctctaggcaattttatgttttcctataacttctgaccttatattgtacacttggactgagtctgaatcaacccagggtctagttactactttctcctgatttgagtccagatggccatactggggtgtgacactgatatatttgctacacgtgttgtgatttttttccatgacatttgaaagtggcagcatcttgcatttgcctttttctgtatttttactttatttacattggtttgtgcctctcttcagcattattattcaaggtcgatcagcagttcatcctaccgatatggaagttgatgataaccaaaataaagatgaaagcgctgaaggatacaacatggaggatggaccttccagtcacaacaaactaaatccgttaagtgcagatggtctagtaggaaacagtcttcctaattggcatacatacaatgtgcaaacacctgatctgaatgatatgctattgaacaatgatgggaatgcaggaccatcagcttcatactatcaacctagtcccttcccttgtgatgagcctgcatcaccagagtttgtaagtgcccaggccccggctacacctggcctaatggaagagactgttccttccagagtgcatgaaagtcctgttctgagtccacagcgaaaagcttcaccatcaagcaatgatgaaactgcaaagacagctgaaaatgctaatgatcttgtgggtgctgaga

SEQ ID NO: 59330 - DNA, 26366 bp, Oryza sativa
ggggcccgggcacgcagcgggatcggatcacttaccgatcggctgctgcggcggtcgtcgtcgtcgtcggctgctgctgctccggctccgccggcggcggcggcggcgagaagagggatcgggggcgcccgcgtcgccgctcctccctctcgatctccggcgcggctaagatctcgatgcgggcatgggaggagggggaggaggaggaggcggaggttggggggatgttacttgggcttcgacgcttcgtctcctcctctccttttatcgaacttttgctctccacctccctccctccgctcgctcgctcgcggtgccgcgatgcgctggtggatggttgttttgggttttttacttttttgcggggagaggccaaacttttttattcggcctccggaaccctgcaattgcggtgctcgcctcgattgggaaagcgggggaggagggtggggggacgcggaaatggtataaataatggacagcgggggcggggcaggtcggcctactggcccctttgccgcgctggacgcgacgcgactctacgtggctggaggaagaagacgacctcacctactgctgcttccgccgccgccgtcgccgatgctgccgtgaagcaatctcgctcgctcgctcgctagcggcgcctttaaagcaggggaggaggaggtgacgccgcggcgcgcgcacggctgtggtggggtgttgggtttgcggcgagcctgcggcgggagtggggccagtagcagtgtgggggcccaccaggcagtgaataggagtaggagtatactgtatactcctccaggagtttagtacgctacagaagggggttggttttgttttcctggaatagggagagaggtgaggacgtggagggatgtccgcttgaacaagctccccgcggacaggacgacggcctgcacgtttaaattgcgtgggacaacgaaaaagtggggatttttttgaggatttgaacggtaaatacaaatgtttagctccatttggaactttcaaaataagtttgcagatggatatgagattactcagtcggagatactccgtagatgagaaaattatgtatataccataaactgtaactagctgggtggtcggcgcaattgcgtggctagcacccaaacaaaatcatatatttttttagtatgattttacttaaaatttattaaatagctatctcactgtcttaagactttgaaagaccaaaccttatcaccctcgtgtttctaattataaagtttttaaaagtcacaccagttgctaccccttatgtcatctccttctttatttgcttgctcaatctactattatttctatttattcttcttggaacctttaaaaattagattttatagtttttagagtttattgtcacgttgagtttcgtatttataatttctagatgttccgtcaaacgttgccattatactcctctacggcccatccattgtttcttctctttattgtcattgagattttaaaaatcgaacataattatcgtttgggttcattttttactttctagaagtcccgccaaactgtcagcggctttgccattgtactcctctacggctcgtccgctgcctcccttctttattgtcattgagattttaaatcgaatataattatcattgggttttttttactttttggaagttccgaacctttaaaaattagacttgtagttttattttttataatttttagaagtcccatcaaacgatgccattatgcccctctatagcccgtccgccgcctactctttattgtcattgtgattctaaaaatcgaacataactatcgttggaattcattttttattttctagaagtctcattaaccgtcggcggctctgcaactatactcttatacaccccgcccgctgcttctcctttttattgccattgagattttaaaaatcgaatatgattatcaatggggtttatttttttttactttctagaaatcccagcaaccgccttacttgtttgctttacggcctgcctgacatccctcctttttttttagaaacacagtacaaatataggcgctcacaacgtgcgcacactcacccctatgaatgcacacacgcacaccctacccctatgagcacctccgaaagactgggccggcatatcttgacatccctccttttaatcgtcattaggattctattggtgttttattaacaatttttatacgtcgtctcaaccgccaccactctactcctttgtaggcctgttacttaatttatctcgtcatgtattttagatggtcttattttttaatagtctttatttttatcacaaattttagttatttataaattatattcctaattgaaatcttatttttctttttctaatttcataatttattttttaaaaaaattagttaataccgcattgtgtactttttaatgtttttattttttatttccaattttagttgttttaaaattgtattcctacatgaactctgttttaatttttctaattttggatattattttattttttatttgaaattttaattaatctcgtattgggttcttatatggattcttctttcaatattgcttatttttaattccaaatttcagctaattttaaattgtatgtctacttaaactcttcttttgttttcttttgctaatttcggatttatttttatttttattccgaattttaattaatctcgtattgggttcttatatggactcttcttttaatattccttatttttaattccgaatttcaactatttttaaattttattcctacttggactctcctttccttttctaatttattttttttatttttattttgaattttgactaatctcgtattgggttcttaaatggaaacttcttttaatattgcttatttttaattccgaatttcagctattcttaaattgtattcctacttggactctccttttctttctaattttggattttattttatttttatttcgaattttgattaatctcgtattgggttcttagatgaaaaattctttcaatatttcttatttttaattctgaatttcagttatttttagattgtatttctacctggactctcctttccttttctaattttggattttattttatttttattttgaattttgattaaactcgtattgggtttttatatggaaacttttttcaatattgcttatttttaattccgaatttcagctatttttaaattggacttctacttggactcttctttttctttttttctttttcttcgattaatgtaagaatttctagccccacagcgaacgtggtgcctcttttcaaagctgttttagtaatataatagatagatgccatcatcaggtttgctaaaattccactatcaattcatgggtgttcgatacaatgttattttcatccttttaagtatttgcatatcgttttgactctatttctcactacccatggctccatgttttctctcttctcgaaaactggtcatctcgtcattgttttcccaacgagctgaggtaggagtgtgtggcccactagtgcaccgcatcccgctattccgtagccgcatcggcaccccgcctcagcatccatcgaagtccgccgtgtcgtggaggcggctcatgctcccctgtcgtcaagctgggacgcatcctcctacgggggtgcatcctccagagcggggttgagcagtgactagcgggcggcacaggggtgagcggccaggcatgccggggcggcaagttgtcctgggtggtcgagtctggcgcttgggcggcggggacgtcaaggaatccttgcatcactctctgctgagccgcttgccacctctgcctcctagttcgccactcgcattcatcgtcgtctcatcgtttcctcaatcaatttaatgttgctcctttttgtttcttgcctcgatgacggtggttgattcctctccactgttgcctcgacgtggtaggacttctttttttcttttgggtcttcggaggaggtgtgtggatctttcgacccaacgatcccttccatccatgggcttgttgcggcagcggtgaggtggggcggtgttggcgtgtacgtggctcgctgcctcagccaagagaggaagaaaaacgtgagaataacaagtttggttcgatggagaaaagaaaaaggaacaacctgtccaggtccaagggcaactccagtagaatacaactaaaaagagtgcaaaatcatttctatttatataataggatgaaaacaacattatacggaacgccctccgattgactatggcattttagcgaaatccactaagtgatggcattccagcgaatccactcttttacgatggtgcatatgcaaattttcgtggatagactgcatcaattagttcccctcccggcagggagactcttgcctataatcgcaaagtaatatgctattatttccaaataagtgttaattcaactttatcaccaacaactcttattaaaatggttaaattaagaggatgggagttttaagtttttcatagcttgaaacaaagtgcgggattatccactattaaaaaaatgaaagttttatgtttatgattatgaattagtataatgctacacactttggtattattgtatcctttgaagtatttatttttctaaaaaaacaagtgaatggtcaaattttgaggattagtgttgttaggtgacaattactttaaaacaaattaagtatttgtactccttgttcccattctcttcaaattaaaaacagagccactaccattttttgtctttaaggtatataatgtaggaaaaaaagaacatttagtttaatttgaaatattttaacaaatgagagagctaatgatccgcatataaaaatggtcatgtttaaaggagcttctagcaactacgattttatagagtcttagactccaccaaactatccgcattattatccaagattctaataatatatagtagtaatagagtacacaaaaaattaacaaaagaacagaagttgagaaatccagctcttctacattttcaccatatgcttctcaaaaagtcaaaatttgagctccccgaagctcgcgaattggtcactcatgacatcacgtgattccacccatcctcctggatgcgcaattctctgcctcccagctcgctactcgcacattagtacaacacaccgagcatcaccttcctcactgcttctagcttgtcgaagaagtgcgcctcctagctcgcccacctctattgagcttcactgcctcggcttcgcagctctgttatgctcagttgcgtctccttctctcaacaggccggcctaccactgtctcacactccctaactcgttgtcaacgagttccgaccttatttccctacatgtatgccccctctccttcacctgggtccccgaccgggttccgaggacccatcggggttagggatggggcctggttttccttgatgtgccccgttgtcaccactaaatgagatgcttagtagagaatttaagttatttaaaatttaaaatttgactactacagagactaaaaagaatattttctctctatcttagtttttttttctaaatacttatatgataaaatgaaggggagtacaggcatatgtatgcagtgttcttgtttgtgccatgacgatgttaccaataatgctggtggtgagagaacgcatagtatatccagcttgagaccgttgtaacttacctgtcccacaaatcgacttaacaacaataactgagtaagcatgtgatgcgctaacttcgtaatgtatcataattagattatagtacaagaaggggtgtaagggcctatttgattcagcagtttttgtacgctttccgaattacgaaataatgtttttcgtaaaaaatttatataccaaagtttcttttagaatcaatttttttaaaaaaattataatactttattcttaattaatcatatgtgttactgattcgcttatttttcttgcttacgaagccgacatctcaatttaatgcggctaatgtaaatgatactatatgttaattaatgcgttcattttggtgccaagagttattcacggtgaacaaaagtgtggaatttgttgttggagggcctcttattatgaagagagaacctattccatgtcatggagtttcccctagttcaacaatttgccagtgtttctcctttctataatataccattaggctgtgttcggctcttctagttcccatcatctcctccctagttttccatgcgcacgcttcccaaactactaagcgttgtattttttgcaaaaaatttttgtggaaagttactttaaaaaatcatactaacccattttaaaattttttagctaatacttaactaatcgtgcactaatccatcgctccattttccgtgctggagagaacccttacctaagaacaccgcctaagtccatgaacaatattctagctattcaaccacgtacctttttaaaatttcccaaaatgcccttacatatgttaatatgtattatgaataattgattgaccggctaaaagttccaaaagattatggacatttttgtgtagtctctttgcatgacatataagtggttgatttacattaaaaacaaggaaaaaaatccaaataaccccataaactttggatagaaatccgtctagcaccctgaactttgaaaccggatattcaacccctaaactttgcaatgccgtttatacccctaaggtagttttgaaaatttgtatgtaagttagatgggtttgaccacatgacccacacgttagacatatatattaaaatttcgacttaaatctatcttttactctattagctttcacttacaaataagtaccaatataataatagtataatctcactatataaggataaattgataagttataactgattacaaataagtaccaacataataatagtataatctcactatataaggataaattgataacttataactgatgatttgcaaatatgttttattagttattcaaagttgttcgtttaagcttccaaaaaatatgcaaaaccaccatataaagccactttaggaatatgcaaaaccaccatctaggggtgaaaacgggtcgtgttcggtcagaccttacccttcccatatcctaacccatattttataatcggaatcgggtcggacacagatagtgctgaatacggatacaaactcagataatgtcgggcaaaaatacggaacgaatacgtaccaaaatggatacgtacactatctcggttacaaatatttattcggatatcaagtcgaagcaataatcttatatatcacatagacaataactattcaacaattccatatatccataatacgattatattaggctattaggacctttgaaaataaatagggtacaatacatcatagtagaatcaatatattgtaccaaaaagtgcctcacaaaaacataataggggtaagagatccgtataactatccgggtaatacccggattttttaccggataatctaaatccgttgaatactacgttcccgaacatgatcttgtatccgtcaaaaaatacctattcggacccgatatccgtgaaaagtcccgggtacccgaatttgtcctgaaataatgtgatcacggacgggcgggcgggaaatacccgccccgttttcacccctaccaccatctaaaaccactttaagagggtaatatggacagtacagtgaagttttgggggttgaatatccggttttaaagtgtagagtgtagacaaacttctatccaaagtttagcggggtatttgtactttcctaaaaacaacaacaaagaatattctatatagcatatgacatacacacacatatataatattttataaaaataaggtagtgatcgaaaaaccttccaacttactccctcagtcccaaaaaaagacaaaccttgggtttccgtgtccaacgtttgaccgtccgtcttatttaaaaaaattatgaaaaaaataaaaaaagacaagtcacacaaagtattaatcatgttttatcatctaacaataataaaaatactaattataaaaaaatttcatataagacggagagtcaaaagttggacacggaaacctagggtttgtcttttttttggacggagggagtagggacgtatactcaaacttctatgttgtataaggaggctacacaaaaatatttctaattttctaaatattctagtaggataaataaattgtcaaccttatatgtttataagggcatttctaaaaaaacatgttccaataatatattgtagaaacattgataaactaagactaggttgactgtaaatgacgtgtcagattttagagctactagtagttggctatattattaaacttgctcttagctatttcatttctcataagagttaaatttagaagaggactataagtgggtcccatcaaataataaaaacaatatattagatattccctccgtttcataatgtaagtcattttagcatttcccacatttgtattgatgctaatgaatatagacatatatatatctatctagattcattagcatcaatatgaatattggaaatgctacaatgacttacattgtgaaacggaggaagtatctcatatgcatagagagagagcgtaaggagagaagtgagagattattattttatcccttatggctaccgatatgcatatggagagagaacttactatttatcatcctctcaaatatatttttcatttccgtttgtcagctgggcccacgtgttagcccccttctcattcgttgagtttgtggacccgtgtggacccagaaaggaggctaacatatagctatggactaccaataaactatatgcggtttatgctatctactattattacattgtggatgtcctaagaggtgatttgtgtattaacagtgtagtaggctattagatttgttgtaaatgatatattaaattttacataataattaattatactattaaatatctactctatagttcaacaaatactttcactcattcttccgttctttcattcatcgctcaaggttcagatcatccgcctaaaatccgaacggtccagatcgatcctgcctccacccccctcaatcagcgcaccgctcccgcacctccgccctccgccagaacaccgctcccgcacctccgccatcaccgctccgctccgtatcagccgccgcgccgtcctctgcatcgcctgtcctccgccaccccgccgcacgaggtgctcccgtcgccaggtagccgccgcgccgtcatctgcatcgcctgtctccaccgatcccctccgcacgaggtgctcccgtcgccaggtcgccgccgacgccttccgcggtgatccgatctgccatcgaatccccgccgccggctcgtcctccaagatccccatcggcctgtcctccgcctcctcgccgcacgaattcctcacgtcgccaggtcgccgccaccgatctgctccaccgatccccgccgcacgaggtgctcccgtcgccaggtcgccgccgacgccttccgcggtgatccgatccccgtcgcctgtccgcggtgatcagaaatttcatcgcagcgcctccgccagggcagagcagttgagaaggtatgggcgtctgatccaaaatcccagacatataccatgtgatgttgcaacccactgaaatcccagatagaccttgaacactcaagattgacatcaccacctcttgaatgttacaccatttacttttatgcaatattatacaagcagttgcaaacgacggccattccgttaatcttgtgatcataattgttatgacacccacacagtcttttgtttctatataagaagatcaatgacatattcatctgtcatggcaggtagaatctccaattcaaggggctctgcgccttgttcctcaacaagagaaggtgaattttccaactgcaactgcaaatctttcatcaggctgtcaagtaaacatttgtactggattgaagctgcacctacattatcctgttgcctggcatattcgtgtgtttacatggggttgaggtagccagtgttgatatagatatatgcaaactagactcgaggatgctgaacatgtttttttttttacagttagttcagaaatatttaggtttcagcattgaacgaggttgggtttttcttcccattgaacaaaaggcatctgattacaatttttctaaaaaaaattatttaggaagttctttgctttttttttcctcaacaagaaaagatggttagcattgagtcataaacttagaggtacaagttgctcaactgctaaggtctgttttatacaggtataatggcaggagaaatgtcaccaaaagaaaattctttctgttgattcacattattttccagttaaatgcgttcatcatttacccatttatttggatcacgtgcattgtcatttgctgtaatttactcatgtcccctaggtaactatattaaacctaccatctttccgaattgaacctgtttcatgtgtagttttcagtggtcacctgttggttgcttccattatatcacacagatttccaatctgactggtaatattgtgagatcatttttttttgtgtgtcatgttctttttatcagatgtgtcattgctgtacagaattaatatataattctcatgtgaacccgttggttgttgttcttttattagttgtgaatttactaaagaaaacatccaaactgaatgacgttggttactgccaaactgagatcaagaaatacatctactccagtagatgataagtccacctattggttcaatttaaaaaatctgaatttggcaaatttaagaaattggttcaatgtacgagcagcatcatatttcaattactgacatactcgactgcaaaactatttcagggctaaactgaattggagaaagatgttccgaagtactgtgataagaattcaaatagtgtgaagtgcaggaaaccaaggaggtatcgcttactactaattcgctcttcaacataacctggtgcttatatattggcatggttttgtacaatatatagtaatcaagattcaataatccgagtatagaagaaaccttgctgcacaaccatattgtggtgtattataacatttaaattataatattgtttggcgacatgatagttaattgtacccatcattcacgtggtcgaatctgctcttgagttattcttttagtcctgagtttaaacatggtgaggggaatgtaaatgcagtggaggaaatcgtgtatttaacattgccaaattcaggtgccattggcgattaacatcctatgttttatttggtgcgacattaattttgtctagccacttacgatgtgaaaaaagagttaacaatgtaattcagctgtcaaggttatttcggtcgtcctaacgtgtcttgtgatcctaattgttagaggataggtcctttttttattacttggttttaaatgactccgtaccgttaggcagtttggattcatcattttgcatatcagccataataagctttaggctcctatttcagaacatttcaccttgattggatagatgttttgagttttatatgaaatgccactgttcttcgagaatttgcctcaaattaactgctaagtttgggttgtacatgtaccgctccaaatataactattttcctattagtaattataaaattattctcttgattctctgatgcctcgaaatattaattagtattttgcaccccgcaatttccaacagggatccagtccctgttcgctgccgcccctcatctccgcatccacgccgccagatcgccgtcgctcggattctggtacataacgtcgccaatctgctctccgctgcacaactccattgcatctctcgccagtctgctccgccaacacgctgttccacctcctccgcctcaagcgccaccacgaccaacacaaatcccctacgccagttaatttttaaaaaacattgaggtacatatcaaattaatttttattatgtagtcatgtgctcatactacatactcatcaaaaatacataaaatgtaaattaggtgcgcatggacgcaaatcgggaggacggtggagctcgcaaatccctcggagatataacaaaccaccgtcaaggtgtacatataatggatagttcgttgtgtacaacgcaggtcttgtccttttcagtatgactatagtgttaataaaaaaatgcaggtcatgtggatcaatttgggctatccaatgagtctcagcgtaaaaaggaaagaaacttcaaacaacgtatatatcgtgcaaatctggaggctaagaagaaatgtagtacaagtcctatgcaaacaacgcatgtgtcagagtatgaagaatgtgatagtgccgaggtcaatgttgctgaaattgccacctcaacaaagagggaaaaaaataacagctatctacgtgagtggcgtgcaagaaatagagcaaagtcgagtgttgttaatagcactgtaacatccgtcaatccaactcaagcaacaactacatctgaaataaaccagagtgaagggggtgtggtagggacaagtgaactttctgcaaagaaaaagagagaggatacaaacaagtatcttcgtgaatggcgtgcaagaaagaaggccaaatcaacagatggatgcaatactgtatcttctggcacgccaatgcagtcaactattatgacccccgaagaacacaatgaagatggtgctgttcagcgatcttcaatctaccctatagttaaacaaatactttcactcattctttcattcatcactcaacgtccagattatccccaagagatctaacgtccgggatagcatccgccttccctcacccctacgcccccgaaatcgtcgcactttccttccaatcgcgaaatccatctcctccgccagttctctcgcccatcgcgcctatgcacgtcgccgcccccgtcgtctcccggcgctcgcgcccccacccgccgtccagaccgcatcgcccactccgccgtcgcacgccgcacaccacacccgccctcccaccccgccagttgtcccctccactcaccactccgccgttcatcgcccttctcgctggtctcctccgcaccgcccccgatcttcaccaggaactccgcctcgtcggtctcctccgtgccgcccccaatctccggctcgtcgactgtctccgtgcaaccaccaatctctgctttcagaacagtgtcgccccatcctcgatctgattcgccgaaattaaggtacagaaatcatcctccctccttttttttaatccacaatccagtactatatatatttcctctccccccatcagtcgccgctgatttgatcatacgattcttaatataatccagaatcaatcaaaagaaaaaaaaaccgaaagcatcgttttggtatctaaagaattcatgtttttagataatgataactaaagtatctatgtctatgaacaacgcataactgtctgcacatgtctaaacatctccaaagaacaatagtatctggttatttaagattttacacatttcagaagtcaaaccttaaaattcgattttcactggcaatgacagaatatttaagatgatgcaccatctatgtcaattatcagtatagtagagattcattccttgattaatgaaatcaccatcaccatgcatatgttaggacaatccaattgtttctggattcttgacagatttggtcaagatgaacttatgacttcagtaagcttttgactaattctgtaccaagatggttcatttttaagcaaagtgcaataagcttcatgaaacattgcaccaccgtaatcttcctcatgattttcttattttgctgtataggattagggattattgatacaacatccggcaacctccacctcggggggccacaccggcgccgccgaagcccaccctcgacatctccgtgccgccaccgaccgtcgaggacaacaccagtgacaccacgccgatctcctccgtggccactacccaccggcgctgccacacgcaccgccaccaccacattgctgcggcgtctcccaacccatgttcgtctcatctccaccgtctatccccaaactgtatgaaagcattggtaaaaagaaaagaatataagataaaattttacaattttaaagcatgaatacaaatggaagggtggtttttctttagtttgaatccttcttacaactggaagtgtaggactacttagggaaaacatttttttctctataaatgcggtgctgcttcatttactttggtattatcggatgattcatttcaggagactgcataatgtttgcataacattcattattccaatgcaaaacaattatgttaatattaaaactcatggtaggttcctggtccaggttagaataccaatttgcaaaccggaaaaaaaacatgaacatgtttataagccatagcccttatccgtacatagaaacttttcttgaggtcttctgtgtcacatatatcattacatgcaaacaacaaaaggtaacctccagtcttccagtattattttgctccatagcgaattagccatctactcatatttgccttgtacttatggataaccgtgagatgttcaggtggatcaaaccagaaccgtggtttcaaggtcagtttctaaacctcaagtagcagaaaagttggtttcttatattacaatgtaaattattttatttattgtaggatcagtttccatatgctataaccatgggagctctctcagttcgcctaagttgtttgtctagaagtatgtcactgctttggttcatcaattcttttgtcagttcattggcagtagtactttggatgacaatgagattggcttggaaaaattctgcctttgagtaggcagcccagaacagatttcccctgcaatgtattagggatcacaaataatcacgcacgcgggatcaccgctcggtttcctttcccctccgtcaaatcgccaaccactgcagcctctctcccgcacctcctccagatcgcaaataatgctttattttgttcccgcaacaaataataaaataacttacttttttaacataatagcgtattatatactgaagtgattatataaacttaattcttgtaaagatttattgtgcccatgcaatatcatattattttattttacgttaaataagtatatttaatgtacgacatgaattgaattaaagttcaaatacacatatcatataaaaaaatttccgctaacatgaaattttaataattattaaagacaaatagaattgcaccgtaacgtttagcacggacatattactagtaatctattaaaatacaaatctaacctgccaactattatagctcgccggcataatagtaggtttgctgaattccacgtctgcgcctatccatctttttcttcggattgagaccacgtattcagcatcagcaatgctaggaaaattcaacgctgggcttttcttgagagggacagcatccgttgcaaatttttgttgtaaactacaccctctcaaatatgtgcaaaattctgaaagcaacttctaaccatctaaccattgtgaaatgaaaaaaaaacaaaaccaaaatattttaaccacgcaatgtaattttacttccagtacatatttttaacatatcaaacattcttattattgtttaggacaacagtacctttgggataaggagagagaaactccaataccataatgtgtgataaatctctgttttatgggttcgatatacaagtggtacatctctatcgtttgaaagggacatatacaagaagatttttgtattttcctagtcttttgcctaatgagttcttagcaggccacccttttgggcccaatattgtaagaggtccattacaaagaattagggcaatcttacatggctaacttctatggtcttcgccacttctgatggtatcatcggagacggcgtttctcgtcacttccacgtaggatcacgggcgggcttgttcactttgctactatttacaatcttattttttttcttggtaaagttacctaaaataatagctacatttaatttgttgctaaattttaataagtacatatgaaatcttgctaaaatttgacaaccttaccaaaatttggcaatgccaaaacttgataaggttgaaaatggtagcaaaatgaacaagccccatattcatgtttttctaaataatcatttgggcggacatctccttcttttttcaatgtttcagtcaactttttttacacttgcattcctttgtttttttttcgaattagttccctcccatcagaaacaacttttttgaaggaaaataaacctttttaataccgatgaactatacagatattcagaattttcgacctaagaaaaagtgctgaccaggccacctgacagtaactacaaactactcttcaattcttcagcattgccagcaacagcaatatgtacagactacatagtaccctgctcacatactactaccacactactactcgtagccaaggttcacagttcatcaaacctttggtatgggttaccgtcacccgcagtttgacggttaccatggtaaccacgtggttatcgtgaaaaccacatggtcacgtgataacccagtaaccgtacggttttgtaaacatagcagggtttacagtatgatctgcaatttcttttccacgtgtgtagtaaaaatgtctcgtcatttttttacctctcgctcagtccctcgctgcgtgcttcgttctacaggccactgagctgagctgctctgcacttgccctgcacttgctctgcttccccctcgacgtcgacgacgacgacgacgacctgctccctctcccgaacacggccagcctcgcgaagatgcgcaggatcctactcgcgcaccgccgctgcgatccccaccgcatggagccaatgcagctgctggaggacaccggcgctcgccgcctgaccgccgccgccgccgccggcgtggccgccgtgtccatcctgaagctcgcctccttccgggacgagctcttcttcacggtgttgtgccgctgcagcgtctgcttcaggggggatctcctgctccagcgcctggatcctaaagctcgccgtctcgtagcccgacgccgcgtcgtcgtcgtcgtcgccggcgcgggcgcggaccagcttcctgccgtcccgcgtggcgtgggcggtgtccgtgtacgggctgctggtgctgagcggctggctggtggggacggcggtggtgcacccggggctcggggtgtacgcggtggcggcggcggcgccgccggagacggggacgaggagctcccccgagtgcatgcaccggaacgagtcggagcactcggtgaaggcgcggtgcgtgtgcagctgctgcacgaacagcgcctgcacgatcagccggagcggcatccggtcgttctgcaccgcctggatgcacgcctcgtgcgacagcttccggcattcgaggtggccgcacagcgacgccttctcgtcgccggacaagccgggatgctcctgcaatggcagaatcaaacagcttcacaacgttagcgcgacagcttaacggactaaataatctcgtgcacgcacgagtgctctgctcgatcgtctttaccacgatgtatgtgtcgattgcttcgtagagatggtcgtgggatttccggtcgccggccggaacgacgccgatgagctcggccagccggtccggccggagcttcgggtcaccgacgatctgggcgatgtaccgatcccagagctccgcgacggcctccgcgcctcttctttgcattgagacatggctcgcgacgatgctctccatcgccctcacctccgggctgccggcgatggattggccgccggcgtcttgctctggctccggcagcgggaggtcgtccacgcgggcgaattgcaggttggacgcgaccagttcgcgcagcctcgtctggctctcgtcgctgagctcgagggtgatcgaccgcgccagcagcgcgaagtagaacgacaccgggatggcgccgccggtcgccgccgacgactcgagtgggaggaggtcgatcacgccctgcaggatcgcggtggccctcctgttggcgtcggtctcgccgtcgccggtgtccgtgctcgccatgaacttgtgcgtcttcttggagagcacccacttgttggcgtagaagagcacgacggggctgacgtacttctccttcatgccctgacgccgcagcgccagcacgatccgcctgaagaactcgaaggggagggcgacgaggtccttgatccaaaggtcgcgcgcggcgagctccttgactagctcggcgtcccaccggcgcccggcgaggccgcgcgccgcggcggcggcgaggaggcccggctggtcgcgctcgcgccgctgctcgtcgccgtcggggtcgaggatctccatgcacgccatgaacgccagcgactcgacgcagcggctgacgacaaggagctcctcggcgacggggagcagcggctggcatcgctgcaggacgatgagggcgtcgtcccagctctgcagcaccacctggttgatgtacaggtcgcagcgcgcgccgaggccggacacgtcgaggaactccgccgcgcaccgcaccgccgccacgttgaacgggtcgagcgccaccgcgtcgccgtagcagtacagcccgatcacctcgaacgcctcgctgccgccggggaagctcgccggcagctcgacgacctcgccgtcgccgtcgccgcaccggagaatcgcctgcctcaagtacccgcacctggacaccagaggatcctgcaacgacaagatcacacacactcatcaccatcttcttcctcctcatcccaaccaagaatccctaattaatcttcacacaatctctcctaaccttgtgcaggttgaagctcctgtcgccgacgtggacgctcaccgtcgccggcgaaccggtctccttggccctgcaatccaatccaatccagatcaacaaccaacccaaccatcagaacccccaagggctccaaaattccaagctctaacactctgtaccatgaaacgaccctcctctgcaggagcaacgccgtgctcgggctcgagtaagggctaaacacggcggccttcgccgccgccggcgacatctccacctccacctccacctccatctccggctccatccctcgcagattaccagtactagtagcagtagagactagagactagagagataggaggagtataaaaccggagtggtggagtgagggaggaaggaacatcgggaggagtggaaaaggggtacaatggctgagggcgcacgaatgggggacgttggagttgaaccccagttttaaggctgggaaatcggatcgccctccaccccctcgtgcaagtttccttattccctgggcgcgcgtgcgttctcctctgcactgcactgctctctcctcgccaccacagggcacagggaggcagccttgtaaagatccgagggagccagcactagtttaagcaaattaagctcgagctaacctgcctctaatggccggaatggcttatggcctcttcaggcaccatctggcctttggtatatgcacgtgttctggaaaaaaatacagtattttcatatgaatcagttcgattatcggagaaatcgagaaaaatttcatgtgtcacaaatggaggccacactttccatttggtgtgaatgtctaatgtgtgaaaagatgtgtgtatatattctcggttttgtaagtaattagtgtggtgtttccagtgtacagttgacgtctgattggggtgtccaaatttctcaccaaatggcagaaaactggatccttttgcgcctggggtcataccaagctttcagagctctgaacaggcagaacagccggtcattgttgtgtgctactcctaggcgtaaaacgtccaaggttagcaatctagcatcgccaaagcgaaggactgaaagagttgcttggaggtaacaatctccatataataactgccacgagactaagcatctcctatgattagactatctgtcctctgctaatctctctagatgggcttctttttcagagaaacttataatgaccaaatcgtacactatccggtagcataagttgggcagatagatgctcttccacacaacttttagattaaaagaaaacaagcgtgcacattgacgaacggacggagctctgaatatcatagtaggaagtatagtattatcaaactattaatcaaggtcactgtcagttcatttcaacgggcgtttcatcattcaccaggcatgcacgccagagactcccattcggactcggaactgtgaaatggtttctttaagcttcggtagcaagcaatggcagtgtggtcgccagaaaaccttgtttctcctgagtcctgacaattgcgttgccatgacaaattgacacctttgtattctcctgacgttcagaagtagctatcagattaaaaaaaaaggaacctaaaaaataagagaatatagcattcgtgtgattgcttagctgattagtgctgtaatttatgtgcgatcacactaccggcatggtcagcgcatttctgaatctaagttctgcaatggcaagattgccattgataaaggagaatgtcggtaataatcaaatcgttgacgtgcatcggacgctgcagaaggtggggaatttaagggcgtcaaatgccagtaatattttgctctggaatttggggggtatcgggaagccaatcccccacaattcttattctcattgatgcgttgaaaacttgaaatctcccgaattcttttcgtggctcgtgactgcatcgagatcggtggtgagaaatttttactggcgactcgatcgtgcttgggtttcagctcaacggagaaggagacgccgggtctgcaaggcttctcacgcccgtgactcacattttgatttttgatcgcattaaagcacccaagggcgtcgttgaaacggagagaaacaatgcaagagaggaatggacgaactctctccaattggcaaacgttacgtatcgaactgtcaatctcagagggtcagaggttaaagttaaaaaaaagaaagggttactctagattgatctggcgaaaggtttcgcccactgttttcgtcgtttcattgtatatgtttatagtgatagaattctatgtttataccattcccaggctctcatcggatggcccaataagccaaagaataagctaaattttgaattttcaaacttaattttaagattgattttaagatattttcaacgtattttttttcagcattggcttttaaattacaaagaacacatatataaaagttttacctacaaatttatttttattccctaataaaccgttttggcttattagaaaaaaagccaaccgatggggccgccaggtgcttggatgaaaataaagtttcacagtaggacatgtatgcttataattgaactactttttcatttttctctctctgttgttccataaattcatagtaaaattcgtaaaaaaaatcaaaatttataatggcaaaagagcaaaacgcttggacaaacaacaatcgatatttattacttgttcagttaacatttcacctcacttgagagttcatagcattaaatagcatgccaagtactataaaatttgcactacaattagtacaaagagatgcaagaacaagtaatggtacgaaatacaaccacaaagactccaacaaaactattttttcgctgggctgacaaagaatgccgaccgaacttgtattaaggagggagggggtaaaaatttatagactttgtaaatgctcagccaaaacacagaggatgaagcatatcgggcgtgagactgagatgcgaagcgagccctgtcataaaaccaaggcaaagtgcctgatgacctgggctcgtcggcacaatgctacacttcaggttaccaatctgttgtgctatgctaggcacctagtccagccatcttccatgtcctccgctcatcaattgtgcaatctgcgacctacagtaactagtgggtgaaggcttcaaagactcttgtgctcctttctttccagatcatccagcagaagaggcatatgaccgtgtcgaacacctggagactccaacaaaaatttatagtattgagacatgtttccaatgtgtctagacattaggtgattaattgggattgggtaataaaattgattagataggttcaactatgcactaggcgaacaacttctttaatggtgtcttagattacatggattagatacaacctattttgtgttgtatgtattgggacggctcttatagcccttcagaaaaaggaatgttttattttattcttcagtaatacaatatatagtcaattaccttatgtatttctcgcactgattgaatgagctctctcataactagaaatcttcgcaaaacatgcacttctcatgtaatttatcttttttcacaattatatggaagacgcacatgcacacatacaacacaaaatgcaacttattttataaggaaaaagtccaacttacccagtcaactattgtgatagtttggattacccgcgaactgcgaagccatacatttcacacccttcaacttttgacactagacaaattggtcggtcgacccgagataaaacacgcgacaatccaataagaaaaaaaaatcaaggaacccacatgtcatctatctcctttgtgtgtgtggaagcagttgcctctgcaacgtaggtaggtgccgcctggtgcagatcccatgctcttctcgaagcacacactaacccgtgcaaaagcttaccaccgacattgtagaatgtaaagctgcgtccgaatgtgaagccacctccaccactgcaaaagcttgtggaggtgacgatataggaactcaagctagctcggggaggcagatcttgccttcgctaagcacgtgctagaggtcgagaagtgggtggtggtctggttgaggcggatatcgtcagggcggagcttggtatgtggtgagcaggagacaacgatggtgagctctcctgttgaggtcgatgccgtcattgggcgagctattgaaaattggtgacaaggttggagaaggaggaagacgaagagagaaggtcagtggcgtggcgctgaaggtatcgatattgacacaagttgcaatggtggtggtcacctaggggatctggccacaacagagggagaggaggcatatctcgtcaccgtaggcctctacgttctaggtcaccggtgtcatggtgaggcttccttcgagtttcaagtacactgtcaatgcaacaagcccctacctccaagtctacttccataggctttttgtgagagagaaagagaaggttagagagagagaaagggaaagagaagaaatagacattgactgacatgtgggccactagatcttttttaatctagttgctgactggaataccacatcaggcaaattattgtcatatgtgtgtcatgtagggatcaaaatgctctgggttgtgttagggggtaatttgaccagattaaagagtttagggttcataatttatggttctttggtttgattggtggggaaggggaaggcgggataattcaaactgttgcaatagtttatggggtttgaacttttttttcctttttgtaaaacctttgaggacatctacccaagtcaattatcaatccagtcaaggattttatgtcattagtttccttgccattaaaatgcacttgtatgagtacacctagcgtcaataatactgtcttggttagtccaactacccaagtaaggtaaaggactttagttcccttaagattatgcccctccttagtctatatcaaccaaatttccttatagatacaactcataaaaaaagttgtgtataatcttgaaatgttccatgtatccatgacaacccaaggcaccctaccctaagatgtaggaggcctatttgggaagcccagaacccccgtgttcatccctgtggttggactgggagtctgggagcttgaacccttgtggatggatcggattaggattttaggcctcccaatcgagcccgtaaaaatcatttatatctgcctttagaatgcctacaattgaccaaagatactggaaaacacatactcctaggtgcgaacaagctgacatccagaaaattgaggataaacaaagatacagcaggataagtccttcagaatccataggtgcgaacaggctgagttcgaatgattcttcagcagatgcgatgccccacacacaacaccccatcacctaacgaacttgaccaagagcaccaaaatttgtggaatgtgcatggatacggcaatggcattgccactgtatccgatgtccaacggcaacatgataaccgcaagctctaccactactccacacaagcagaactgcagaagacatgtatgcgctttttggtggaaaatgctttccttcaactgaattgagctatccgtttgccagccgtctcctctctgtacaggttgtcggacagcctgtttgcaacggacgctacgtaccccgtcgtgtttcctgaggcttgaagcaaaaaaagagcagcgcaaaagaggaaaagggcccgagatatctcagatattgattgggtctcacgtctacatccatctgattttagtattgaactataaactccagcatccagctcatggaaatctcacacctttaatttacaaccatcctttgaaaggattgtgacacatttgacacgcaaagccaaagccaaatacagctcctcatcttccatttctttgaagctcatgaatcaaatcagtacaaaccaaagaacaaacagtacaataaatactacagtactagccactaattaaccacatccaaagctacaggctacagctcgagcgccggtgagacatgaacctataaacatttgctactcgctggagcttaattcgtttagaacgtttatttgtttccaatcgaattcacatacaataatttctagtactacccagctggttaacaggctagccgagcgtgccggtgctatcgtcgtcgtcgatgccggcgaagaaggggtcgcggaggagctcggcggcggagggccggttccggggctggccgatgcagcgctcgatgaaggcgcggagctcggggtccctgatgcgcttgagcgcggcgggggggacgccccgggtgacgctgtggtagatctgcacgacgctgtcgcactcggcgtagggcatctcccgcgtcaccatctccagcacgcacatcccgtacgagtagatgtccaccgactccgtgtacgtctccgtgtacagctccggcgccatgaactccggcgtgcccaggatcgtgtgcgccacgtgggtcttgtccacgatcgccgccagcccgaggtccccgatcttgacctgcatccatccatcgaccgatccaggccgatcgagccgtcgtcgtcgtcagccacacgaccaatccaaactcgattcgcgagacagcgacaagcgaaagcaagcatggcgtgcgaaaattgcgcgacgcccacgcgatttgatcgatttgaaggggtgggaaaactagtgtgaaattaaagagcgcatcagcgtgcatctcacttgtgttcccttcctttattcgaaaggtgcagctcatgcacacaccgagagctactactactacaggtcatcacggaaaagaggcggaaagggcaaagccacccgctaatcccccgaatgccgtgatgccccggtcggtgtacatttcaacagccaataaattatactccctccaaccaccgtctaccaattcaaaatttgaataccatttcagttttcaaacatttcattttgaaaaagaaaaatggcagttcaaaggcctaattaagctattgctttgctcctaatatagtctagcagatcgaacgttatcatgattttgattgtaattaattctagccctaaatttttgggataggtgagcttgtcaaatctgctaatctgggaagaaactggatgcagtaatgaggggtgggggggaacctggccggtgttgccgttgatgaagacgttgctgcagttgaggtcgcagtggatgatgcaggggtcgagggtgtggaagtggtcgagttcgaagaggatctggcgcgcccacttcttgagcgccttgacagagacgtagcggtggcggtcgctgtactctcggaggctgccagaagtgcataccttcgtgatgaagttgagcacgcccgccgtccggtcgagcatacctttgtgtagcccgatgatgtgctcgttgtggagggagccg

SEQ ID NO: 59331 - DNA, 43593 bp, Oryza sativa
tccctcgacagggagccatggcagaaggagagggaggcaccggaggagaagccgagcgccgtcgcgagttcaacttccgccttgccgcactccgccgcaaccacgacctccagtcgggaatgaaggagaggacgatggggctgaccggagagaggggaaagggagagttgtgtgactgacgagtgggtcccacggcgatttttgcactacgctgccatgttggcataccacataggcaaaagtggcaaatagttaaaagggcacaaccttagaagggcaagaaaataagggcaaatataagaagggaatttggatatttggcaaacctaaaagtggcaaatagttaaatttcccacagatatggcatatcttcacgtatgcggattgttctcgtgtacgccgaaggaatttatttcgaattatggaaaatatctctacgagtcaagtgatttccaaagtcctgcttggtggggataaagtttatgttatatcgtacaagatccgatgtctctgagttttacttggagatcaagatgatccacggtattaaggggcccaaggaggggtgcaaggcatcaaaattcatcaccaacacacccaccatagtttacgaagccagagtactcggagctaggtcaccgggagatctcgtcgggaacatcgactacgatctcgtcagtatcgtcagtttcgactactttctttgtaatctgtggttttccatcatcaatcccatataaactggagtagggctattacctgataaggggcctgaaccagtataatccttgtcttctatttgcttgatgtcatattacgtaaatccttgttccaacgtatcccaatacccaaatcatccggtctacgagtaccactcattgacagtggcacgccaggtaggggaacttggtgctcaaggttctacaaatatgacttcaagccatcccgacaacagtaccaacaccggcgtcaatcaaggagcctctacctcgacatcgctggtttggactcaagtcgggactattgtctttccggtctacaccgtcatgccgatctcgacaagcccaatcactattgggaacgagaacggcacggctatgacttcgagaaatgacgcttcgctgacaattcctcccacgcaagtggagaatggaacatcgacggccttagtacctggaaggaatcctcaagcggccgagttctgtcctctgaacaagagaccagagccgacaaggatacccatccagaaaccgaggtcttggtgtcccgtccataagacatccaagcatactctggaagattgcctcgtgatacttcacgcaaaggctgaactctacgcctgctggaaacgtgggattcaacgcacttcaccaacgggcaccacttattgcccgattcatagatcgagatcccacgatctcacaagttgcataatcttccttaggacattcaagtcgtcgcatcctcacatcccacaaccacgagatcaatctcagtgcgttgtcgaggaacgagacgcagcgactttagatcggttcgtaggctttatcggtgtcaaccctagcgagccatccatgctgcacctactgaaagattacgagtcttcttcagactcaccacgagacgtgaacgtgatcaatggtgtcgagacaagtgcttccgcggccgcgagaacacctccacaacaactgcggaacctcgacgcaatattaagagagagcccctttgaccctgtcctaaaccccgatgtcgatcagtgggcggcacgactacgagagactgtgaccaacctcaacagcgcattcgtggatgcagcagtcgagcctccaccccaagatccaccgggagggaacggtgaaccagctaacgggaacgcggaagcgcaaaaccctactagggaaccaccggctcgagacccgactccatcgcgtcgtgaaaatcgtgaccttcatgaacatctagatgaccggcggagggacaggcgagattggaatgacaatgatcgtcatcagcatcgctctccctccagacgaggagagaacatcgctcacgtcaacaccgtcaccgttccctttcacgccgaggtgggaacgcggatcgaggaggccatcccaacggtgaccgagatcggcaggcccgtagcgaccaccaagacaatggagataacaattgagaacggaggcgaggcagcaacaacggacgagaacgtagctcccggtctcccgcctctaggcgagatcgaagacgtgaccaccgttcgagaagctgggctcctaaccctagtggaccaccgttcgagaagctgggctcctaaccctagtgatccctcgtcttcgtcttggtcatcttcttcatcggacaagcctcctcgacgacatcacaaccgcgggccacctttcgcccaaggaggcgtgtgcagagcgtttgcgcgcacattgcgagatgtgcgatggcccgaaaagttccggacaggggcgatcgagaagtatgacggaagcacagacatagaagaatttctgcaagtctactccacaattctctacgctgctagtgcatacgacaatgcgctggcaaactatttaccagacgcgttgaaagattccgctcgttcatgactggttcacctcccaccctactcaatctcttcatgggaagacttgtggtaacagtttgttgtcaacttccagggaacatacaagtgtcacgcgattgaggacgaccttcatgccctaactcaaaacccagatgaatcatagagggactatattcggcacttcaatgagtgcaggaatacgatccccgagatcactgacgcttctgtcatccgcacattcaagtcaggcgtccgagattgatacaccaaccaggaactggcaactcgaagaatcacatctgcttgcaaactatttgagatcattgacagatgcgctcatgcagatgacgccttgagatgaaaggaaggaaagagcagtgtaggtgaggagaagaagtcagccaacaaagacgcgccggaatcaagcaagaaaagaagtcgtaaaagtgggaagcgcaaaccctcgggagaggtcctcgccgctaagcaaacggacccacccaagcgctcgaacccccaaaacgacgactcgaagaagtaatggtgccctatacacaagactaacaatcactccatggaggattgttatgtcttcaaaaaggagctcgcgcgacaactagcactctagagagggaagcgagtacgtgttgtcgaaacggccgaagaggcggccactcccgactccaactccgcgttcccagagtacgacctccatgtcttgcacatattcggcggttctacatcgtacacctcaaaaagggagtacaaaaagatagaacacgaagtctgctccacgtcgcaggggcctaccgctaagatgagatggtcccaacacaagatcgagttctcggagacggaccacccgaagatcgcgaccacacctggtagatatctgatcgtgatcgaacccactattcggaatgtcaaggtagcacgggctctcatcgatggcagaagttccattaatctactcttcgccagcaccttagatgccatggggataccgcgaagcgagctgacgcccacagatcagcccttccatgaaatcactccagaatcatcatctaagccgctgggtaagattacattgcccgtcaccttcggacaagccgacaacttccgaacagagcagatcacctttaatgtcgcagagttcgataccacttacaataccatcattggaagaactgcactcgcgaagttcatggcagcatcccactacacttaccaagttctcaaaatgccaggaccaaaagggacaattactatccagggaaacgccaagttagcggtgcagtgcaacaagcggagcctcgacatggtcgagcatactcccaacccgcccgccacaattgagcaccccaagaaagtgagcaagcccaacaagaaaccgaagttagacggcgccatcaagattattccgttgtccaactccaaccccgacaagaccatcaagatcggggcaaagctggatgacaaataggaactcgcgttcatcaccttcctccgcaacaatgcaaacgtgttcgcttggcaactgtaacgccccgattttcgttcgggaataaaaatcaattaataatacattttctagaaattaaataaaatttaaatcaacttaatcaagtgaattattgagggaattaaaaatttcctttaaaaatcattggccgagaatattttgtaatattctttgtgccctaaaatactctccggatttttccgcaaattttcgaagctcaagaaataattttaaagtcacaaagatcatttaaccaattaaataaaaagaaaacaaataaaaatctccttccttcccttttgggcttggcccaagccttcccctcctctcccgcgggccgcgcgcctcctctctctctcggccggcccgcgccttgcgaaagtctgctttacgtcccccggtttccctcctctctctccatccggccgacaggtgggaccgtgggccccacctgtcagctcctacctctcgccggccaaccccaaccgccattgccgcccacgtcgccgcaaaatccggcgccctcccgcacccgagctcgcatccaacgacgtgggcacgatcccctccacgtcctccaccattttccccgctcgtcccacaaaaaccggcgccggccgagccaccaccaccccccgtcggcgccccactttcccgccggttgccgcccctctcggccccgtttccgccgctccgaccctataaaaacgaacccggagcatcctctctcttttcccctcctcacccgagccagccgtgctctctctccccctccccacgccgctcccgcgcaccgccgctttccggcgagctccggccgcccgccaccgctgctccacccaccgccgcgccaatccgccaccaccgtcggcttcgcggcaccgtgccgcagcccggcctctactccatttcccctctccgcctccagaacaccgccgcctcgtgcaccaccacctaccgcctccggccgcctctagccgccatcctcaaccacctcaagccgcgccactgcctcggttagatccaccaccgcaagggcaagcccggccgtccatccctttttcccctccaccaccagaaccacctccctaccacgccaccctaccggccattttttttccgtctccggtcgccgttcgccatcaccccggctgccgccgcgacgcgccggccgcatcgcctccttcgccgcgtcccgctcttccccgtccgccgcccggtcaccgccttccgccgccgggagcccctcctcattgtcgacctatggagcgccgccgcctccctccgccggctgctctcgccgtcgccgtgcccctcggtgagctccgccacatccctctccctcactgcccccgtttcctctcgccgcttcctgcgctgcgcgccgccgctccctgcgacgcccggcccgtgtgccgccgtcgctttggtcccggccgccgccgccgccagccttgtgtgcgcgctggccaggccgcgccgcccggccgtccccagccgtccgatcggccttggccgatctagaccgtcgggtgcgcggccgcgtggccgatcgccaccgtggactcggtccacggtgggccgtgccgctgacgtgtggggcctgccccctttgtggacgtggtccgcgcctcaccccttgctgacgtcagcgaggaccatttcctttgtaaaaataaataataattgcgcaataaatcgagtttaattctagaaattcatttaaatggcttaaaacttctaaaattcatacctaattcattcgaactccgaattgagccattcaacttgcaaaattcatctaaaattgagctctacatgtttgtttagtttttatgtactgttttcttggtttttattagagtttttcctcgttttgcgtgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagctggtgttactttgatgacctagctagaactatatgcttagccatgcttaattaccactagctcagtcgatgggataattgcagtattagacattctagtatcttgttgagctgcgtgctcgagacatctggccattcttcagggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggtctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacccaatacactgtagtttaggtgggttggttgggcctgttcaacgtggtgtagcgttgatcagtggagatttaaggttactttaattactcaacagttttactgtgttgctcaataaaatgttttacaaccgcctttatgcaaatagccacaaaccatccttgtatccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcatttttttttcgctgctgctgcttttgtttcggtgtgaggactaagtgcctcttctgtaagtattttacgcttattttacgtttggaactgtatattacttgtcgttttgtgtaccctggctggtcctggacagggatttaatacgcaaaatagtctggaaatttgggtgaaatttctgggcgtgacagcagccgtcagacatgtcgggagttcccagggaggcgattgagcacaaactgatggtgcaacccgacgccaagccagttaagcaaaaactatggagatttgcacctgatcgaacacaagtcatacgaattcgacaaacttctcaaaattggcttcatcaaagaagccctccatccagagtggctcgctaatccagtaatgatacatgaagccaacgggaagtggaggatgtgtgtcgacttcaccgacctcaataaggcatgccccaaggaccatttccctctccctcgaatagatcaactggtggattcaacagccggctgctagttcttaagctttctcgatgcttactccggctaccaccagatcaacatggcaaaagaggatgtggagaagacagcgttcgtcacgtccttcggtgtattctgctacaccaagatgccgtttggattaataagcgcaggcaacacatatcagtgcgggatccagggagcactaggtgatcagctcggacgaaacgccgaagcttacgtggacgacatcgtcgtcaaaaccaagacgggcgactcattgatcgacgacctaaggaaaacgttcgacaacctccgacgatatcaaacgaagctcaacccggagaagtgtacgttcagagtaccgttagggaaactactcggcttcctggtctccgggcggggaatcgaggccaaccctgagaagttcaaggcaatcgagaacatgaagtcgcccacaagactcaaggaggtccaacgattgacaggatgcatggcttcgttaagtcgtttcatcgcaaggatgggagaacgaggacaagctttcttcgccctgctcaagaagcaggacaaattcgagtggacccaagaagctgagagcgcgttcattgcgctcaaacgctacttgtcaaaccccccggactagttgccccacaaaataatgaagaattattcatttatattactgccacaccttattctatgagtacgtttatcgttgtagagagggaaagagtacaatacccagtgtctatgtcagcaaggccctccacgatgcaaaaactaaatatccacagatccaaaaactattctacgctgtgatcatgacatccagaaagctacaccacaacttccaagcccataaggtcatagtgatctcctcctcccctttgggagaagtcatcaggaataaagatgtcgtcggccgtattgctaaatgggtagtcaagctaagccattgaaatagggtggtccaaattgaaatgtaaagttagttgttctgtaaatgaaaagaatggttaaaggatgacataatatgaaaacttttaagaatacatagtacgaactgtaatttacttttttggtttagcacaattaaagatgagttgtctattacctggtactcttgtgatatactaagtcattagtacaattaaagatgagttgtccattactcaatagtcttgtgatatattaagtattgttgggtcagtgtacttggctattactaatagtctcatgatatgttgatgcatgaagatgcatacttctactaacacgagataattaattatggttatatagattcagctaaaaaaagataaaattaatgccatcaatttttctcaacaataaagcattcgactgtggtctccttttctcactgcatgatatacgattgtaggtattaccgtaattctttcatattatttttttctacatatacgttaatttggactaatattttttctcataattaaatatttaataaatcatttttcatatttctactataaaatgtgaagagggcattgtataatttgaaaattatattataagtgtatgtaatttaatgtgtaagatatgaacttatagtataagatttaactttttataaaaatgctgcatgatagtagataggtaatgaactaaacaaccataaaatatatagtgaatccattgtgtgttattgattttgtccttattctacaatatgtcactaggtttgtcaagttctaatatgccatcgcattttgcttaacttctataacataccatcgtcgtctagttagcttctgttagtattgtataattttatcataatgaccgaaatagccatgggacgaaaaatttcaaatatctcattgtaaacttccaaagtttgagatggatatcttctctgccttgtttataatattatattttggaatattctgtcaaattttggaatttctgtcccggggatatttcggtcattagaacaaaattatacagtactaacgaagtctaaatggacggcgacggtatattacagaggataagcaaaatacgatagcatattgtataacttaacaaactcagtgccatattatagaacagggacaaagtcagcggcacacagtggattctcttaaaaaataatctagtcaaaaaagtttctttattttattcaaaacaaaacattttttctaccaaacacgttaggagaacttcgaaagaagataagaaaaaaaaggaggtttagtcattagctcaaacacacgtggggaaaagctactcacatccatggtatggtatatactcacattaatcgataatatactaatattattaaaattattcttcgtcttaatacggtgtaaaactaaaactttaaccttatattcttctgttattccatcttcttctcgctttctcattcttatttatttttgataataatattgctacaatcaacactagtacttgcacatgaatactagcagctaactcatatgtgtgtgctccgtaatatatattatctatgtttttacatgagtaaacaacaattattatatttcttaatgatattgtaattatataaggtacctaactagttttctaagaactggaaagatatttttgttaaacataatctagaatgctataaagattaataatattgaacgatatataaccatataatttttttataaatgaattagagatcgactcttgttaagaatccaatgatcataatgcactatatatattgtttaagtgagttatgatattctatttaggatgtgtttgacaaatgggttatgagaggtgggattgagaaagggaaatggatgaatgattaggattaaatgaggtgtgatgaatggatagttaggatacaatactaccctttggagggtggaatattatttccctatcctatttgcaaacaaagccttactagttacatgtgtatgcattaaagtgggatctagagataaaaatcagacactgctcgccaaagaagcacgaatgcacgatataaataaaccctctaatcaccggatcaactaacacgaaaaatgatatatataaatcctctaatcaccagatcaactaacacgaaaaaacacggccctcactggcgtcgccgcgaattggggagatgacgaaatggtgtgaatgcgaagtggggtggtcgaaaccggtccgcctttatttgggttcatggagagagacccaagcaagcggcgagctcctctcgtgcttcccgtgtgctatctggctggctgcacagtggttcgtccgagcggtgagccggtgacgcgcttcggtgcttgcttctgagcttttgtgaatcgtgactttgtggctgatagataatgccataatggcacgccatggtagctttattgccattgctaacttcttgctttggctgctatgtaggcaaggcgtaaacaatttctgtaatgaagaatagtcaaaataatcaattgtgataaaatatcccgatgtaatttattatatgaaacattgtgaaaccctaacgattaaattgctattattatttacattcattttcgtggtgatttttggtgagggagattgaatgtgactatgttgaccatagggagagacgtaagcaagcttaaagcaaccagggcttttgcctacataatcacaattaggtccttttaaatcactattgaaagtttttttttgaaaaaaaagaacttaaaatctagtagttgagccctatgtgagttctaggttttggtaatttctgactccctctctgagcagcaataggttcttagtccgataacatgttttttagggtttgcatgggttagttaaaaatatatgtagactgatggatatactgccaagaaaggggagacaataaatgtaccttttttttattgttttcacaaatggcattagctttgttggatacttttattctctcgccggctcccgcgtcatgtaattgagtggtagaatccatcgttgtagtggtaagtagtcaggcataatctacttttggcatgaaatgtggttgtgagtattttacttactccatttcaaaatgactaaagttttaatattaggagaaaaagggaaataatctaaatacccctcattaaatgagaggtggttgggggtaaagcatgaagaaatttaaacgagggtggttggagaggaagatattactttcaaattacacttatttaagacaatttcaatgataaatttctaggccagaataatataatagccattaggttttgtgaggtgctatgtgtttctttttctaagtgaaaatataatattgcataaaaaggtagatcaaaggggaaaaaaggccaacgaaccaaactagcatggcatcattataatcaacaaagacacccaaattgcatacaaaagtacccataatcatcagctgcttcttatgttgacatcacagaaaacaaaatggataggatgtgcagatgcaatgcaccacactggcctacaccaaaagtctctagacatgcaaacactgatcaatggagtagtatcaacttagagcaggtataatagtaggtggtaagactttaaatattatatctgtgctgacatggaagggagaaaaggttaggaaacgcaaaggcgagcgcttcagttagcgctagctctagcacagcctccaacgcaaagtggtggggcccataagtgggagggcatggccagccaattggatggagctaagccgagtgatacgtaaagttagttgaataaaatattaaaagtaactatgactagcttaagtagtatttcttctttttatttacttttgctgaggtggattattttgcagcggctgcgctattaaccttgctcttattagtatgtcataatgaatggccacatgggtacatggcaccagtcaccctcttgtcaacagtccaaatgtccaatctctcgagtcttgagaacgacctttcactcggttcgtcatttttttttcactaacaccttgctcgttgaaaaatatacccttattaattccattattattagggagtactggagaaatctaagagattgttcaaataagcataacattaaacgctattccttctcaaggatactattaaatccccactaataaaaagatatttggccccttactcaaatcccatctaaacaatcactgaggtggcattaattaatgtgtagggttagatcaatggcaagatgaagggtgaggatagagaagcagagcaggattttgggttcggatttacccaaccctcttatccggttcgatcatgtgtttcttataagttatatgtaacatgtgtccataaactaatatatatcactcgagtgatttttaaagtaaaaaagtccatgaatataattataacgcctatattttttttacatggtcttcaataacatagtttgactagtattttatttcattctataatctcaacaaatataaaattagcatcacatgaaagtaattcaaaatatgaatctagtaatataacatgcataatacttagtatagatatagttaggccctgtttaaatcccaccccaaaatttttcaccatgtcacatcgaacgtttgaacacctgcatgaagtattaaataactgtcgacgttggatgtcgcgattccggtatttgcatagtatggggatcgttggtactaggatatacgcgagacttaggtaaaagagacggaggagaggatttttatacaggttcgggcccctgaattgtcaggtaatagccctacatcctgttggccgaaaccggtcgttgctcttattcaccataatcacaccagtacaatatttggggtagcctatctatctgttgtcgacttggcggtctgaagtgctgactcgtagtcgacaacagggtagtcttcctcctcgaatctgtgcccgacgaggtcagagatagcgctagattcctctctttggttcccgtaggtaccatattgggttttcccaggcttatctctgatgtcgatatctggcagtttgtcttggcgtatgtaggcttgtattggcctgtggctttgtggcgtctatgttgtctgtgtccctctcctcctaggcggtcttgtatttatacccataggtgtccccttgtccaagtagaactaggaaaatcagtatggatacaatccgagtagtccttgtcgttttcatatagaactctagttatctttccttatccggaactccccctatatccgaaggttgtttccgtataagacatggtatgtggtgggtcctgccgagatttagtcaactactattaggtatgtggtatccataaccctgacaataactaattacacatataggctaaaaaaataactaattacacatattgcgactaatttgcgagacgaattttttaaacctaattgattcatgatttgacaatgtagtgctatagtaaacatttgctaatgacggattaattaggcgtaataaattcgtttcgcagtttacatacggattctgtaatttgtttcattattatactacgtttaatatttcaaatgtgtgtccgtatattcaatgtgacacaccaaaattttacagccctaaatctaaataccctttagtatgattattactcaaaagctaccaagtttattttttaaaaaaaaacagggcgccctataattttgggcggcgggagtagtaaaagctatttttttttacactcaaaccagtccgtgtatgtgcgcgtagctcgcctgtctcaacgtaattaagtgaacgataaatcaaataaggcaaaatcttccaaggtcaaaatggaggaacccactatccccagattaccacgggccaaaattcggcccaacctgtgatgaagcggcccagcccaagtcggctaaacccctctcctcttctcgtgccctgcctgattccgctgcctccaccgctccacgtatccccgaaagattctcctcctcgtcctcatccatcccccaccgccgccgcggataaaaatccaaggaatcgaaggccccaacgtgtagtactacgcctacgcgccccctcccatggcgccgcctccgccgctcgccgcgctccgccccgcgccattccctctccctcgcctcctcccctgccccgcctccgccgccgcccgccgcggcgccgtcgccttctcgctgcagaccaacgtgcggctcctcaagcccaaccgccgctcccggcgatcccggtacccctactacgaccacgacgaggacgaggacgacgatgaggcggagttcgagtttgaggaaggggaggaggaggaggaagacggctacgagaccgatgtaagttccctcgtttggcagtagccgcttctagctttgctactgtcgtgagaggttgcctgagtggctgggtccttagctaaaattgcttgcgtactcaagctcgtgccatgggataagtgcaaggctgtgctatcacatgatatcatcatccaattgctgctcattatgtaattagagctccggaaggaatatcattcaactgctgctcattatgtaactagagctccggtattccttttgttttggagtacattagagatgtgataccattttattgcgtcaggctagagagtttcagaaattgaactaaccaacatctcattaggttgtaggatgtaatgttgtatgcacattgagttaaagaggcataagtttgtcaaaggaatcaacaaacattgtaggatgtaatgttgtatgcacattgagttaaaagaggcataagtttgtgaagagcgcactagtggtaaatcatcgttcctgtatttaatggtataacaccttaaccgctcatatgataaactgttttaaaagttttctgcctggctgccacagttaaacaattcttatttatatggtttatttgttccatgcatatttatgtgcttaaatactcaatggtatgctcttaaacttaggctagctgggtaacagtaggtagaggtgggcattagggtgagagactaatttgatttctgccttgggtaaaccatatccaacatacggggaccaatagaaacagcgaaactcgcttttctgctgattagtgaagacttaaaagagagagggagagagaatcagttatgtttcttctgccaccctgactatatgatctgttctgcattgagttttcaatatatagtatactgcatcactgggtgtttagtccacatgccaaaccaggcagaattgcagattattggattcaaaaggataaagttttgtgatgctaactttcattcatttctcatagaatgaaatatgagaaacttaccattggcaatattctacatttccagcattctaatatattctcttactcttttcaggatgatctatcaggtttggagtatcctggtgtactttattcaaacaatcctcgtgctccaatcaagaaaccaggtatgaaaggctgtgaaaatccctgatatccagtggttactttgtattaatactttattctccaggccgggaaaaaccagcgctgaaacaaaactgggaaggaagacaacctaaaacacgagacagatgtgacacttcaaaaaaagtcgatgctctgcatgccaagagtaaagctagcagatcaactggtcttgtggacatagataatgaagtagaggtagactactaaggttgattcagtgtgtccatgttcttgtttatgttcaatatttaacgtatgcaggataaatgattgatttattttcgcagttgaaaaatgaaagtatctctagaagcttgtttcagaaacttcaagaagaatatgactttgatgataaatggttaccactaatcgattacttgtgcacatttggactgaaggaatctcattttacaaacatgtatgagagacacatggcctgctttcaaatcagtcaagcttctgcagaagaaaggttggagttcctgctaagtgttggtgttaaaagcaaggatatgaagaggatgcttgttagacaaccacaaattttggaatacactctcagcaacctgaagtctcatgttgcatttctggtgggcataggtgttcctagtgcacggataggtcaaattatttctgctgctccatcatttttctcttacagtgttgagcagtctctgaagccaaccataaggtatctgattgaggaagtgggcattgaggagagtgatgtgggcaaagtagtgcaactaagcccacagattctggtccagcgaatcgatagtgcatggaaatctcgatttctttttctatcaaaagaattaggggctccaaaagataacattgttaaaatggtcacaaaacacccacagctgcttcattacagtattgaggatggaatattgcctcgaatcaatttccttagaagcattggcatgagagatactgatgttctcaaggtattgacgagtctgactcaggtattaccacattcaagttccctatccttttcatttttgttttgtttttacaagtatcttcattgttcaatgtagacagatgccattataataccctctaatatttgtttcttttcaggtgttgtctttgtccttggaggaaaatctcaaaccaaagtatctttacttggtcaatgaccttaaaaacgatgttcaatccttgacaaagtatcctatgtacttgagcttgtcccttgaccagagaatccgtccccgtcaccgttttcttgtttcattgaagaaagctcctaagggtccattccctcttagctcctttgtgcctacagatgagcgattttgcaagaggtgggctgggactagcttagaaaagtatcatacatttcgtcagagcatgctgctcaaaggtttttcagagaagactggaaggaaaacattaacatcgaggcggtagatacttcatgattgagaagtaggttgtttttgaacctatgccacgctgtaagatgatcatttcacgcagtacctcaaatattttgagtttattttacagaagttgcttttcatagcaatgctgattgatttactgtttgcaggaaaaggcctgggttgctgtgctggtattcaatcatcagcattcggcacacatatatcaatatcacagatacatcactaactacagtttagacttccttttttttttactcctattacaacaaggtgtaaattcttcatctgattcctccagtcgaaaaacaaatggatgttccaggagtcaatctaaggatgaaaagggatgcaccagaatggttgatgtggcattttgttgtctactgccacggtgacatcaccttgaccattagctaatgttaaatatgtctagcacaacaaactaaccatctattagggatgtattaggcagcatcctacgttgccgtaagtctgtagcgtcgttaagcacgatattttattttccacggttgtaaatgatagaaattctatcaccagttcgatctgtactttgtgcgcttttctggtttgttatgttggaaaattattcctgttgctgtggcttctatctgtgttgtgtttggtttactagtcatatagaagaaatcatatttttcgtgtataacgttatgctgcaacacagcatttacgatataactgatctagataagtcactggtgattgaaaggtagaatttagcaaatactccctccgttttataatgtaagtcattctaacattttctatattcatattaatattaatgaatatagatatatatatctatctagattcattaacatcaatatgaatatgagaaatgttagaatgatttatattgtgaaacggaggaagtaacttctgattctggaaaaggaacgaacgttgggaaaagctatctaaagactgataaagatatactccctcattccttaaatatttgacgccgttgacttttttaaacatgtttaaccgttcattttattcaaaaatttttgtgaaatatgtaaaactatatgtataaataaaagtatatttaacaatgaatcaaatgatagaaaaagaaataataattacttttttttaacaagacgaacggtcaaacatgttttaaaaagtcaacggcgtcaaatatttaggtaaaaaaagtcaacggcgtcaaatatttagggtcaacggcgtcaaatatttaggtaaaaaaagtcaacggcgtcaaatatttagggatggagggagtatgatttttcgaaaacatagtggccaattgtttgcattttgagcaactggaactggtggtcaggtgctattccggggagaaatccccaaaagggaaaaatcgacgcatcacaagtaaagaaagcctcaaatgttgtcaacttatcaggaaaaagcacgtattacatgtctaggtagtaagcaacatgacaaaaaaatagactggatctcagggctatgcttatgtacgtcaagctgtttctgctttactgctaactgcaaaataaccctttctataacaacctacttgaccatgcttacttgtgaatcctaagttctgtattataagtataacccaaaaaccatcctactactactattaataataatctgtggaaacctacttgacctcactgcgtctgtgtacctatttataatctatggcaagtaaataattaataataataataataatttgtgtaccaatgtataatctcttgtcagtgtgtttgtagtattggtgaagaaataatagcgctcagtagagaccaaggctatctggaagaatgatctcatcactgcaaaacagttcagacgactcggatgttataactagaaatgccagatgaattatcttggaaaacaaaaaagaattaaagagaactgaaataacataagtaggaacagttacctatcttcatatgctgaagcttcatccaaatcatccgacctgtgtgatttttttttcatgttgttacctggaagatttacatgagacaaaatcagacatgacaaggaaaacgactgaatcgtaatcattccctcagaagtgacacagtacaaatctaagtgtaagaatttgctaacctatataatgctcattagtgacaccgaaacctgatgtcctgtgttcacgatagtcaaattgcttatttttccgataaatttttctgtatcagtaaatgggaatagaatgttggttattcctcaagttgaagatataaagagcaaaagaaaattacacaaggtataaccagcaaatatgaaatattagttcaccatttctctaaaaagaatagttataaagaaactacaccaataaagtcttcactgatagacaaaattcagtcaacaattataactgagcaagataggctaatgattttacaaacgatggtatgtgtagaacagtgataaaaatgcaaattgaacccctaatctgatgtagtgctgtaaatatgaagtataagcatggaatcaatctctgcaaaaatgatattctagatctgtcctgattgtgagatcaaattagccccactgattactgtaatgtaacatggggccttggtctttgctacactgttctttgacttctttcttttttttggatggtgcctttgctatagtgtggccaatggtaaccttcaaacaactatcaacttgacttccagaaacactcttcagccatgtcattcttcaaataaaataaatattattgcatttatggaattttcatgtgtgtatggatgaggggtattgttctgtatgttgtaaacccgcattacataatcagatccttaatagtaaaaactataggcttaaattgggtaaaccataaaggggaagcaaatatcatttttcatctttaacgtcttggtctgccacgcatgaaagcaaggaatcattttaatgaaatcgatagtggtttccaatgcgtggtagtaataatgtcagaaacagcaagcgacataaaacagccctattgaacagtagagtgttaccttagttcagacttttccatgtagcgcttgacaagaactcgcaatccacagatgaagtgagctgtcccctttgataagataagcctcactgtctcagtgtataggaagctcacaaaaccaaacatccgcttctcctgatagggaattcgcacaccggagacaggcccaaattgcctggcattatcaagacaatattgtcatcacagtaacataataacatgacaaattgacaattcacacctagtaacaataaagttaaggcaatacttgaagtaattctcgacatcatcatcagtgaatttgctgtgaacagggaaggtcatataaatctggttagacccagtgccagtatccatcaagttgcaactgtgagccaagcccaagcaatccatgtacttcttccgagcatcttccaccaggactacatgatactgtccatgttctctgaagttgaaaacggaaagagccatgatcaggatgtgaagaaaaaagaaaaataatcaatcatgatagagccatatcagaaattcatagaagaaaacctctcgaccactctgatggtgttaagccccatgagcagacttgtaagactgcaaccagtccttccatgctgctggctctcagtgagccatccatcaggccgcaggggcttaccgtacttctcaaagtacatcgacggcaaacgatcgactgcgactggtggtggtattccgatcaggagttctctgatctccatatccagcttgctcagcgacgcaaaggggtgaacttgcctgggattatgcagctcagggacggacccatggaagaactgacagttgacacctttcttgcagtaacccctgaagaaatggaaatggcaaggcttggaactcgacttcgagctactatgaggatgtccgacgagatttcgaccagcatttggagaattccttggcatgctcaaagactgcaactcttcctttaagcagatggattcaggaaatgagctctgcaatgctccagtttgatcaattaatgggcgacgttgagcttggattccacgataattgccgcttgattgacgctgagccctcaagtaagccagtgggagttcttgccccggtggaggaggcagcagtgagggtaaggaacgtagatgctcgtcaggactagctgcatactgtctgatctgcgggtatgaacttgttgagaggatgtaaccaccgtttgcacgcgatggctcgaattcccgagctctattcagcagcactgaacatttgttcatagccatttcttgattcctgcaacagaaacgaaatgatgggattttcattctataaaaaaaagttccacctagaaaaagtaggagattgttttctgataatttcactgcaatgcaaaacaagagtgagattgttttatgattaattaaaaggttaagatgcaaatactgtgacaatatagaactttagtccaagcaaaaacgaaaaattgcacattccactgtttccaccacaaacaacaccgagttcgtgttctcccagttgctgcttccaaaaatcaaacgacaaaaatgcagaaacaattctggataacaaattacaactctaccttaactaaaccaccaaacctcttcagaatacgagaagaacccatgattaacaaatgctgtaccaaaaaacccatccctataatataacaaaaccgaacgaatccaagatcaagaaatgccgtaccaaaaaacccatccctataatataaccaaaaccgaccgaagaccacgatccttcgcatgaacacgccaaaaagaaaaggcgaaatttcaataaatttaacatatatgcaaccaagaatcgttctgggcttctggccaagaacctgtcccccagaattcaaccaaaaccactcagattgcaccagataccccccacaaaccctcccaagaacccaccttgtctcgcagttctcctaatgcgcggatcccttcttggtccaggaagaaagaacgccaccatgtgaaacccccaagcgggcgcgattgcgcgaatgccgtacgtcgccgcgtgtgcaggccgcggggcttgccgcgtaggtgggatttagcagatgggaatcggtccagaggttggaaagattgtagctttcgccagttggtgttccctaaatcttgggactgagggtttatagtgccattttcgccggaagggagagcggtttgcggaaccgactgacgacgagagaggaggccctgcgccgacctgcggttgttcttcgtgtgccaagtgcgaacacaaacgtgtcccttttttttttttgaaattataaaaactacctggtgggccgtgtatttacgtggccatagctcccgtacaaaattatttaagcttttttcacgtgattttctcaaaatttgttaaatagtcatctcgttgtcttagcatattaaaagaaattgaatatttgtttttcagttttatagctcttcaaagttacaccagccatcacctgttacttttattctgcctctatttacttgtccgacatgtcacgacttatttcatccttaagacatttaaaaatcatatcttataatttttagagttcattgtctcgttaatttttctttttattgtttttagaagtcttgtcaaatgttgttactgtacttttttatagccagcccgctcttactctttattgttattggaatttaaaactgaacctagttatttttactttttataagtcccgtcaatcgccataaccttagtgcttcacggcctgtccgttgcctttctcttaatcgtcattggattctaaaaatcaaacctgctcatcattgaaggattttatttatagtttttagatttttcatcaaccgccacgacactaaccatgtatagcttatccgctaccccattcttttttggcatttgccactgttgtgttctagatgtattgttttttatattccttttttattatttctatattgtatttctacttgataactcatttttatctatttttagaatttatttttatttataactttaattaatatcgtgttgcgttctacgcggactattttttaatattccttatttccattctgaattttagttttttctaaattatattcctacttaaacactcaattttatcttatttttatttctgaatttattttattatatatttcgaattttaattaatcccatgtaatattctagatgatatatcctttcaatatttctttcatttcaaaatttagtatctctaaatgaggtagcttttgtaaatttttttcttttttttttccgttagtggcatgccactggcaaagagacggtatccgtaaatggtttaacttaggctgtgtttagttcacacggtgtgttagaagtttggttgatattggaacgatgtgacggaaaagttgaaagtttatgtgtgaaggaaagttttgatgtgatggaaaagttgaaagtttgaaaaaaaactttgtaactaaacacggccttattctcttcttccatattttctctcctatttggatcagaggtgaaggtggttcaattttctctcttgatttttttttattaaagcggttcaacattttctcctatccggtatttttctctcatttaaccttttttcatatgctattttagatcgcggatttttgagcggtttctctcttttttttaatggtttttcagaatatttttatatgtgggataaggtgggaaccagaaagatggctatggctagtaccggatatgacacatcttagcattacgaatctagattcgtagtactagaatatatcatatctgatgctagattcgttttttatgggacggagggagtagtagagactagatttgaattgctaaaactttctatttttaggatactaatttatactccctctatttcaaaatgtacttgtgccctttttaataagagattaaggctgggtgtgtggaaaatgactgtgatgggttcagatgagaaaatatatgagaaagattatgcttggttgagatgaggagataggtagagaagtagctgtattttttgaaaaatttaaataacacaagtagttgtgttttgagacaaattttaaatcctagatgtcgaagtgtgagctcctctatcggggtaccgcgaggccccctctttgttagttcgaccaggggcagcgagtgagattcgagattcctgtggtggatgagagaaagagaggggggcggggccctcgaagacagagacaaaagggatttatacaggttcgggccgctgagaagcgtaacaccctactcatgtgcttagctgactatatgtggaatacatatgcttaagcgcgtgagcccccaagcgccagttagacaaagagttgatcccccctccctaagtaggcttggaccttcttttatatctcaaggagttaccacatgggcccgccgagcctattcagggaggataatcacattaaatgtatttcttattgcttgtcttggaagtctgttgcacaccttgctgcgacgtagggcctgtcaaatccatccggctgacagtgtcaacacgcatgtcattcagcatttaaagagtgaggacttttgggtcctcatttgcaccgggaagtgggaaccctgccctaaccgggttaggcaaaccgtctccggcagacgtgagaggctgagctgcccctcacaattgcgacatgacgggggggggggggtgtcaggcggccgcctgacatgcaaccagagcgcaggcacactaccccagccatgtcaatcatcggtcacagatcggtcacggaccggtctgacgcaccacgccacaataaatgttgcacgtggagcgctcgctcagaccgccttaaacgcggttaggtgggcgctaggaacgcccgtctagcacggcacacgtggcgccacgtggagggggtcgaggtggcccgacccccaagcgaggagggggcagccgccactccaccccgggcctgaccctcttcggggaagtgtcatgtgggtctaggggcagtctcctcctttcaaactcggtaccctaagctgggagggggcagccgtcgctccagcccaggcccggcccccctcagggggggcgccacgtgggttcgggggcggcctcctccctctaaacatgataccccgggcccatatcaccaaccctagagcattgatttcaatatgtgggaataacattttcagcaaatcaggttctttataggaaaatctaagcaattcaaaaaattaattgctgagataattgaaagatattttttctcttaatcttaattttactaaagaacgtaaaaatatcttaaacttaatcttagtatttgcaaatgtttgcataatgtgtcacagttctttcagcccgtgggttaggaaggctgagagaagatgcaactatgcaagtacattaccggagtccggagacaggaaggccaataggctgcgccctgcgctgtgcggagatggagtcgagtagtcgaccgcacgacgctgaagatttagtaccatatgttgacgtaatatactcgtcccgttccaaattactcaaaatttatacaatataaatgtttatatagatatttcctatcaatcacaagttatccttaatttctactaaaactttataaaatgcctatattttgatgcgaatcgagaagaagaaaaaatccagggtcgatagatgcagctataaccagttatcgttgctttttctatcttttgccctatagctaaaatttaaattttaaattttacaactaaattttaaagttgatttagtatatattttctaccgtagatcttctgcaatggagtataacgttactcttcccaacaatgacattttcccctcaaatgaaaaaaagaatcagaatatgttccctctcgtttatcttccagcatacatttcagaacgacatcatcagctatggcatgctgcatctggactcattctagcatttcaagaacaaaactccaccgtgcaaattcagtcactcccctcctataaaatactcctgtaaatttagatgcttcactgaaacacaaaatacattctttttgtgaaggaactggtctaaacacttctttttttcgagggaacgggcagcctgccatttcattaatagaaggatagataggtctaaacacttctccaattataataacaattatatacaatgttaataagatgcaaccggtttaacccacatatctgagcaaatctacactcgataggcattcaaccaccttgtcaaaaaataggtaatcagccccccaaagaatgtacactcaagaatgaaactgtcacaagattaacacagtttcattcttgtcacagaaagattaacatgtattgtatggctacactcttaagtgcactaagctgtttcagcattaacatcaactgctacttaaccatgtttacgtgtagtagtatatcctaacgacttcagtgtgacgccaaaatcaatcaactaagaaacattcctccgggccactgtacacaaactttcccttttgtttgactggcttaggtggcttggaactagcaaagtcatacaagtgctgcttcaccttcactgttcctcactaaataggtcatctggaagacagcgctccctgcaaagcagttggcatatgtcggatgttacaaccagattaattagttgggggcgaaacacaatacagtatatgagtaagatatgaaatacaatggctgttgctattgtacattcaaaagcacaaagcatctgaagtgcgttgccaacatattttgacctctcgcgagaacaataagatgggagtgttcatttgcattgactaaaaaagtttgagtaaagttcacagccggtctttaaagttgtagcgaggtgtcacttaggtcaatgatctaggaaaatcgtcaatacggtccgcgatcttgtttaagtgaatcatttaggtccaaagcacctctgatcgggttgactggcttacgtggccgtccacggtggcagcatttttgcattttagccccccccccccccccccccggcatcttgcctcccccatgtccgatccaggcagtctcccccaaatcctcctccttctacacgcgatttctagggttagtgattgcagcggcaataggggcggcggccgtgaggacgagacccacgacgaggagggtggcgcgcacagaggcaacggcatgggaggcggcctcgggttcgtgaagtgcgctggtaggggaggccatgggtactcgaagtagtgggtcttcttcaagtgcccagaggagaaggtccgaccttcccctgataaagtgcccttgctgctgcgtgaagaacatcgtggagctcactgcaacgacagatgctaatcgcgggcgcatttttttcacatgtcctgaccacgaggtaatggtccgattgatttggttttgggttttttgagttcctttattttcatgaacatgacagtgcttgcaattgatgaatgtgtgtagaaggatggttctggatgcaatttctggtacaggaaagaagggtatgtgaagtatcttgagaggaaaggctacattgctgacaaggagctaagagatgtgaagcacatgtcagagaggaagaaggctgtgaacaatgaagatggtggggaagatgaagtgaagaagctaatgttatctctagtttccattgggttggagatagttcagatcttgaagggcatgctagttggttttattttacttgttgttgctttagtgtgtttggtgcttgctgtatggctgaaataagatgatgattatgggtggattatgtagtagttgtcagttgaggattatgcagttttaacatgtaatggcaatggccataattcactctagaatcaatggccataagtgtatgcagtttatatatgcaaactggattgactggttgtagtggtgttgtctgaatgtaggtggcaaaacaaatgcagttttaagatgtaatggcaatgggcttaatttactctggaatcaatgcaaattgggtactataatgttggcttgtatgattgcatttcaactcatgaattcagtagcaaataaaaattggcaatgatccatacaagaatgaataaaatcacaggtctgcaagttgaaaatcacaatttcagttggagaaaccatagatttgaacccattaagtttgcattggcataacttgtttgcatccaagcaagttcaagcaacaaaatacaatcccagttaaaaattttcaaatggttaccttttgtttgtctgtcataatggtccatggagaggtgttcactatcccaagttcagtcttcaaggtatcaagaaaccatgtccatgtgctgaaagactcaacttctaccacagccattgcaatggggtatatgcagtcattgggatcaattccaactgctgtcaacaattgacctccaaatttggtcttgatgtggcaaccatccagacaaatgattggcctgcaaccactgaggaatcctctcttgcatacatctagtgagaagtacaagctactaaatttgccctcatctaacctaagatagaaagaactcccaggattggacctccttagttcattgccataatcccacaacaagttgtattgggctatttcatcaccatatatctcttttagggccagcctcctagctcttgcaagcttgcttcttgaaggagtcaagttccactctttttgtactgtctttgcaaagctaggaatggtcatcttcccatcagccctaaatgactcagtgtacttttcagctaaccattttgcagtacacctttttagaatccactccttcttgcatttgtgatggggctcatatgtcttaacaatgaaggcctttgccctgctgtccattgaagcataaaagttccaggggcatccttctgcacaatgtgccttgatcctagttctatcattcctgggcatctttatgtccaccctgttcttcatgctatattcagagatagcctttctaactaattcaactgaagagaataccatgcctactttgaagattgggttgttaatgtcttcaggattaaaagacttaaacttcaagttgaactcatcatcatcatcatcacttggcaagtgcagttgttcatcatcacttgtgtcaccttctgacaaatctgccacaactttcttgcccttcaacacactacctgcagccttcttatggttgaatttcttcctatccccctcttccacatcaccatccacattttcctcaaagaggtcatcatcatcatcctcccactcataatcactatcaacaaaatcagaatcagactcactgtcatctgagtttatatgaaagctcaactatttcttcaccaacatccaattcttcatgcactacatgtccatcaggtgcattcctagggtttctatcctcgctttctgcctcctctgtctgctggcactgtctactagggttgaacacctctggcaactcagcttctgggctcagaacaatgtcatctatatttcttcctgagacatgattagtatgatcaaaatagatgacaaaattcttgattttatttgacactgatttcatgacattgatctcaacttcactgtctatgatcctcaatccatcagacatgttctttccaggcaataaccaataagttttcaactttccatcagagtcatatccaagcatggcaacaaagtctgctaaatgtagacatctaccccaatctcgagaatcaatattgtcaaaccagtctactttgccatccatatatgtgcggttcactcccataccacagaaaaaccccccatgatgaaactcaattgaaaagtactttgatccaggacctatatagtgcacacattcgggatgagacaacatactaaaccctacattacatcacaatagctaaaaaaacacacatttaccaacacaaaatcaactaattgcattctagatgaaaccctagaaaaaattgccaccgaccaaaagtcccaaatttcttgaagaaacaaacttccaaacctctcaatcacagattaaacttaccaaatgaaagggattaaaagatgacgacgacactcactataaacaggcgcaggtgcgccttcatctcgcaaggtcaggtccatctcgcgcctccgacgcctccgatgacggcgcccaatcggttggcggccaaacgcgccacccagaacgcgtctccggccaccctgaccccgatcgccgactccgccctaatcgccgcccctcctcggagtgctcctagctcggccagaacgagagaatgggggtcaattttggtcgcgtgtagaaggaggaggatttgggggagactgcctggatcggaaataggggaggcaagatgcggcggggctaaaatgcaaaaatgctgccaccgtggacggccacgtaagccagtcaacccggtcagaggcgctttggacctaaatgattcacttaaacaagatcgcggaccgtattgacaattttcctagatcatagacctaagtgacacctcgctacaactttaaggaccggctgtgaactttactcaaaaaagtttctatgctgcataaagaatgaaaaatgccacttcaacgttacagatgtacaactgtgcagcagcatcagaagtgctccaattttccaacatatcttgatctttctcatgaataaattatgaaaagtattaactcttaatttcattaatttgtttccgtgttgcttaaagaataatgttctcagaagcaataatgcatcgtacaggttgaaataagactgtttaatctgcaaatagaaacaggagtactcattactcacatagctgagaattctgaagattcatccacattagactcttttgtcgcatgatcatctaaaacatcacagaatcaagtaagggcctgtttggcacagctccaactcctaaatataactccagaagttgagtctggagtggagttgtggagctgcctaaacccagctccacaactctattacattttgtgagagagctccacccaactccactcctagttttggtggagctaaaactgtttggctgagctccagctccaggaggggtggagttggagctggagctgtgccaaacaggccctaagacttactaatataaaaactataacagtttaatgaaaaacaaggatgaatatggagtagggaaattccacatgaataccttctggagattctgttttcttctcagagaggttatgtgttagaggtgaatcaaaatctccaaattgatgtgtcagtgtctcctgggaaagttcaatgaaattcggcattttttgtcctatcagaaatgacaaaagaaatggcttaataagtcaaaatatagaatcacaaccataagtctagaactaaatcagaagtggcacagcacaaagccaaggaagggcatttacagatttactcaccagagtgaccctcaatggcattgtcacatgatgtcctgtgtgcaacattgtcaaaacggtcgtttctctgaggaagctgcctgtatcggtaaacatgttattatgtttgaacatgtaaatacagagagaataaacaattgcacaatgtataagcataaaatattagttcaacaaaagcaaactaatttccaaccattaaatcagtaaataactgtctcgtggaacttaaatgtgcagcaaaaacaaactatttccatgtattaaacggctaccttgcagggacttgtttaagatgtacgtataaattataattactgaaaaattcaatctgcaacttaagtacagacagaaaagctagttattattttttcacaaagacggtacatgtggaacagaatggacaaattgaccatacacttaaaataattaaccaaatgagtaatatgtcagtatgatttatgaagcacgcatgagtgcatgataacaaaaaagcgtgaaactgatgtcccatagaccaataattatttctaaaatcaaattagtccccactaaccactgccatgaaaaagaagtccctggtcaagatcatatttcaactaacaaccacatttcaagaactctcaaattgacttccagaattaatcttcagctaataactagttttaaaatcctcaagaaagcacttatggaagatttcgtgcaagtccttagatgagagagatttgatcttttgcaagctatatatatgaagatcagaaaagggagaggacactgtggcaagactgccatttggacctcagaacaaacaagaacacatcaaactctaatcctgtaattagcagaataccgtgacataacccctctgaaaaagaggtgcacccagctgcttgccaggacagagaaggattgatttgggaatggttaaaatgtacttactatagatttgagtctaacccctttatccaaacaggttcttaacagtatagtttgtaaatcacgaatcagatattgtttgaacaaaaacaacagcaggtttaaaatgctggttaattaaagacaatctgagaagcaatcaacaaaagaaacagtgaagttagataaagtacctttgctcttgtttggtcctatccaggtaaggctttgactctaacttctactccactgatggaatgcgatgtgctctttgataagagaagccccactgtgtcatcattttcgaatgtcacaaaaccgaaagtgtgcttctcattgtctggcttaaaggggatgtagacattgatcacaggtccgaacttcctagaagaaataccatcataatattattgaattgaacatagtggtataatttgaaacttcaaatcatattgcacctagtcttgtcctcaaaacaaagtaaacatagtactaagtttagaagaaaatacttgaagtagtcccgaatatttttccaagtcaatatgttcttagcgatggtaatataaatcgtaaactcggtactttgaccgaagaaatccctctgtgagccatgaggatgggattgcctctgattgtgaccaaagaaatccctctgtgagccacgaggatgagatagcctctgattgtgcaactcagggacaccagacccgagaacttgtgcatttaggtaatcccttggcatgccatcgaaggcattggcacatgatgtcctgtgtgcaacattgtcaaaatggtcgttttcttgaggaagcttcctgtatcagtaagcatgttaggtttgaatgtgtaaataagagagcaaaaacgattgaacaagctaaaaatattagttcaataaaagcaaactaatttccaaccattaaatcagtaaataaatgtctcgtggaacttaaatgtacagtgaaaacaaactatttccatgtgcccaaaaattaaacggataccttgcaggtacttgtttaagatgtacgtaattatataattactgaaaaattcaatctgcaacttaagtacagccagaaaagctagttattattttttcacaaagacggtacatgtggaacaaaatggacgatttgactacacatttaaaataagtaaccaaatgaataaactgtcaatatgatttatgaagcacacctgcacatgcatgagtgcatgataacataaaagcatgaactctgtcctatagactgaatgaatattaaaatcaaattagtccccaccaaccattgccatgcaaaaggaggccccgataatagatcatacttttattaacaaccatatttcaggaactctcaaattgacctccagaaagaatcttcaactaataactaattttagaatcctaaagaatgcacttatggaagattttgtgcaagtccttggatgagagggattgatcttttgccggccaaataaatgaagatcagaaaagggagagtacattgtggaaagactgccatttggacctcagaacaaacagaacacatcaaactcaaagcctgcaattagcagcaggatactgtgacgtaagttacataaccccactgaaaaagaggcacaccaagctgcttgccaggacatagggatcgatttgggaattgttaacatgtactcctcctaacaggcgctcaacagtatagtttgtaaaccataactcagatatcgtttggatgaaaacaacagtaggtttacattgtaggttaattaaaaaaactgcgagaagcaatcaacaaaagaaacagcaaagttagataacagacctttgctcttgtttggtccattccaggtaacgcttgactctaacttttactccaaagatgaaatgaggtgtgctctttgataagagaaggctcaccgtatcagcattttcaaatgtcacaaaaccgaaagtgtacttttcattccctggcttacagctaaggtagacattgatcacaggcccgaacttcctggaagaaataccatcgtaaaattattgaattgaatgtagtggtataatttgaaactttaaatcatattacacctagtattgtcctccaaactagtaaacataatacaaaggttagaagaaaatacttgaagtagtcccaaatattttccttagttaatctgccgccatcaaagttgatggtaatataaatcgtaaaatcggaaccttcaccaaagaaatccctatgtcggccacgaggatgagattgcctctgattgtgcatctcatggacatcagacccgagaacattaacttgtgcatttagataatcccttggcaagccatcacctggaatgttcaaagactgcaaatgcgcagaaaatgggatgtcaaaacctccactttgaccaacggggaggcatggaaacttaactccatgataacaactacctacctgaaactgaggctccaaatagagcgatggggattcataatcataccgcgttgaaggtgactgcagtaagggtagctgctggaggtgttgtattggggggaacctcatgtagtatgacttcgcctcattaatcaaggcttgtattgcctcatcccgggctgaaaatgcataccaactgatccaacttggctttgatatgttggcgtactgaacaatagcatttgcacatgatggctccaactgatccaacttggcttgtgccgcaaaaccagttgacattggagcatatgccccccgttcctgcaacacaagggacaaaatataaaaacccactgcaagccaatatttctgattggaaaaatcagcagttatttctaaaagattacaaggataacaattaaaccaaaatttggcagtagagaaaattagtgcaagcaaaaccggaaaccttgcatctatctctgtttgcacccacaaaagaggaaacatttgcaccaactcgtgtttttccacattgacccaaaattatgttttcctggttccaaatctgaagaacaaagtgcaaagttatctgttggatgcaaaacagaaactctatacccaccaacccagccaaaatatccatagtaagagaacgaacccaatgagcaagaactgttctttccaataacccttctcagaatccaaccaaaactagccgaacgctactcctcctgtaatccatagacctgcctccacaagaacacaccaaaagaagaaaagagaagttgtatatctacaaacaagaactattccagccaagaacataatctcggaattaaaccaataccactcagattgtactagatactccacgaacccctagaagagctcaccccgcaaagaatcacaagagtacaaaacatcgttctggccaagaatcagtatccagagtgcaactaaaaccgccaagattgtacctgataatccacgaacccctagaacagctgaacccgcaaagaatcacaagagtaaaaggcaccgtcccggccaagaatcagtatccagagttcaactagaaccaccaagattgtaccagataatccacgaaccgctacatgaattcacccgcgtaaagaaaagacaagaagcgaaggatcgttctagccaagaacccacccgtccccggaattcaaccaaaaccgctcttgattgtaccagatgctccacaaaacacctcaagaacgcacaaggatcaagcaaacgacagaaaagagcaaatgcaacgccgcgctagctccccaatttactagtacatacattgtcgtccaggaagcgcaccaccctgcgacaccgagcggcgaagggggggcaggggggagaagggagacgaagacgacgaagcggccgctgacgctaatgccgcgacgcctctcgcaccggcttgcttgcttggtaccgaaatggattccgccgcggatggcaattcgatcaaaaaggctgtggatttcgctacttggtgtccctctcctaattcttgggaggaggaggagggtttatatagcgccatgcgcgcgggggggagaaggcggttcgctaaaccgagctcagcaacggcgagtcgattcccgtttggatgtcgggaatcgaaatgccacccgggaatgccatacattgggaaagaactggattttgaacccagttggggagggattagcagaggagaaaattggataaatcgcagcgactgaaaccagtcggaggtgggattagagggggaatttgtataaaccccggcgattgaaacccaatggatgtgggattggagggggaagagtgtatttataagcagcgattgaaacccagtggaggtgtggttttaggaggggggaaatgggatcggagagaatgaggatgagaatacccgttgcgccggcggccggagccaggtgccaagcggcggcggtccccggccgtccgtcggagacccgccgccgctcattgagacctagccgatcgccgccgcccgcgcgcttcgccgacctcgaacaagaaagagatttgggagcatggtcgttcgtttggagaaggaagaggtcgtgttcaatattgggctgaaaatattgttcccctcggtttgcacggatttgggcctctagttcggcccatcagattgatttgctctatcttcacatttagaattacacaaaaacaaaatcatctgaaatagttctccgaagacttttgggaaaggtgtcaaaaaagaaaaaaatttgcgaaaacatcaaattttgctggtttatttggcaaagaaaaatgcagtacctggattttccctatatacggattaggcataaatccatcggcttcgatgggcctgagtatgcctacaggccgaggcgggtccaatcgaacgctctgcttgttgggctttggaagctttttgcccacccgtgtcctgacttgggcctctgctcgggccaccgtgtcatggatcgctagcctaccattggtagatcaagtcaaccgctgtaaataggtccagatcgacaatagttataaggcctgtttggttgggggagtttttaagagggattgggagtttagagggatgaggctattaagtgttttgtttggttaggagacatgataattttggtgggatggggatggggaattgagtaagaaactcccttcttttcaataccttggtaggggcaggtaattgggaagtaatttctcctttagtttttctaagcaaatctcagccatccatttttattaatgacctaatctccaactaaacttcctatcaatttccatcacctctaccaaacaagatattaggattaaaaatcaaattcccatcttaatctcatcatcaatttcctcgtgtaaactctcaatccccttccctcgagttaccaaacaagccgatagtttcgggggaaatttgcgacggtcctctcgttcttgtattatcgttcgtgtttttttttacaagtacctcgcagacgagtactccctccgtattttaatgtatgtcaccgttgacttttcgaccaacgtttgaccattcgttttattcaaaaattttgtgcaaatatgaaaatatttatatcatgcttaaagaatatttgatgatgaattaagtcacaataaaataaataataattacataaaaattttttaataagacgaatggtcaaacgttgggtaaaaaataaacggcatcctaccttaaaatatagatatggatgtagtacgtgacagcgtgagccaaactttgacggtccattgtattatctgtgacgccgtttccggcgcccctggacatgaacagaacgacgcgcaccaagcacgaccagtctccctacgacggcgacgatacacgactacacaaacctacaaaaagggacagacagcctctgcccgtgtgctcgtgcgcgtcgcgttaacctttttttccgatcaaagttgcagagcagcagagaagcatatagaacccagaacgcacactcgtccgcccgcggtcagcaagcgccgcgcggaagtcggaacacccgcctattccgccgttcgacgaggctgcgtctgcgtggaaggaaggagatcttggacgctgtttcgccacaagtcacgagatgccgatgcaaccgcacacagccacacacgcacacgcacacgcacacgcacaccccctccacaggaggcagcctatcggtttcgccgcgggcaactgggaaggggcacgccgcacgccaggatcttagaacctctcccaaaggcagcaacataaaaatctaaacccgtcccacacaacacgctcccactcgcacgtccccgtccgcagcggcgcccggcgtggtcggcatgcagcgcccggcgccggacacgtgtgaactgcgaaccaccctgggcgccgccgcccgcagcccgccgcggccgattgcccgaccggctgtggaatctctccaggggacaagccaacaacatgtactgcccaaggccccgcctcgcatcgcccgatcgaaagcgcgtcgacgcgatccgatccgatcacgcgaggaacaaacaaaatcatcgcttcgcttggtcttttagccgtccgcttcacgacctgcgggaagcagcagcagcagagctacagtagtggagcggcgtcgaatcgaatcatgctgattgctgcgtgactcgtatggcactcgcttttcgtcacggccacttcgatatattctgctgtttaagaagaggcttttgatatgatattgcatcaggccgggaaaggtcgtggtcctcgtggacacggagcctagtgaattatatacaatgcagggcatgcagccgggaggaataacgcaacacgcatgttgacacggagaatcgagatcgatcttagcttcaatttttattaggttaaagtcagtcagactcgaggaaaagcaaggagggtaagtggtattgctgcgactttgctctgaagctaatataagcgactgtatatatagtaacttatgttttgatggcgaggtctgcatttatttaaccaaagacttgcagtagcaactagcaactgctccacgacgtgttctatactaatctaccgaagctgttcatttgtacattcatgttgaccacaacattgaccaaagaaaggttgaccagtatcagctcaacaactcggcaacttttctctctgccacacggttttcagcccccgttttttgtctgctgcctgactgagctatgggcatatggccatgttatgttatttctttgagtttgagacgactactcctgtgcaggagtgggcaaatccactgtcatattatatccaaatgtttatgcgcttctacgctacgtaaacagatagacgcatgacgatttcgtgagcgaacctggatacactttataaaaggaagagggccatgtttttcttcgaattgcgcataaattatctcaggatcaaattatttattgaccaaattgcgaagttgacagttaccatcatgctccaacctactcgcgagttaacttgtccagggcttcttccaaccacgtgtactgttggtccactgtcaattagtttttagttatgatgtacatttaattcaatcatgataaataaaactgaatcatcactgagattaaaggtatatataaatggattgagttttgctgatcaggtttgcaatccgacgcatgagatcaaaattatgagtttaaatgataacttgataagtcacaaagaatcctattaatcagtgcgacacttaagttgtagtatgggatggctaagagctcaatcaacagctaattaggtagtgcatctagggtttacattttcgatggactgctggacctaactcctggtagtataccattttctcaacgaatttccataaattttgattacattttgcttgaatttactgtttcaaatttgaatttctcaaaaacattcaaaagttgcctcaaaatatattctttcccgtgcccaaacctcaaatttcgtggtttttcatcaatgtcgaaccctgtatgcatcccttcggctttcagccccaccctctaggtggcactcatgacattacagcagcatctttatccttaccgctgactcctccattcaccctaagaacgatactcttaagtcttaaccaacctaccaatgtgatggcttctcaatctgcactagtcccttttcccttaaatttcaccaaaaatgtcaattattatgtccaaattcaaaatccacttaaacattttgttcaaaacgtgttggcaactttttgtgacaagttgacaagcacgatcatagcaccttatgccttgcagtgatcctagagtcgccaaccacctcaatctagcaaagagctaaacttagatgggttttgacgaataaaccggctagcggagccgattttagataactacccgtctcgtgggcaaaacggaaggttttcaggacaaacctacaaagagatgtcgcactctcgcagcggcggcggacggtttacggcgcaaaccgacaaagatggacaaactaagagaaactaaaagcaatatgaaaaacgattcaattgattgattgtagattggttttttacaatagaaccggccatgtcccttatataggggttggtcttgccctttacaggccctcctccacgttcaactcgggataaaaaccaaaggaaactcgaaacataccttcccaagcaaggaaatcccgaaacccgatgaaacacagtcggactcggacactgccggtcagaccagccacacaccgccggtctgaccggccttcaacaggaggtctgaccgcccgacacacggcggtcagaccggcccactcggagaaaaccggtatacttccaaatcttggcgatctttcctatcttaattttaggtgccaaatttgggtgtaaacacaaaacattcgataaaaaccaacaaacctgaaattcccatgagcctccaagttttcttctagttagaaccagctggtaggatggtaccactatgagatcggccaaacataaatattatccacagccattgatgtttacactccccactccagtgaatagatcagatatatatgcaataaatcaacactcttttatgcatccgtccggctttttgctatgatgacggaacaagatacaaggctgcagtgtctcgtcaggttgtggtcacaaagatgcggaatagccatgtcgttctctgaacataagtgcaccggtgtcctattaccggggtcatcatcttagtcataaaccacactagcagcatttccgcgctcggtgggcccaccattcgacgcatgcatggtgtgttgtgagccaaaatattagccaaaaggcactggccggaatgtggatgacattccagggacagataagaaaatcaatagaccatgccactagagagaagaaatgagtaggagagaggagtaaagatgatcaggacatctcaccttttatcagtgtagacagaaaaatcttactgattatgtgctggaaaagttagatctaagaacaaatggagatgctcttacagctggatagaattatactatatgtactgatctcttcccggccctcaacctaaagtcatgtttttctttaagaaaaaaaccatgaattcgcagcatttttatggaacaagattagtttttctggaaaaaaataattaatcctctatatatcagtatattccaaaggacctctgaatggtttcgtggtaaataatattttacataagaagttcatataatgcttaatattgggctgttgcacatatggtatataagaacttttacggtaaaatatactaccagtatatactggtagtatatagaagggcatgttaagaatttgatagaaaataaaacaacactctagtaatttttgtttcagattaaatctaattggagtacccggtcctggatcttatcatgcgctaagagaggagcatcgtgagcgctatttgatgacgaatcacgtgacgataacacgatttgatgaaagaataacgaagaaaagacaaaattaccctttcaaactttatactgcaatctaattaataaaaaatcaaattaatctacactgttagatcatatatacttgcagtatatactagcagtatattgtaccgtaaaagtcctcatagcatataggctagtctattataactcgttaatctaatatattatgaaggtagcttgaaaaactaaccatgttcgctctgaacaagtactataaattctcacattaattataaaaaagaaaaaaggtttggaccattaaattatatatggtgggttcagattatgatggtttagatcaattgatatagttatataaatgagcatgttcggctaaccattacagccgctacagctaaacacaaccctagctgctatagatgcagacaccgggggcggatctaggaacaaaaaattgagaggctcaattatacagtttcttcaacctccagccatttagagacctttagtttattattcatggtgaaaaaattgaagggggtgct

SEQ ID NO: 59332 - DNA, 7105 bp, Oryza sativa
  unsure (1)..(7105): unsure at all n locations
ctcctctagcacgaatgtgggtcctgcctgagactaaggaactcgtagctaaagttggctactcggacctgagcaagttccgtgctttgacgatatggtatggaatatccgttttttggtgtggaggctaaatgccacaaaacctaccgtgaatggcctttaaggcgcgaccttctccacacgttgccgatgacggaattttgcgagctcagacacacgcgtcggccgatagtgcaacgaccccacaacgtacggctgtactgcagatcgacacggcaatgtggtggtgggggagcgacggagagttgctggttaaggttgttggcgcgtcacgtcgacccatcggatcgcccgatacgacgtctaagctcaccatttttcctttttcctttttttttttgagaactgtctaagctagcagagctcacctcgactgcccagtgcccgtcattcggtattcccgtgggacaccacgcccgtcgcactccctccgttttgcgcgacgggaccgggtgagagcgtgcggtgtgggatcgagccggccggcgagcgagatcgcgcaatgaggagggcaggaggcgcgacatgtaaagtactgacttgaagacgcggaacggccggttttcacacgagaggcagaccggcttcgacgacgaggaaaacttccagatgacacgaacgtgcgccggcgtgggacgttgacgatgcggaatctgagggagggagcacaggtagtccgtggtcggtaggcagttggtcaaagtaaaccgcgcgtgaaaactgtactagtgcttccaaaagattgatcatggactgcacatactaagcagttttgatttgtagtgactaagcagttctcttttttttttttccttaacacgccttgagcgaaaacaaaagcttatccaacaacgaggacatgtcattgccatatcaaagtatggaaaacccctatacgatgcttcaggctaaatttgtgtacatgcatcttaatctaacatttttttaagacaatgatctaaatctaacatataaatcaggaaaagaaatatataaatatcatctttgcttccattaattgcttgaagtcacaaggagttgcacctacctaggattcaaagactgataacagttggcagctataccgtacgcacgagtactgctgtactggtagtacagtactaacttactgcactgcactgtcacggggagggagtggtgacgctcaccccccgcgacatcgccgcgagcaccgtctccgccgtgagccgctccggcccggccgaccgcaccatgagcgtgtgcgtgacggcgtcgtccgacaccgccacgtccgacgccacgacgctgatctgggattccctcatggcgtggaacaccctggagatggggtgctcgtccaggggcgtggtcacgcgcagcaccacctcgtcctgcattgccttcacctccacggccggcccatccgcccgcgcgggcacgggcgcgtcgcccctgagccgggcctccagctcctggatgtacgcgatggcgtcgctgagcagggacgccttgtccatcttggagatcttgggcaccaccgcgcgcagcgcgtagaacctctggttcagcttctcccgccgctgccgctccgcctccacgtggttcagcggctcctcccgcccgttcgccggcttgcgcccacgcttccgcggccgccgctcctggccgccggcctgttcctgcacgttcgccttggagaagtccaagctcttggggggctcggctggtttcgccttgaccacctccttcttggctgggcgcaccggcgtggtttggacaacgagccgcggcgtccatggggcgtcgcatcccatgggctgggacggtcggccgggtgagagatccttgccgaagattctcatgaaatcttccggcggagctggcacggcgcgcatggcagattggatggcgcgcaagacctcgggggtctcgcggatggctacgacggaaccgagctcgagaacgccgcccttgcacgggaggaagacgacggtgcgtaaccccgcggactgggcgagagacgagcgaacgtaccaccctggcgcgctaccggagccggaagggtgggggtctacgtccgcccaggcgtggcggccggaggccagagcgcggcccggtccgcccgagccctccgggaaggagaagtacatggacgccaggaagtacatctcggcgccggtgacccggtccagccggagcgcgtagtcggcgccatcctcatccccgcctccgtacagcgcgtgcagccgcagcagcacgcgcttccgcgccacgctcctctccgcggcgccgacctccccgtgtccggcaccgtcgcggcagtggccgtcgccccagccgagcacggcgcgggcagcgcggccgctggcggcaccggcgccgcgggactcctgccagaagatgccgtacgtccaggcccctccctgccgctcgacgaggtcgtgcaggctcgcctgcagctcggccgacgacggcgacccctccggcgcgtcgaggtgcggcggcgtggtggccaggtgatgcgccgcgtcgtgccccagcaccgccgcgaacagcgcggcgtccgtctcggaccacgacatgcccgccggccccgctagctcgccgcctccgcctacgcgcgtcggtcaaacaaatcaaccgcgtgtgcgctctcttttttttggccgagacaagatgcgcgtggccttgtgaattttttaccagcttactacgcttttatatatagcgccgagccgtcgagcacgagacgtcagctcacgggagcttattggccacggcaagttgcttggctctcggctagctcggctgccactggagtgtatcggtggcgagtgctcggaaccagtgaagcgtgtggtgtggagtggatgcgcgatgtgaagttgcgatcgagccgggggctaaaataaggggggagctgacgtacggcgaggtacaggacttggagcgggttcgatgcaccaaggacgcgggggtcggccgccttacgggattgtgcggtttttggagcgaggcgtcgcggcatgtgattcatgttggccttttgggtggttcggccgtttcctttccgtcgatatggatgttgtcgcccctcgaccaaaatcgctatcctaccgtgaatggcttcagttcccgtgtagggaataccgtccgatcggcatagagcatcatggaccgtttgattctctatgtgaggaaggagagtttttttttaatagaactgaagggagggttaagcgaccatatatagtcctcccgcctttgctacttgcactctagagtggattttaaactctctagatattttcattgttttttatgtcacttaaataattataatcatacaacttaaaattcaacttttacatgccgcaaaaaaagatttgattgtaaatatacgttaactagtttaatttgtcttttttttggcaacatgtagaacttgaattttaggttgtatgtttgtgaaatgatatatcacatattaatatatcttctctttttttcaaatatttttatagctatttaagtgacatgtaaatgacaaaaaaaatatcctctcgagagtataaaatagtttccctctgcgtggtaccccttttttttcttcctgatcaagtgcacccccttgtcagctgtcacgcctctcaatcaccctctgatgtgacgaggaaataaccaacgtgtattctaatggctgttaaaacatactcatttcccaaatgggacaataacgcataaatatacttgtctgttcaaggtaatttaaatttgaaagttgttctagaagttcgtttgttgaaagctagctaggtggtcagcggggcggattcataatgggggcggagaggtcttgaaaccccactaccgttcccgggacagtggagacccccctaagcccccactaaatttttttctatagatccataagatgtggggactggaggttcgatttatactgatatagtttatttagcttccactattatttttttctagatccgtccctggtggtcagtgtggtcttaatgcacgacccataaaccgtagttatgatatgaacaaattatatgcatgatggttacgacaaaccgttcgttttgttgtggctggccacatcaagtcactcgtacaagcatatcttctagtgttacctatctactttagagatctcggaccaagtgataccccgactacatataatgtccatgccggatcctagcttccttggacttagcctcctagtgttatttaacacataagtcttttgctaaattgcagcgaggtgttcgacattggtttgtagggaacacaacacttgcgtttcaatgggatcaaccattctccttaggacgtttcatgtaatatatatggctgaaaattggtggacgagagacaattgtgattttggttaccacggaaaaagatctgttctccactagtgattgggagaaccgtttctacttgtagggcaacaatcatatttggtgtatccgtgcattaccatcttttcaaaatcataataaatttaaggcgtcattttcactggtttggaaaaaaaatgcaccctttactttctcctacgctaaaaaggctagaaaatgtttaattaggactacgattgcctatatgtttgcatgaaaaggaatttttgctcgagtgtcgatgccatcaggctcgtgagaaaatacaagggatggaggagatgaattgtgtgctattagcctattactgtgttcagcggttaacaaaaaggcagacccttttttccgtaggatagagttattaaccttttggtttctttgttgtaaaagtactcactccgtcaaataatataagagattttgacattttacttgcactgaccactcgtcttatttttaaaaaattatgcaaatataaaaaataaaaaattatgtttaaagtactttggataataaagtaagtcacaaataaaataaataataattctaatttttttttaattagacgaatggtcaaacggtgcaagcaaaatgttaaatcccttatattatgagacggagggagtaataaatatatgaatttaaggttgactaacccctcaattaaaatacaaatggtataaaaactcataagctaaatcttctactatgctggacacaactggaattaaggagcactggagcacaaatcttatcacataaaaaaattctaaatatatatacaatcagatgggctgagaatagagtggcaagtgctgtggaaggttgtggttgttgcacacttgcactacagtcaggcgtgctgaaaaggatatatggtcgtcgccaataatagccagacagtgcagtgaactggcggactcgtcgtcacctcagtgaggtttggttggtggcctaaatagccttatcaaattttgtcaatactaaattttggcaagttttgacatgactaattttggtaaggcaaagttgtgtttgaattgaagccaaaataacataaattcactattgaaatggcatattttcaatccatcagatccggatccgtcgtatttggcccccttttttgtccaacgggagagatgcgcgcacgagagggattactatttgacatcagcgcggctccggccgagaggggacagagagatgaagacggggacctccgcctcctcgacctcactgtcgtgagaggcgtgcgcccgcagcaaacccccctcgcggtggcgcgcgttgcggcaagccggcaacaactgaaagtggatcgtacgcgagagagacgcatacgggggtgggccagcgtgggatcggagcatgcacaggggggggtatgatcgctgctgccgttccgggcacgggaattcaacccccgtacgggtgcagtctggtccttttgaagatgctaatgatccagcccatgtgagagtatagtttcttcgcaggcttgcggatttggatcagggcatctttgcgatcacttgagattaatttcaacctttgcgtctggcgaaccatgattctttcctctttgtggtgggggtccagcatatgcagtccaaagactccgaactcgtccagatctgagcttggacacaggtgccatcatattcgtatatatggcttgatattttaggctcaactttgatagaactcctacttagtaggccaaatttcaaggattccaatccaatcgttggttaggagcggtaagaacaattggatcgcgcacgaatatcgcatggccgccagattgcacctatcagcttcgacatggcaacagatcgaccatcctacgttacactttgaactccacagtcagaactgttgctgctgctaatgaccttattaattggaagagattagattcaacatgatgatgattgatctatccctaggaatagagaagagcggcgccgctgtgcctttcaaggccgcgagattaggatcgttcccatggcacacgtacaacacactaaaaaagcatttttcccaacatggaggtctcattttcgcaagcggacatgacctttagagtcaaatgatcgtctacaaaaatataaattaaggtgaaatttacggtcagcatgtgaaaatatacttgaatataattaaatagatttggataggagtagattttttctaaggctccacacttcacccctctcttcacccacttcacccctctcttcacccacggccggcctctcccttccccacacctcacggccggcctcccctcacctctcctcctctcccctcccctcacctctcctcctctccctggccaccagaggggggagcgatggtggctacggcgcggggtggcgcggaaggcggcgtggccgcgcggctcccctcactccctcccctcctagatctggccggaggagggatgggggaggccggcgggggaacaacggcagctacggcgcggggccgcggcggtggcggctcccctccccctccctcctagatctagccggaggagggaggggggaggccggccggcggcncggggcggcgcggcttcccctcccaacctcctctcccaaatctggccggaggagggaggggggagg

SEQ ID NO: 59333 - DNA, 9485 bp, Oryza sativa
tgggaagaactccatccactttttctgcaatggcaatgaaccaatcaatcagcaaggaggcatacgtgtatatgaacgaattcattcatgggcaagatggaaaatgcttgtggcgtcgaacagcttggagaagatgctgtcgtaggttgagggtctcgcgggcgtcgccgccggacacgccaccgctggggctcttggaccagatgtgttcgcctgcctgcgcgaggcggatcagctcgtctccccgacgagccgccgctgaggaggtcaaggtctagcgcggccagcacagccgggctcgtctccccttctcccgtcgacgcgggtgacgacctctcccctttctcccgccaatgcggtcggccgcctctcccgccgacgcccccacctctcgcgtcggcgcgcctcctctcctcctctcccgccgcctcgtcacgccgaccgcctccgcttgccgctgcagccgcactcgccgacgcccgccctagcagccgcgcttcccgccgcaagccgcgctcgcccgccgcttgccctcgcagccgctccgcctgcctccgcccacgcccggagaagaaaaaagaacaacagaaaaatgtgggtcacttatatgtgggccccacatatttatttttattatttgtgctaaccagatgtcacgtcagcgaaaccgtttttgtatagtttaggggtggagatttctggttttgtggttaagcaaccttaaaaaatctcgctgttaagttgagggacctccggtgaacttattccttagcgccgaatatgtcgggccggatagcccaggagtctcgtcctcttcccctacccccatcgacgcaggcggcgctgtacagcggttaggagttcgacagagtggggagaaagccggcgagggaagccgaagcatcgccgccttccgccagcgccccaccggcggccggcatggacgaggagacgcagaagaaggtggagtccacggttctggagatcctccggggctccgacatggagtccctcacggagttcaaggtccgcaccgccgccgccgaccgcctcggcatcgacctctccatccccgaccgcaagcgcttcgtccgccgcgtcgtcgaggggtacctcgaatccctctcccaggaggatgagcaggagcagcagcaggagcaggccggcggcgccggcgaggaggggaaggacgaacaggccgaggaggaagaggaagaggaggaggaggaggaggaggagcggggaggtggaacgaagagggagtacgatgacgagggagacctcatcctctgccgcgtgagttcttcccctcgcgtgaaatcgctgatactcctttgtttcgctagatttcgcggtgggaatcggtgtgatgaggtttgcttttgcagctttcggccaggaggagggtgactcttcaggagttcaagggcaagacgcttctgtccatccgagagtactacttcaaggacggcaaggagctgcccgccaaaggtgatgcacatattcctgatttgttagctgaaacattggatttctgctattataatagaggacttgtcttagaactgctcggttaaaatgcaccttaatattacacatatatctcgaactttaccagttttattatgggtgggactgctgcaagtcagttgggttagattttgtttagacctcagaggaaatattacactctaccaattctgacatctgtataatcgaattgcatcataactgtaaattctctgatagctcgatctgtttaatattttgatgtgttttctgtgcttatctatcctcttctttcttggtctatttgatcacactctcaaatgtcacggagcatacctaggttttgttttgcacatgtatgagctattgtttatattccagtgttgttataaggatcaagggtgagttgcttaaagacaaaggggtgatgataagaatatagggaattgtgaattgggtatgaaaatattcttccagcttatcagtcctaaaaatattaacttcgtgcaaatttccctagttttttctattgtacttgctaatatcaatcttgagtgaggccgacctgtcacttgtctgttgtcatttgccatcatgctttgattgtgtcagcgacactatttttgtagatctgtgctattgccaatttgtaactgcttgattatggttaggattctccatttgccaattctgcaaatatttatcgtacagtccctgttatggcttacaagttgttgttaccaatttgacttcttgtctttactcttagatgattcatattggtagtactaggatatctattttaccttgggtttgcaccatctaagtctttagtgtggtttggaagttgttgtgcagtttgttttcttattatttgtttagtccagctgaacgtagttgctgaaaaagttaaatatgatgtcaggttctaactagtttataggatatttgaataggtgcaatgtgattaaatcttatgcaacagctacccagctctatttatattgttgtccaaatttagttttatgggaggaacatttaagcttagatgtctagctgatcctcaaaagtatctcccaaccttatgaagctatactacaatcttaggcataagcgaaagataaaagaaaagagtcacagttactccatagcctgtacacaggatcctaatagtgtgttgatttataatgtttggaatacgacatcacccctcagattgtacttttatcacaaatccttatattgaagtctaacatctgacaattgtttcacttgggacaccttccttcctaaaggatgagcctttgtaccatgttttttattttaccaccaaagatgaaaaagttcattttcagtttgctttgtgcctattgcatcctcttcacaggcattctttgtgtagtggtgctaatgcaatgcagttttgttttactttcatgacgtaactgtacctttgcgtgtgtgttgatatgtttgatttcatgtgcttcatttcttattttgccacgctgctgaattgcagggataagtttgacagttgagcagtgggaagcatttcgtgattctgtgccagcaatagaggatgccattaaaaagcttggagaatcatcggactgaaagcatgtttcagaagccccttttgcctgtatcaaatcaagaaggcctttgttctggccctttacttagggccagtacaggctgtaagtccgctatggagggtctggaggtactagggttcctataaacttttgtaaaacttatcccttagtcaagctgcatgatgctgtgtagggtagacggttggagacttggagaagtaatttcttcatatgctcgtcttaatattggagttagtgatgtacactgacatgcatctggctactttagaaaaatcagacatgggttccagcaacaagcctcttttgtttggatcatgaggcactgtcatcggactaactcatctttatgaagaattagttctccgccgctagatgttagtgtttttcgttcatgcccttacacttgacaattgcgtctttttgtctggaagttgcaatactgatatgttttgggcaggtgatctgagccctttatcattgtttctcgaaactgatttttaattaatctcacgggtttcacaccttctgccatcctgatgccaggataaaggttgtactataaactttagttggtactccatagtttccagcactagactttgtttctgatttgagcgtcacctccctgaccaggaaagatatgctcaaaggaaacaaccaactaacatcaattatttgcgtacgaattatagggaactatgatgtgagcttatggtattgataaagactgtcctagagtagtgaaggaagaaacggttgattttatagtgtcttggtagtatcatccaactcgatagctcattatggtctatttggaggagcttaataatttgagaatctgctagttgatagttaattactgagaatattgagaagctgagttatcttgagaagctgagttatctagcttctggcttctagttcattttctgtcttttacaactgcatattcttaaaatctgggtgacaatctggactatttagaggagctgaaaattctgtgagaaattgcagctgctagaagctcttccaaacatactctatatatgatcatgtagatttggagtagcgatatgcatatagatttggagtagcaatatggggaaaacaaagttacatttctagtttttgcctaccagttcatttatctgaattttgtagctattaattctaagaccaattgttacaatatgttctcgccaagaaagtgttgcacagttataaacacatatccctagtactccctctggtaaaaaaaaaacttaaatcctaaggatgaacatagacacgtactcaaatcctagggataaatctaaacacatatgtgtatagattcatgcctaagatttatatctttttgggacaaaagagtactccctccgtcccataaaaaaccagtctagtactggatgtgacatattttagtactatgaatctggatatatatatgtcaaattcatcgtactaaaatatgtcacatccagttttagattcgttttttattggacggagagagtgcagacgagacatgagacgaggaaccgaacctttgcaacttgtcaaccatcttttcaattcttaccaatacaccatcctcttgtaatgctacaagttgcacgttgctagaccaatattgaaaccgccacacgtcatgtcatgctacaattattctggagtgtacgtccaaggcccggaccacaaaaaatgaaaaacatttgtggaaaatgacaccgggaaattgctataactggtacaactttaattagacacatgatgataagtagtatgggcccccaacaaagttctcatagctgtatgcccaaacaagcgaaacaaaccaacgatcacgtaggcgccacacccagtcggcttgctgcgatgatcgatgcctcttatagctatttatggacactaaaagaaatgaccgttcgttgcaacgggaataaaacatgagaatttaagaaaaaaaaggagaaatatttacattacgtaattaattaaaatacaaatttcagcatccttactataaataaactacatatatttatatttatttcatccccactacatataaaatcgcagttacatacgatattacgaaaagaaaggatcatgaaaatcaaggtaaatgtgggtaataaattttcccaagtaataaaattaatttttattaaattttccatgattaattacgttttatgaatataactgttaaatgtagattaaattcgacaaactaaaaacgaattgaaagggaaaattacagggaaaataagaagaaggagttgggaatcgatttttgccattaattaaaggaggaaacgcagggaaagacatgggtataggttcagattggaatagataaaaagaaaatcgaacaaaaagctggcgtgcgcaagaaaaatccgattccaaaaaaagcaaaaaaaaaagaaggaaaaaccgattaaaaaagataaaaatgattaatccgatcagaaaataaacggtgagaaaaaaaagggaaaaccgataaaaaaagatggaccaaacaaaaaaccataagttttattttaaagaaaaaaaacgctcatcagcggagggcggtcgcatgcgcaccctcgtttcttccagccccacgcgcctcatttcttccgcctgaccttatcctccctctctctttcctctcgctgtatctgctccgcccgcccgccatatctccttctctccttcaccttttctctccccaagcggcgacgccttccctctccccaaaccagcgacgctgctctccctcctcctccccccacggcgacgctgccacccctacccctcagccagggtgccctcacccgcccggagggtcttttccccggcgggtggcgtcctgcccttggaaaccgacgctttagctgtggcgccctcccaaggcgggcggcgcctcagccgcggtgcctcgtaccaccctcctcctggccggcgatgccctttccccagcgggcggcgttctctcctcggcggcatcaccttcttctccggcacaatggcggcaccttcttcatgggagcccctcggcggcggcaccctcctcatggcgcacggcggcagcacacgcgccatccaccacgacctcgggggcagcggcatcctcggctccaatgagtagtggtgccagtgatttagttttttgtgatttaattttcttgcatgattttgattcattgttgttggatttgtgattttgtgattaagtgaagttgtgattttgtgatttattctctcttttctgtatgatttgacatctagttcaaggggaacatgtttgttatgtacatccgtatgggacggaagtgaggcggacatgtatgttcggccacgggatgcgatctcgcgaacggccggatcggaatcgggacgacggacaaaaaaaaaatcacggaaaccttataaattttttaattaggtatagatagatatagatatataagctggttaataattaaccatagttttcgcagtactataaccttcttggcttcgatgagtggctgcacttggtttaagttctaatctcttcgtcttcatgaacattcaaaatcacatctaatacgagattaacttttatcatatgtgacgaaaggcatatagtactcccactgtcccaaaagtacttggtttaagttctaatctcttcgtcttcgcgaacattcaaaatcacatctaatacgagattagcttttatcatatgtgacggaaggtatacagtattccctatgtcccaaaatataacaacttttggttgtatgagaagtcccatccaaccaaaagttgttatattttgggacagagagagtactttctttgattcaatgactgctgcacttggttaagttctataccatatatgaactgtctcttgccttttacagtactacctttcttatttttcatggttacatgttatgcacgtgtgggcagtggtgataacactaccctaggatctagctaacaccctactagtagtaaccaccatacgtacatgtcatgacgtggtggatgcatcctgcacgtgcgactgtgcgagtgaataggaagagtaaaatattccaaccaacacaagttgatacaacaaagcacagaagaatgaaaggtatcggtctatcggatgaattacttttctactagtagtactactaaattcattcattttattctttgtgtaatgaaataaactaatactagtcaaaactgcttatgacatttgtggacaggcaggcgatgtggcccattggtacgtcgcctggcctctagctagcgttcgtcgcgacagaaacgtacgcgtgatgggtgtgccgcaggctctgttaggcatgtgtgatgactgatgagtgaccgcctgcctaaccacgtaccccttcttgtgtcattgtgtcatatgcaatgggagtatcaagcgtgacatacatagtatcgcacgtgcgaatgaaacgtctgtcttgggtgaagtgtttgtgtggagttgttaatgtaccaatggtgatcaaggatttatttactgtatctagtatggacatagcaacgctaattggtaatctcattttcaggctgatgttgtatgttctattatctccatcttaaaataggagacgtcctagtatagttgagctaaattagccaaattagtgtaccatatgacgctaacttattactacttcatccgtcccaaaatataaaagatttagggtggatgtaacatataatccagatttatagtcctttgatatatcacatccatcctaaattttttatattttacgacggagagagtagttactttgaatgaccagaataagcaatcatttcaaaacaaaaatacacctgtcatttctaccatggaaggaatcatggatgaactaccatacatgataaaatttgaatcgtacactgctacaccgaccccacgtttctgcttcttactaaaacatcaagcattacaggacaatagatatgaagtaaaatgccaagtatacgggacagagggagtattgtaatttgcaaatatttgtttaatataacaaattattatattttaggatgagtaaagtcatatattactagtttgctgtatctattagtctgttcggttggatatgggatgcggctgcagccagcacggataaaactttactcacagaatcagcagcatgcagttgtagcatggctgccgaacaggcgctatataagtatatataagtgacgtgacgatggggttggaaattcatgtctatctttttttttcttttgataactgctggaaattcatctctctcttttttttgtttgctaactgctggaaattcatctcattctcatttctcgagtgcagggcagttggccgctgctggcctggtgattacggagtacatgcatgtgggtagcaagctgggaaaacaaggtacgattacaaatgctggcactgcatcgacagatccaaccgaaccactgcaccgacggtgtgcgcgggtgctacgagtactttactactagaccgatcactctaacagtgtgttttttacaaaaattttctatacgaaagttactttaaaagaccatattaactcatttttcaagttttctttactaatacttaattaatcgtgcattaaacaatcgcgttgttttgcgtgcacgagagggagggttcccaacccatgctaaggaacatagcctaaatgtactgctctgaccgatcggtcgacgaccgtcgtgcaattagggcattcatagtgcgccactattatttgctcagcctcacgcgccagctagatgaggaacaatgttagctacatgtgtcacagtgcaagttgcttcttatgggtcccaccattaccatccttttaccacttttttctctaccctctctctttcctgtcttctttccctaccgcagtgagcaccgagcgcatcgccagccgagcagccaagcggcaacggcgccgaccggaggggcggtgaggcttgacgctcgcccgtgcaccaccctcctcctcctcctccccggaaaaaacgacgagcatcggtacaacggtgcaggagctcagcggcggagggcttgatggcggaggagctcggcggcggtcgatctgggacggcgccgggcggcggggcggtcgagcggcaacccgagctcctccgctcgagctgggacggcgccgggcggcgggagacgacgcgcaggagctcgacgacagatctggccgacttggggaccgccgctcgtgctagaggagaggggacagggccgaggcagctgaggaggatggccctgagctcggcgacgcggagacgaggaggtcgacgagcttgatgaactactgt

SEQ ID NO: 59334 - DNA, 13667 bp, Oryza sativa
gaaagcaaagcgtaacaagtatatactgcatagaagcaccaatccttaatgaatgaatcctcttacatgttaaggctcatcacagcaactgcaatataacaaaaatagcacaatatcaaataataccacgcagtttctaaaattgtaagtactgattccattgtagcagagaacaaaaacatcataacaaatactcactctttgaaatgctacaaaacagtcagaaaatcagcaagctattgaagcagcagcagaatttgcaaacttgaaaccaaaaaaaaaaaaacagaagcagaagcttataagcttctttttgcatcttaatatgttaggactcatcaaatgatcacatcatttttataagcttgatgtgagaatttagatatccaattaaatcaacatgaaaaacaattagacaggctgacttaagcaccataaagttctggtgctaatacctggttcttgacagccttggccattttgcggaactccttgcgcatgacagacttgtggtagaggctagcaggcttgttctgcttctctgtcttggttgtagagaggaccactgccgtttccttaccactggcaggctggaccgtcacggttttcttgtttgccaggcctgaaaagaccaaatgaacagcacaaccagtcaagactcaagagagtgccacgggagacatgcatatcaagagaagcatgccaaccaaccattaattaccagaatgcttgtaagagtggacattgtacaggttgttgggctccttgctgaactgaaccttggcattgccattgccgaactgcttgaccaggaatgaattgttcttcttgacaagctcccagaccagagaatctggaatcgtggccatttatcctaacctaaagaatccacatcaacacccggatgaaatccaaaaccgaaatggaacaaaacaggaacaaatataagactcctaatataagagctgtgtccttctggcagatgggaattcagacagatatcgccgccatgtctgatttggcgactcttcagagccccccctccatcccaaccaagcatttcagagttttctttcttctctgtttttgggggctatggaatcaccgccatgatgtaatttttaggggtatgcaaaagtctcttcccctttggtagccaaatgtttagatgaggcctccttatgggccgaaaggctaaatgtaagcgatcgtattgtggtttccgcctggaaggaaaccatctcttcctccctcagaacctcttccccctgatgtaatttgtatcatttcaccgtaacctagagcttgcttattcttgtagcaccaatggcgttctattcagaggttggagcaattagctccttaacttaccgaagaagacatccatttagcatatgattaatttagtattaattattataaacttagcaaatggattcgtttgaatttttttaagatatatatatatatttttcaaaaatatcatttagcaatttcaaaaacgtgccggcaataagctagtaacccaaaagctgaaaagaacatggcctaaacgagcatatatatgatgataagaatcgaacacacaaatcgtagacctgaattccaatttccgaacagaccagtgaatatcccattagcggatggtgataaatgatttatcactggacccacataccatagacacatgaagacccacatattatagacagcgagtggtaaataattaattgtcacatcttgaaagtggccaaaagttaaatgtccccacaccagcacgtctcaagcgactctaagcatttgggcagtaacaaagcgagcgtagctacgaacgtcgaatgatctaattcaagtaaaccaccagcactggatggatggagagggcaaagctaaaatcgcaaaaatggagtctaaactgatcaattcatgcagcgaaacgaacgcataacaggctaacgccaacagaagttacagaacaagccatgctacgagaagattgcaatgagtggtttcttcttaccggagattggagtgacgcgcgccgccgatctgcctccttccggggtcacgatctcgcggcgctgaaaaaaaaaccctagccttgaggtgggtggccaattcatgggctgtagcctgtagtaaggtggaatgggcctgtttggtagcggacgatgttggatgggctgtaggcccacgttagtgggacacgtgaactcaagtttccagttcaaagatggtacaagggggtcggggaattaaactccgaccccgcttgactgtcgtttgcacgaaaaattttagaacaatgacagtaaacatcgaatgatattaaacaaaattataaagtttactaaagtatttctagaattttcagtccgcccgctccaaaggaaatatttttggcttcaacagtagtgaaacctggatgaatctgaacataatttgctaaaattcagaatttcgaactttttggccgaaaaagcttcctgttggtggcttggcgctactggtagggccgaaaaaaaacgggaaatttcagtgcaaaatctgtaaccctggtcaaacctacacattatttttaggtcaatatttgtagtaatatcatttttcacctagtgaggatatatccagaaaatatgcattacgacttacgacaatgctgaaggttcattatcatttttatatcattacacaactaatgcatgaaatcgctcattcgtgtgactataaccatcatgttataaatggtgtgcaagataatatattaacgataatatgaaattaaataattagttattcaaaacgtataaaacatctattcgaaacctaattggttgatataaattaaattaatcatatggatatacacttgtatagatatacaattttgagtattcttaaggttaggaatactcatgtttaattaaatctgtagaatttagaatactatggttgcacagtttagtttacaattatctgaatttgaagacatagttgtaatataaatataggcaaatgattgatttgtacttatacaatttattatatgactaagtgcaaaagtagaatcacatctctctacatcaagctccatgtgtccacatgtaattacttgtctccttatatacattatgttttgattaaagtaagcgactatatatctctatttgtaaattgcaatacctttctgccatctcaagcaagtagctctttctattacctgctagaagctagaagggtttatcaatgaacaccatatgtttttttattactacttgagttccatcctataatcaaaatttgttttagctttttgtcatttagtgaatccgataactaatattcattggatggtgtggcaaattctaattacatgttgagtttcacttttcattagttaagatacggtactgtatgtcaagcagtaaaagtccaaaacactgccaactgctttcctgttggctgccagttccaacattttctgaaagcatccaaggaatttctcaaatctcaaatgacatgcataaatcaaatctcaaagcactgccaactgctttccagttggctgccagtctcaatcctccaaggcttgcataaatcaacaaaaactagctggacagataaagctggatatgttaatcaaaactcatgttgaacaaatgtagtaagtactagcaactagctgggatggtatggaatatatggaaacaggttcctttttcaaacagaatatatgaaaaaaggtaaacctcttaagttctgtaaacgtctgtacatctgactgcataatgtgcttattacacgctaacaatcctttcataatgacaatacctaagatgtgatgaacatgaggccaaaatagaacgaaagaataatagctcgccaaaaagaccaacatataagaccgagtgctatgagttgatatactgtacaaatgtcaactcgaagctatagaatgtatgtatccctgtgtttgtaaatacgacttcttcacatgtaaaactcaactggtatgcgatcataaaactagcggcgattggtccgaagagacataaaatgtgcagcaaacgaatcatagtctgtcggaagcttggggtgaacatgcgacggagcagtttttgaggtgctttctttcggagtttctgctgggctttctgtgttttcctcctttcctgtgacagaaactgtattcagatcagcttcttgtgacttccctttgcccaagggaggttccacacgcacaggttttggtgaagttcgtggtactggaaccctggagtacacaggtgagtctctcctttgttcagtaaacctagaaaatgacccagcaggtgatttcgcctcagtttcatcagcatgctgcactccaactcggacaccggtttctttctttgtatctgatgtcatctgagtcctgcgtgattgaatctgctctctagaccactttgtctggacctccttgcgttgtgccaattcgtcctcgctatcatctgaatcaaagtaacttttggcagtttttgttgtagttcccctgcgggctccagcacctggcttttcatggtacagatcttgactggaatttacacctccagaactcttattcatcacagaacttggagcattataagattgctcagataacttccctctatcaccttctgacccatagtaattcctcatggttgatctagcttccacacttgctccaacactttgattttggtcatgaagttcactgttgtaatctgcaccgaacgaactcctggccatacctgtagaagtatttcttgtatttccaaacgaggtatcctcttcagagtgcactgatttttcaatggcggtaggaaccttatgcaacgaggtattcccagaatcctttatgtacggaggaggttgccggagtttgtttcttagtccaggagttagccttccaaagttcaagcctggatcgccttcatcatagtcagcagatgatgttgaagtttgcctgcctaaagaaaacagctgattcttattttctcctgttgtcaatgatgatgcaccttccaatttatgtggcactctttcttcttcaagatctctgatttttgtacgatccaattccccatcaacccatgagtaatcagatctaggtgaactttcactgtagcgctccttattgaatgcattagaaccagatgaattaaggtaattcttcctggacatggatacatgatcttcaatattttcattaacatcatggacaacctttccagaaattatattttctctactctcggaaaaatcggatcctctggaatgagaccttaaagaccttgcatgcatgcctgtggtcatttcctcatcagaactaacaccatccgagtcaaatgtaggtggcacattatcataagaatgaggtgaggaaacatcttttctgtttgcttctgttcctgaaaatagtgttgagctgctatgattaactggagattcatttctatgctgttgaccccaatctgcacttgagaatcccttgtgatcttcaacagtgggttcttcagtgtgctttgaagagaaaggatccaataaattttcttctccgacatcagaatcatattgatcaaaaacaacagctgaagaatcaggtccagctttatcattctgactgtcccaaatggtactgctgccatgggtgaatgtaccatgggaagagctatagttgctgtagtagttgtctgtgttctcttgatcaaaggtagcatgcttgctttccgtgtccttgatgttgtgcccaccaagttgagcctcggacaatctttctccaggtaaattaaactgatgatcctcaggtcttccaaagttgctttctttctcagatgaatcatcagaatattgaggatcgggtgaatgagaacgatgcggatcagttggcatgtcatactcatcactgtgaatatgagggctatatggtggggattgacccaaggaattagttggcatattctgactacctacacggcttgtttctgttctccccccatccttcctagcatcattacttgagatgagtcttggatcataagcccctgaactctgctcattagaactcctctgcccatccttcattaaatgttcagcttgttgcttcctgggtgtagtttcatgggtataagcaggtgactcaaaagctccagtattttgctccgcagaaaggtttccacgactagcaagttgggcagcagccctagcagcaatactagccatctctgcggactctgctgctgcttgtgctgcagatgttgcatccttgaattctatattccaattggaaccactaactgaagattttctctccctagagtgattgaactcttccctcctggacgctgtatctgaaaataacatttaaactaggaatgaacaagaaagcactaaaaaattggtaatgttcagattatatgaccttcacctgtatctggaactgttgcaccatattgggagtaaggtctagaaacatttgaacctccagcagtatcatgagagaaactgttaggaccatgctgggacctaggggacattggagcatcagaaccccttctgttttcttgggggaaagcattagaattggcagtgacatatggagccctattgtctggaacctcagctgatgaatatgaatgtgccgtagacatgtgagaattggaagattccatatatgaatgagaaggtgcagcaggctgtgaagttggcatgccagaattagaagcagatgatcccctagttggaatatttcctcccggatatgttgaggtcacatgctaaatcatcaaatgattaatccagttagaaccataatacttgaacgcttaaataaacttttatgtcagctaatttaccagaagatcatcattttgcttcggcaatttctcctcaaatgcttttggctcccatttgatgttgtgctcctctgcaatagaggtcaaggttttgattttggtctgtgtatcaggtgctccagctgacagcttctcaatgacctgtatccaattattacaaacataagctataatcatggcatatatttattcaggccaacagaagtaaggaaattattttcccatacaaaatacttctaaaagcagcataaattaccagtcggctgacaccactgtcaggtcgcacttcaagagctgctgctgcaaactcttttccatacttacttgtgaaatgcttgcgaacatctgcaagttctgtgacatctgaacacctcattgatgcaaatataacactggctatggcttctttcagatcaatagggcaagtccttcaggtaaaaaccacataaacaaggaaaggaagagaacagatcagttccaggggaacagaaaccataaaaccaataaattaactaagaaaaccaaaacaatgcatagttttcaatcaatattaatctcaatttattttttatctaagctcttttcttcctgtcattatcttaaaaggtcgcgccacagcacaggtcctagataactaagatgcaatgagcatctaacaccctggacattagtatgttataattagacaatcgatttgtatagttttcgtttaagaaagcatagaagcactcatcttagtggctattattttgtatttcttaaaatgagtgtgccaattgccatagagttggtagcacttgacttaattagactattttagaatagtttgattagttaagatgagaatgagtaaatgggaggattcagctcctttgaaaccatgaaataatacttggagcgtaaaactcatgtctaggctaacttgatattttcagataatggaagcttaattgaactcagctaaataaggctaacttgatatggcagaattgagtccataaaacattccactctggaaccagggaagtttcaattggaagacataaggaatttacatttatctccagcaagtaactaagtagtatatgactgtgccacaaaaaaaataaagtgggttcagtttccagattacactcacgaggaaaaaaaaagaggatgccaggattataagcagttttaggaggcccatatcaatcaggcaaaatcatgctttgcttataagaaaaaagtaactcttgtgatataagaaacaatctgaaggttgctaataacatgaaaaaaattgtttagtatcaacttaagaaatcatatcgacaagaaataagctatgttagaggtagtcctccaactaacaaaatatgcttctgttatctatgataatgaagcaatttctgacataagaaacataaatagaccagcaagtaattggctatatgcattatatacaataaaggggaaaatggcttacttctgtgagtcaataatggacatgcgtgccaccataagttcacagtatacttcaattaagtcatatgcttgcatgaacttctcttcccttatgacatgttcaacctgtggaaaaagataagcaaaacgggccaaaaagaaaatagatgagcctttggtcaggaagtaccatcaagacacgttaggactgtgtgtgcgtctttgattcactaacaagtagctggtcactctgtggctcagaacccaacaggatgccctaataatatactcacagcaagataatacttgacacatgcattcgcaacaagcaggcatgtaaaagtaaagaaaaaccaaatactcaaatggatggaactaaaaaacgaatcattcgttgtaatgtagctaccgagaggcaaaaccaaacacttgtcagataagaatccaatactctcatggaattcaagagttcaacggagcaagtcaatacagtgaccaaattgatggcactgctacagaacgaattgtaaatggtttctgtcaagacataaaaatgaattgcatttgagccagcaggcatatacagggccaacaggcccaaggacttctatggcaattccacttataattgcagtagttcatcggcatatccaaagcgagcagatcattcgtaaaacatcactactactagtaactaacaaaattttcccatataaacacctaaggcacactaagaccaagcgcaagcggctaaacaattgatgctagcatccaaagcccatctgattccgcgtcaaggcaccccaattacccgattccgtcatcaattgggggagctaaagagacaaattgagaccgcgatagagacggaggcaagggaaggcgtaccctgatgcgtgcggtctggtcctgatcggcctcgagcagctgcgcgacctctcgacgcatctgccgcacctgcacctccttgcggttcctcagcagcttgatccgcgccagcgccatccgcagcgccgtcttgctgcggcatccacgagacccaaaaaaaaaaaaactgttagcccttgcaagcacgcgcctccgcggcgcacacaaacgcgcgcggagagttagcgagggcgagatgatctcgggcaggcgggcaaactgaccacttgtcgggcttgaagcccttgtgcaggacgccggacagcttcgccttgctcctgttcatctccgcctccgccgccgccgccgctgccgcttccgcttctctgtgtacctagattcgaatcgaatcggctcccgcgaggcgcggggggcaggcgaggggtagctgggcgcgggcgtctccggttggtgcaggtagattggaaaggagggaggaggatgggttcacgcggatgcgtgtgctgcgctaccgaccagggaggaagaggccaaggagagagggggggagactttcgctaggcagggaggaagagaggagataggaaaacggatgcggttttttctcggaggattccgtgacgacgaaaccgcagacagaagcccaggcgcaggcggcttcttcaccgcttccgtcacgtcgattcgggagattgaccttgaccggtggcgcgcccggttcgagggcggggcgcgtggggaggattcgcggggatttttgggggtgatacgcgccgtttctgctggggtgtacttgggttggaaaacccgaggaacggaggcatatattgttacaaacttagtaaaaactttctaaactgatcatattaagtagatatataaaataaggtaagccattaatatataattaattaaatattaactattttaaactttaaaaatggattaatatgatttttttaaagtaaatttcatatagaaatttattttttaaaaaacataccgtttaatagtttaaaaagcgtgcacgaaaaaacgaaataaaccaactcactctcacctcccctagaacgcagtacaataaagtaagagctagctataaacacatatcgagaaaataaaagaaaagagaaaaacaacaagctacagattcgtagtcagctgcagcatggactccaaggcaaaacgtgtgtatgataagtgggaccgattattaatattgtagtatatgtttataggtaactattgtatgtattggctatatatatgatttggtgctagttgttaactatactattaaacttgctctaattacatctaaattagtagtagattctaaaccttaatatataaacatgagaaattatcattcctcgtaccatttccacaacatttcactcaaaccaaatctatccataatttaacgtttaacaaatcttcattcatatatctcacggtaaagcgcgaggcattatatccataacatttcacttcaaaaagtctatccatcatttctacgagatatatggttctatccaccatatatagaaaaaatggttatatacacctgagagtacctgccctgctcccgatccaccattgatcagtgcaggacaccgattgagcacccacgaccttgctatcagatccaccatacatgctttggttttttcttttccagaataaattgctggaattgttaattatcccttacggcttgactgacaactggagagaagaggattgagagtttggagtagggaattgatgatgagattaacatgggaatttgatttttaattctaatatcttgtttggtagagatggtgggaattaatagggagtttagtttgagattagattttaaatgaaaatggatggtcatatttgtttaggcaaagtaaaggaggaatttcctcccaattaccaccctatacccaaaagtattgaagagggagttattactttctcaattccccattatcatcctaccaaaatcttccatatcttccaccgaacggaacaattaatagcctcatatctctaagctcctaatcacttgtaaaaacccctcctaaccaaacgtcccgttaatgatcggatctagcaacggcgctgagctgctagcatatactccctccgtcccaaaatatagccacttttgtttatgaatctaaaagtggctatattttgggacggaggtagtatactcttgtttcaaccgtggcgatgggttgcggcgattcggtcgatctcccctgatatttcccatgcgagattcggctgctgacaaatcgatccacctcatggaagaaacatacatggcggcacgacatcgtgtacgtcatcgtgttcggcatgcttcactagacgatgtgctttgttcgctcaccgtgacttcctcgttaacaggcggcggcggttggaatatgtcaacaccagcatctagcctttctacgcgtacgtgatgcatctgctaactccattttttgatggatgatgagcatattataggcgcataaatctttttatcagcatgcattgtgtaaatatcatccttgtctagaatatggtatctgtaagttctggtagttcataacctataatgactaataaaaatatctatcatacaaagtactttttatacattgtttccattgccaagtcaataagactatgaaaacacaacacagataatgatcgaggtcgctcctcgaccgaggaacacatgttgagatagtagcgcggtttctgagtctcactattactaatatctgatactatcattcactcatcaatgacgaaaaatggtaaatactgaaaagttgcagaaaaaacttcatacacaaaattataattgatttcatcctcagaccaccaatcaatcaaactaggaaggtcaattgttttgtgaccttaagaggaattattcaaggcatgctgccaatccacaccccttccatatcatatcttcctatatagttgttacccactaagaatcatttactcctataaaacaagacatgcaagaagttacatcatcaataattttaagccatcggatcgcattagtatagagttatcacccgttggatcaagaagttagctactcatccatctaatttaatcattgattactcatccattcacctccctttagctcataatcgcgcgtgacattgttatacattctgcacatccaaatcctcaaagacaatactaatcttttttttttctaaatacaactccaattattacataagatgtgagctttgttttgttataaacaattggataacatacaataactaggtatcattaatccaaactcatttttgaaacatgcttgagatgaagcagataagtgctacactacctaattgtaacgatatccagattgtgcatgaaaacaactttcacatatcataacaatacacaatgatgtttcaaaaaataaaacatgaattatattgtaataacagaagctatatatgaagccgcattatcatttattttgtatatacaaagagttgcatctaatcatttaaaacattgattttattcgatgataaaactagcaaatcccgcagcaaggcgcggggtgccaactagtaaacttaaagcctaatggcataagaggtagtaattctgatcaatcttatgacttgctgaactcatcctaaattcctggaaggcaaatgacaaaaattacagcaaaattttcatgatttgcattgtacaaccaaatgatatagaattatctaaaggtctggtacacgttgatttaccccttaacacatttccattataaaaaaataccagaatatatgggtgtgattgtacccttcaggttgctgctcctccattaagagcattgatagcattgtttagatgcatcttaagttgcttcatcaatactttattaaatttaagaaaatggattggatttttttaaaaaaactgttaacatcatacattacctaatatacattgcacaacaagatacactacgtcaggacaggtttatagtaacacatttttgtgttacaataaccccaaaaatgtattactagtgcctacagtaacacaattatgtaatgttactatagcctatgttactatagctgggtataccgtaacacatgtagatgtccttaaaaataagaaaaggtgttaccaaaaaaagttatagtaacatatgttattttgttacaatagatcatagtaacacctttgtgcacttatagcaacactgtaacataacacgttttttctagttccagcaacaaacttgtaacacctttctatatactgcaacatagtaatagtatatgacgaatggtgcctttaattcaatattattataatagtaaactgctctgtattatcttcacaaactttggagaaggaattagcaagacatcacacaagggcaatgaccacgaatgagtagataac

SEQ ID NO: 59335 - DNA, 1833 bp, Oryza sativa
ggcagcgacagcacgtcggtgatgatgttgccgacggtgctgacgctcgtggcggtgttcttcgggaactcgctgcaggtgtcgttgaggcagcctgcggataccgcgtcgaggcaggtgatggcgcagccggcgttcttcagaaggcggcagggcttggcaccgcaccgcacgccggcgtacgacgaggacacgtacccggcgtcgcagtccacccagagcatggtgcccgcgaggtccagcacggccttcacgggcacctgcggcgtccgctgccggaacatcgtcacgtactgctgcgtcgcgtcgtccttgctcaccggcagcaccacggagctcggcccgccgcctgccgccgcgcggcacggcgagaccgagacgaacagcaggaggagagcgccggaagccacagcaagaggaggcaagcgtgccatgctgacaagagtcagaaaacgaagaactcgatggggatggagatgtgaacttgtgaagtaatgatgcggcaatcaacgacatttataggcgcaacacgagcgatttgggtctccccgtctcaagtctcaacctcttattacgagttacgataccgcggcgagggttgggcagtacgtagtggcgcgcaacctgcccaccgcggggcgagacaacgaagtggacagggaactctgctgttctggtactagctagctgtatttgacggtctggagatgtgcgatctttggacgcgtccatggcgggccacgcatgcatgcacgcacgcctagatcatctgtactacatgtacggagtacattttcttatggcctgtttagattaatttggtctgataattttttttaaaaaagttttggtggtaaaagatttggcattgaagttttgctagttggtgtttacatgcatggtaaagttttgccattttactagtaaaggcagagagagagagagcacggcttccaacacactttttaccaaaatttgttactctagacttccaaatgacaaatgccaaattacaaacttttgctactagtgttgagatctattttggcaaaaagtgccctaaaacagcaaaacttttgccattttggaggaaataagggttccttttaatcgcaggatcgagaaaacgtaggaatatgaaaaaacataggattttgataggaatatatgggccctttgattcaaaggaaatttacaggaattttagaggattttattcttataggaatttttcctatatggccctttgaatcaaaggaatggattctatggaatcctatgaaattcctatggaatgcctcttcccatgcaagtttttttaggaaattagggccctttgatttgtaggaaaaatatagaaattttggaggatttcaatccgatggaaaaaaaaatcctatgaaggtctttgaaacaaaggattgaatcctatccaatcctttaaaattcctatggaatgggtaatcctatgtatattttggaggaaagttagcaagaggtctaacctcttggaaaatttcctctgagtctatctctctcatgttcagaatcctatgtttttcctattcctttgttttttcgttcctatgattcaaaggtagaacctcatggaaagaatactttgagtctttatctctcctcaaatttatgtgattttcctgcggcccaatcaaacattcattcctatatttttcttgtattttgcaatcctctgttttacactagaattcctgtcagaatcctatgttttttctattcttccatttttttcattcctgtgattcaaatgggccctaagtgtaaaacagatgattgcaaaatacaggaaaaaat

SEQ ID NO: 59336 - DNA, 18975 bp, Oryza sativa
gtgagctcctctactcacggtcggcctttggccactgttgccttcgccaagcccgtcctctcccttttctaatctccccttcgtcctcctcaggctcttccggtcgtcatccgccactcctcgctcgcggactgccattgaaccgccgtagccgtgcctccccgaggaagcgtcgtcgcctctcctcgtcgtcggtcgctctccggcgccgcctccgtgccttgtgcgctcggtgagctccccatctccttcctctgcctccctccgctgcctcccgcgcgtgccgtcgcgccggtggtcgtcgccggcgacctttgggctgctcgccgtcgctccccggccggtcggccggcgagttttgccgctcccgctagctgtggccgcccgatcccctttggggtgatccgggccgtctacgtggctctggcgccgccccgcgccggtgtcccatgtggcgccacctcggcgccatgcctttgccacctcgccccgccgtgccgtcgtggccgccacgtggtcttccacgtggtgtgcccgcgcgcctgtgctgcggtggaccgagtccaccatgagccaccccctttgacccgctgacgtgtggggcccacctgtcggcgcccttcctcttgctgacgttagcgcttatcatttcctttggaaaaatatttaataattgtgcaataaattggtattaattatagaaattcatttaaatggctcaaaacttctaaaattcatatctaattcattcgaactccaaattgggccattcaacttacaaaattcatctaaaattgagatctacatgtttgtttactttttatgtactgtttccttggtttttattagattttttcctcgttttgtgtgccagcgtgtagaatccgtcgtttcggaagatcgcggtcacgaggaaaagagttcagaagatccaagtgaagaagcaaggcaagtcacacattccccttgaacattttgatcctaatttacaaatgttttattgtttgcaaataaaattgcatgtcttgctaattacatgggatccgggtattacctatctgtttgcttgtgccatatttacttgatatctgtcatttgtcaaccttgggtaataaatagactagctcatgttacttatgtgacctagctagaactatatacttagtcatgcttaattaccactagctcagttgatgggataattacagtattagatctttttagtatcagaatgagctgcgtgctcaagacatctagccatacttcatggtcgtaattatccaactaaaatgcgactacatggtgggctgtgggtgcatggttttgctagtcgtgcccatggcgattaaggaccggttcgcgggaaaccctggaagaatttatcatgcttaccataagccagcgtgggcaacggctgggcttgtagtgtagctttcctctagctgacgcatccaggcaagggtgggcgtgatggagtttggatgggtcctgcgacggcctatgcggcttccggattcacctaggcacgagaggggactgcccgctatcttgcgaggagtgggggtgaaacctgaggtgtggtgtgcttggttagagggggttatgtgaagggtcctgtcacgacctctttccggtatgtcgtggtggcatgtcggcgcacggaaacgtgtcgtggggctgtatcttgtaggtacagttgtacacctctgatcagagtaaaactattcgagtagccgtgcctgcggttatgggcagtcgaccagattcaccgtgattagtcccaccttaataaatcgactcaatgcactgtagttcagatgggttggttgggcctgttcaacgtggtgtagtgttgatcagtgaagatttaatgttactttaattactcaatagttttacggttttgctcaataaaatgttttacaaccgcctttatgcaaatagccacaaaccgtccttgtgttccccttgcacgtttgcatcattggtgtggcttgctgagtacggtggttgtactcagcctttgctattattcccccttttcagaagtgtagtgcttctgagctgaagacgaagttagaggaccaagactcagaccccagttgagttttgcctgtggagtggagctgaagccccgctaggatcgtcttttctgctgccgttgcttttgtttcggtgtgaggactaagtgcctctcctgtaagtattttacgctttatttacgtttggaactgtttattacttgtcgttttgtgtaccctggctggtcctggatagggatttaatacacaaaatagtctagaaatttgggctaaatttctgggtgtgatagaatgggattaatccgaagcgccgccaatgtagaggcggtcgatagggacaatatatatagatggagcgttgccttgtccagaatagggaaggagaggcgcgggggaagagagaataagcggaaattgaaccagagtgtggtccttgtggaacaagcttacaagggtgacaacttgaatgagagtgttctcatgtatgacaatatgagagaggcggacataagagaggatatattttcacatgttattttctcattaagattcatattttatctcgatttcgatagcatgtttttcaaactactagatggtgtgtttcatacgaaaattttctatgtaagttgatttaaactatcaaatttatccatttgttaatgttgtaataattaaaacttaaataatcatgtgctaatagctaaattaatttgtacaaaaactttctcattacatgcacatgattaattaagttttaattattataaacttaacaaatatatatatttgatattttaaagtaacttttatatagaattttttcacacaaaacaaaacatatagcttaatagttcgtaaaatgtgctaacggtaatgagacaagaagggagccgctaaataaattggacggctgagatactatctgctataggaagcgaccaaccaacgtccacgcttctctgcgaaacacggaagctgcagccgcggccacgtcggcacaaaccgaaggcgggaggacggacgacgaccctccattccccatctcttccaccatctctcctctccctccccacaagaaaaacctcgcgcgaacaatgtacagccctctcggcagcggctgcgcgttcgcggccgcggccagctccgcgttcccgccggccaccgtccccggcgggatattcgcggggaggaggaggaggaggccggcgaggctggttcttgcgtgggcgagctcggatggctcggacggtggtggtgccgccgctggtgcagtggcggccgaggcttccgctgtgggagagagcaaagaaggggaggtggccagtggcggaggttcttccgctgagtcgtcggcggagaagaagccggctcctgttgatcccaagattgagaaggagctcaagaaggtcggctcttttctttgtcccttggtctaagaactaagcattcagctcaggagatggtatctaatctctcgggtggacgtccacccgtttcttgcataccacctaaatgattatgaaaaaattccaaaaaaaattataagataggttaatatgtaatatatcatctcacaaacatgcaagtccaaattcgacttctacaagttgtaacaaaaataacaaattaaactctaactagtatacatatattcacaatcaaatttgttatttttattacaacttatagaagttgaacttgaacttgcatgtttgtgagatgatatattacatattaacctatcatgtcaatttttttgaaaatttttcataaccatttagatgacatgcaagaaacgggtggacgtccacccgagtgtttaaaacagtttcccattcagcttgttcgatataattcataagttgttgcaaataatactaggcaactgtaagaattcgaaacacttgaaaacttcacaattcgatagaaacctagtacaatgaattgcaggaagaaactaatttgagccatcagaaatgttgtagtcttctaataggtgatttaactttagagcaagtttaatagtatagccaactatcggctccaaattatatatagtcaatttaatagccaattcatacaatagttacctatatgtactacatcattaatgtttagtcccacctgtcatatacatatgtatcttggagtccgtattgtaactggctacaaatctgtagcctgctactcttatctctcctcttttatctctttaaaatatgtgtatagctggcttatagcctggtattgtacctgctcttagcatacatctagtttttggtcgtaggcccatatgcacaaagaaactcaaaatgttattttaaagggtagaaatgctaaagatttttgctgatacagcaaacaacatgacttcatgaggtcaccaccaaataactatgctgtgttcttgagcaggcagttcagaagaccgcagcaacgtttgcaccaagggcgtccactgccacaaagaaccctgcagtgcctggaacagctctgtacactatctttgaggtccagggatatgcctccatgctgttgggtggagccctttccttcaatctcgtgttcccgtcgaatgagccggacatttggaggctgatgggaatgtggtccatctggatgttcagtaagtaagaatttgatttgtggtacttgtcgttgtgcagtaagtttatacgtttgtaaattgttcccatcagcagcaaggattatgatctatccatgcatcaaccaagcccttgctcttttttcgtaagcagcaatggctaaaaatgtattgaaagtgctcttgtgctacaacattttgaatcaactggcacaaggggttaattcgtgcttcactagccataaactttatagtgcagttcatccagttctagataaagaatagttctaagagcaactgagaatttattttctttctagcacggtgtctgtttagctgttctatatatgcatatatgctgactggaaaaacatgatgaaatatccttctctttgccaacctttaacaaaaatccttgaggttgtcatatcaagtagtaattaacagtgaatctgtctctcaatattaattattaatctgaggctgtcgataaaatgaacataatttgatctctagatgctgtgtcgctgttgaggttaataagattcaatggatgcaatgaattagatacattttctgtgatgctgtaactgatcaactacctacttctgcagctataccttctcttcgggcccgtgactgctcaagtaaggagaaagaggctctcaactacttgtttctactggtccctctaatcaacgtcattatcccgttcttcgtgaaatccttcgctgttgtctggtcagcagatacggttgcattctttgtgatgtatgcttggaaggtatttcctcatgtcaaatgttgtctgctccttcaatattcagccagttttgttgtcaaatgtttaacaagattcatttctacacagcttggatggctgcaacggtcagagtgaacaatttcctgaacgaaggagcatttgaactgcaaattttgcctaagtgaattttggagggcacgctacatgcgatgaatttttcctagatttagtttcgtgtacatccatggagtgtaaagaagcttgctatgtagatgtaccttaaattgtcaacattagtgttgactaggaactgggcatctctcaacctgttatggtttcccagtagatcatatatgtctgcgcgctggcatgaaacggttgccaattgcatctgcttcgttcttggggctacaattcgcaactgaatttgctatatatttgtcgacaaattttccaccaaaaatttaacagatgtaattatagtacaatcgtagtgtaattacactgtaacttgcatgtaattacactgtaattataatgtaacatgtatgtaacttttaaaaatctctccataacatttatttcggtaaaatggaggttgtgagaacaaattctttcacatatgtgtatgatgtgattttttttcttcctcaccagaacaaatcttataatagatctaacgattcaaaattacgtgaaacttacatataagttacactgtagttacatgcaagttacagtgtaattacatatgagttacagtataactacactacggttgtattataattacatctgtcaaaaagaaaatttgtcaaaaagaaaatttgtcgacaaatgtatagggagtattcctttcttaaactatgaatttactcttttggaaaaaataagtctctttgtttgaattttagaactttgaattttttaccctgaaaaaaaaaagaaaaacctaaccatttaaatctttggtatccttcaaatcttcggtatccttcgagtcttcggtacgcttcgaatccttatggggaagtctataaattatacgccccttgcttgaatcataacgacttacttcaattttgactctatcccccatcagtattcgcatagaactagaccggatctttcctgaaatatagcccaggatgatggtgtcattctctaggcgaacgcggaacattccgttgggtagggcttccataactaaaccctcgaaagtaatttttgcttctctcggggtttttttttctctcctatttttcttttctgtcatatttttttctcctatttttctttttttattttcaaataaaaaaatgttgtatttttgtttgaaaaataggaagttcaagatagaatttgggtactataactataggtggggcgattaccatatataacataagacttctcctccaattttgtttagtcgagcttctcgatctgtcattatacctcgagaagtagaaagaatagcaattcccattccagccaaaaccttaggaattccttgatagttggcataaattcataagccaggtcggctgatacgctttaaaaaggttctagttctatatattccctttctagtctttctcttttgatgtcgcaaagttgaaaccaagaaatatctattactttcctgatgtttccgaacactttcaataaaaccctctcgtagaagtattttaacaatgttttcggtaatatttgtagatactacccgaatagttccttttttattcatgtctgtgtttcttatagaggttagtaaatcaacaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactagtttagtaaaattcaattctctcaattcctcgacgatcgtgccaaaaacgcgagttccttttggatttcctttttgatcaatgataaccgctgcattgtcgtcatagcgtattattataccgtcttcgcatttgaactctttacatgtacgtacaattacagctcgaattacttgagatctttctagaggcatttggggcactgcgtctttgattacagcaacaataacatcaccaatacgagcatattgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggtttttttattttcaatactactttttttggggggttatatttctaaccgaagaaattgacttcgtatgggcattttgctggcagctatggaaatagctgctctagctatagtttcggatactctgcccatttcataaagtattcgacttggtttaacaacggctacccaatattcgggggatccctttcccgaacccatacgtgtttccgtcggtcttattgtaaccggtttgtcgggaaatatacgtaccagatttttccaacacgacgtgcatatcgtgtcattgctcttcgtcctgcttctatctgcctcgccgtaatccaagtaggttcaagtgcttgaagagcatatctaccaaaacaaatacaattgcctcggtaggattttccctttattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattaaatttattaaaatactaaaatatatagtcaagaaaagaggatctagaatatatctagatgtgtatgtttatttatctatattctatatttaatgtaattcttttttttaatctcctttttttattttactcttattgaatcgcggtaaagtattctaattcaataaaaatttcgcgggcgaatatttactctttcatgtcttatttgttaattcataaccttatcaaataagacaattttttttggtttgttccgccatcccacccaatgaagtattgggatttttttcaagaaaatcctatccagtcataggttctgtcattcccactgcttctcctttaatggttaggtttgaatctcgcaatggagcttccaaaaaatttctttccgagtcaatttctcagtttattaactcaggacgctctttgttattccttgaaatttgtatttcttgtttcaatcaaattacgatttcgaattctttgttatttttattatattgatgctttatcacattgctttttatgatgtaattcatagaccatacatattggaatcctatatctttcttttttctcttccttctttctatcatccttccttttatctacatcccctttagttttgcttcacaacttagaatcctatttttttaaagaaaaaattgcagttgctacacgtatatgatagatttacttatttatgatagatgtatttattcatatagtgactgtttcttagttaggatctcgacaatacgaagcaataggttggttattagttcattttctataattacatagtagggttcattctatttttttaatcccctttttgaaccctaaaaaaaactaacgagtcacacactaaacatagcaattttattaaaagatttctcaattttcattaaatcttatagaaagaggtagaatttcttctttttttcagggattttagggaaaataaggctcttgtcattttttattctattacttaacagaatgggaagacagggttggttattcttcatctacgaatatccaaattttaactcctaatactccatagatagttcgaattggatagcagcaataatcaattttagatcgaattgtttggaggggaagtctaccttttttgatgcattcggcacgcgcaatttcttttcccgcgagacggcctgcaatttttacttttactccctttatatatgttttttagttaattcaatgacccctgtacatttgtcgataaattttctcttaaaaatttgacagatgtaattatagtacaatcgtagtgtagttacactgtaactcatatgtaattacactgtaacttgcatgtaactacagtgtaacttatatgtaagtttcacgtaattttgaatcgttagatctattacaagatttgtactattacaagatttgtactagtgaggaagaaaacaaatcatagcacacacatatgtgaaaaaatttgttcccaaggtctccattttatcgaaataacaagttacggaaagatttttgaaaattacatacaacttacattatagttacagtgtaattacatgcaagttatagtgtaattacactacgattatactgtaattacatccgtcaaatttttgagggaaaatttatcgacaaatatatagcaaaattatatctcattcatatgatcaattgaccaccatatctggttctcttacccagtttcactttcatagcacgtatgagagcacgcttgtgctttgatgctttctcgcgttgacaactcgaaaacgtgtttatccatagttccatgcccgtatctccaaaacgtatttctgatttacgctttcaaggtgtgcagcgacatcaaaatatgtatatggttcagtgccttatttgaggcaaatatttttcatggaagaaagatcaaactgcaccacatctcattcacatgatcaaattaaccatgtctgaaaacacgcttgtgctttgatacttccccgctttgacagctggaaagcgtgtttctccatgaccgaaagggtccaatgtccgtatctcggaaacgtactttcgatttacgctttcaagaaatggaccaaataggagtccgggctcgagccactcgactcgaccgattcgacaccgacgaaagagggcgaaaaccatgggctcctcctcgagcaacggccggaccgcgcccgcgccgccgcctccggctgcgcctgcgccgccgcacccactccacgtgatggacgccgacgaggaggacgagaacgtgaagcagctcagcgagtgcgccgccctctacctctccctccaggcaccgattctctcccgctccctttcccctctccctcccctgcgtgttctcttccccgcctcgttcttagtagttgaggacttgaggaggcgaaggcgattcctgtcctgctgccgcgcgcaaatctcttcctgacttaacagtctctgatcttgctgttcgcttggatcctttgcaggattgcctcgtggagtccaaccgcagctggaaggcctgccaagcacgtaagcatcgcgacaaattcgtcattcctttctctctctctatagtaggccttggcgttcatattggtgaactgaatgagttgctgaaagttgctgattgcttgctcagattggaactgatcaactgaatttgttgtcaaatggtttggaattaggcaaaaccttggatttgtagtgttgtgttgaatacccaggataactgcctcatgttacatgtgaatggtttctggtttatcaagtgttaatgtaaactcaggaatgctacgaaattttcttcttcaaaagagagtgcttatggtatagctgaagtgaggctcacttgcttatcacattacactctcagagagaaaaggaaatgtggggaatttttcttgcttctttgggaattgaattgttttgtatgaaattcttgcatatagataggttcttaatggcatgatatggccttcaatagcttaaaacgtgctagaatgggagttagaatcatccaagataaatctacatgtgaatgtggtttagcttcatgtctttcctgaaactattctaaggcttcgtgaagttatgtctttcggcgcttctttacaaccatgcgcacttgtgcgatattactgggtaattttctagtaaaagaagttgctgatccatgaggcaatttgtacacatttggcttacctaacagctcgcaggcccttaacaagtaacaacagcaggcatgcagatccaactttgccatatagcactaatgtcctaggctcctagcactgcacaaagtttggtcacacatttgcatcctagttgctttccaaaatcgaataacttacagccacattttattttgtcttttggctgtacaattgctgtgatgaggttaatgtttgctcaagtcaaggggctagacctgagttgagatgttgcaattttaagatgccttgcattgtgatccgagctaaatgtagcatttctttgaggataaaagtatggtagctatgatagttacatccatatttgtttaaagttagtgctgtcttagttttccacaagctggattctggttttattatcgtaacattatctcactttgttctaacaatatctgtgttgcttcctttttatggcagatgttcaagccttgaaagcatgtgaggcaaagagaaacaaaagtgaaacaagataaaattattttgcaatatttggcactaataccaggcaagtagaaagttaatatggtttgaagagttttgaaatcaactgacttgtttcttcaaatattgcgttatggctgttgccatcagcatcgaactgaacactatgttttttcaccagtctgcttttggaaggtttatcatattcttcattgaggatggcgacaccataggcagcgtgtttagagctgttagctgatgatggagaaggtctacagcatcataacctggagttaacttgttaaaagaacctgtagttagatttcgaccgaaaggacacaggatgagctcgccacgttaactgaacttgcttgattgtttctggtggcagtcgctgtttcttcacattttcatgaaatgagacaatatcagcattacatgcgcctttggataactgctgatatgagttcatagcttaagattatcattgttgctgagatgcctttaggctttttcaatacctgttttggctttgttttggggcgcacatggttcgccacatcgtctatacaagtgacatcgtagcgacagaatcagcgtcttcagtgacgcaactgccattgcagaccgagaacaccaactcctgccattctcccggtggctttctccatcggatagtttcttccgtgttcaattatgtacggatatgaacttctctggttatcagaaaaaagtagaactggaagtgtaaataggttacagccaaaagttttcgacaatcatcagacttggtatttcgcattattgacaaaccgcagagtataaattgctttctgaaaaatccgatacttttttaataatcacaggtttactatgactgcgcagactgttctattgcgggcttatacttccatgctcaaagcttactatcttctgaggctggaatgaacttgagtgagatactgttaacacaatgccgctcatctgtaggcgtgttgaacccctcccctttgaagacatgtcctaaatgtcctccgcaagccgcacaggtgatctctattcgcctgccatcaggatcaggctgaagttgcaaaatagtgccagcatcagtaggagagtatggaacgaccgaaagaggaaaacaaaacaccatatatattcatcgccattcgatgtagaagacaaaaccataccgttcgtgcgatggctccgggaaatccttcatagaatgctggccaaccacaacctgagttgaatttagtagatgacttgtacaatggagtcccgcatccagcacattcataaacaccctcagcgaagagcttgtcatattcacctgttccaggatacctggaaaaaaaaaaagatcaaatcaaaaaattagttcaagactaccagattaaccatgtcatacaccagtaattcgttaactgtacgacaacacaaatgttgataatgagaataggatcagcactgcaacttcgtacagaattatctttttgcagttttgttacattactcaactgtcaggactcaggactacagttgcagatcaggaacaaaacaagcctcaaaggatggtaagttggttacaaccaacaagcatttgtagtgacttcgctttagtaactttggctgagctatttttcgcttacattctgcacttcatgatatgcagctgtgtccaatgagacaataacatattggtcgaatagtagacaaaagaaatattaccgagaaaagggttcatgcactagtactatgtctgtatagcaagatacaatcctggtcaagactcaagacaaagaggatatgtctagagacaaacctaaaattaacatttcatacaggatcatagtaacaagctgatttttttagacaatcatatgtatatacacagccagtagtaacgggctggtaaactgataaattttgtcttcagagtaaaatatcagatactgttacacatgaaattccacatgtaattctaccatttgatatccaaagtacagctggtacttaatttatgaacaattgtgtgcacaaaaaatcattatgtcatcaaaatgcaaaaaataggaaggcatccattccaagaacgtacattcagtcattcagatgagagttatgttttttcacaaactggcaaaaggattgcacgtcattgtattagaagaagcaattgtagtttacacgacatgatgactgggagccatcgtgagtttacatatcagtttccactttcctactaaatctgtagccataggtgcgtgtttttcttgtgcttgagccgatgattaggaaactaactatatctattgtcacatcattttaattttaaacctctggaatattagtccttcaatttgttgctaattttgccaagttttttttttctaattactgtcaatttatatagacttttagctctgatgttttttttatcatctataaaaaatctttgaatttatgtaatactttttatacaattttttttatcacaatcatttgttaagctgcccccctcatagttaaagcctagcttcgcaactgatcacaagcattttagtttgttttttcttcttttgcttggtaaaatcaattggcctggtcggctattatttttgaggctgctcccactgcgaatagctttggctgtgcagctgtacacttcacagctgagcagggccaaatcataaccactttaaattgcattagcagatctagaaacgtttgcagcatgcaaaaatgtcccagaaatgcaactagataacattacagctgttgacccatggcaaaaaaaaaaaaagatggaaactcgggagcagattaataaagagacaggatggttggctgtccagagccagtaaccatgcataggcaagtcatttctgaaagagctcttgcaaagtagcaaggaaatgcacccttccacacatgctcatacatgatccgagtatatactgattcaaagttttaagaaattggcattatcagaaacggaaacagaaacagatagcaaattagcaatgactttacgctagtattttttattctaaggggaaaagaaggataaacagtgggaagaaacacgtcttactccgtgcccttgaggcggaggatgcggaactgctccggcgagaggatggcctcccactcctcctccgacttctgcacggatcccggaggcggcggcggcgccgacgaggacatcgccacgacgacctgcagccgccgccggcccgccgtcccgcggcaccggctggcggcccactggttgtggttgcagtgcggccgcgagcacgagagggtgacgtgccgaggaggaggcgcggcggcggtggaggagggccgggcgaggaagaagaaggcgagcgcggagagcgggcgcgcggcgagcggcgcgccggggtgcgggtgcgggtggggcgacgccatcctcagcttgagcagatgctggacgcccatttttttttcttccttggcgtgtttcgtctggcagtccgtagtacacgtgtccttttcgttttctggtggcgctgatagctgataaggttcttgtgcaagtgtagtgactggataacttcataaggccatgtacaaatgtacaatatggtgcctcgtaactcactgaaggtttgaagtgatctcgcaggggggcagatgaaacagtggttgaactgtggttctaggagagagagaacgatttgtgtgatccagaaagttacagaggagaaaaggggaactagaggccattgacgagttgacgggctggaggtcatcgccgccagcccatgcctcgttgtggcccgtgccgccagggagggaggagagggagcccaacggcggctccgaacaaatcgacgccacctccgggaagacgctgacaacggcggtggctcggccagatccggcgagcatgacgccagatctgtggatctctctggttctcgagctcggccagatccagcgagcatgatgccagatccccgctggaaagctcaagctcgagcgccaccgatcctgtcgccctttgccacacgaagctcgacgtcaaagatctcatcaccaccatgagctgggcgggccacgcctcgtcgacaaggcacagagaaggagaagaggagcaccgacagcaaaggagaaggggagcgcctccgtcggagaaggagaagagggaaaggcgagaatagcgacagtggtggtaagggggtgggggtggaaaatgaatgtgagaggctaactgtgggaccgttaggaggttagagtatatatatatatatgtgttcttttttgttgttataaggtctaaaatataaaagtattatcgatgtgataataaaaaagttaataaggactgaaatgaaaaaacatttagcacttagcagtagtctccattaaagaattgtgtgtatattagtggccttagcctatgtagtaacttgagaccactaatagtagtagcctccattgtacatgtcctcttggaatacaaccatttatgaagaaaatgcagatctcggataagtcagcctcatccttttttttatacttatacctatcagtcaaaatttaaattttaaacctaaaatttagagttaattttagggcctttcatcatattatatcttttagcttttgcttgtagatgtataaaaaagttttattcacaaattatttttcatttgcaaatatgccgtttcactttttcctccaatatgccaaaccatggtgctgatacctgctgcgttccaattgaaaggcagccactttgttcttgtgacaacttctaaaactaaaacctgtagatatctctgcctttttctcttactgagcatctgaaatacccttttccagaaatgcagaaaatgctgcaacttcgttgctctccttaaagacaggattttagtcttagcacctgcaagttatggatttagctcatctattggcaatctatatcagttttgagtgtatggcacttgctggtgacgaaatctcttttccagcttgtaggcataagccgtataatcctctcaaagaaaatcataaacgaatggtacgtttcatgaaaaataacaagagatggaaaaaaaaagtatgcaaggccaacaaatgttctatgcagcacaactgtccaaattctgaagaaaatgtgagcccctaatgcactggccagaaccaggttaaaatgaagtttcgtattcaggaaatatgaactgtccacacgaggtattttttctcaaaaatatgtttctaaatggaaatgccaacttgtcagtaacaaatatgagcaatacagcactacacagatcaaggatatctgaatgcattggacctctaagctacaattttatatatccagcatttgttgatcaagccaatccttcaaaaacaaccacctagtgaccgcatgactgcatcatatcatgtacaacagagcatcaagctgaagacctacatgcaagttcgtcagcaaacagttgatacttgaagcatgttactcaataaactcatcatcggtgctgtcataatcactatcctcatccagatcttcatcttccacctcatcctctactcgctccgacaaagtgttcgtgtcaaaagagttatcaacttccatttcctcgatgccaatcgtatcatatttcatgcgctcatcgaatttggcatcagaacagtttagaagccatgcaagagagcatgtgaatcccttcttcgccaccatctcatgccgtggccttacagtcgactcaaggccatatgtaaagaatgcagggaattcaaccagctcctccaaatccctctccatctcattctggaagtactcaaagctcatcttcattatatccatgttcaatgcgagcagctgtgggcatgctacgaccatcttgctgacctgagagagcaagaagccacaagatgtaaggaaattaacatgctttagaactgcagttcggccaaggctaatggcttgtggcatcctctctatcactctaccaaaatcttcactgctgaccaaaatgctagactcaaacaagctctgttgtgtagcaagcttgtctctcagctcaattccaagaatgtctgggtattgtgccacaatgaatgctaatgcctccttcctcaccccaaattccagaagcgcctcaatattaggcttcaccttgtcctccaacccaaaaccaagaacatatggcttcttctcgatgattcttgcaatagctagcctctgcaacccaatgccctcaaggtgttcgacgaaaggcttaatgatcttacccacccgcatgcccagcacctctgggaaacgggtgatgacgctgccaacctgccgccttgccacgccaatgccgacgaggtaggcgatagaggtgctcatggttccctcgagcttgaagccgaggagctcggggtagcgctcgagcacccgcggcacgtcgtgcggcctgacgtccatgccctggaggtacttgacaacgggggcgaggtcgacgacgacgctggcgtggagcacctgcgggtagcggcggagcaggtccgggagcgcgtcctggcggacgccgagcttgccgaggtagtcgaggacggggaccatgttcttgcggacgctgcagcccagcgcgagcgggtacgcggcgaggtcctcgttggagaggtcgagggagtgcaggaactcgacgcgctcgcgcatgacgtcgacggtggcggggagctcgaggccgccgagctcgcccgggtcgactccgagcgaggcgaggaacgcgtcgacgtcggcgcggcggccggcgcggccgcgctccatgtcaaggaggctggggcgcgcgtaaagggaggaggagggggaggggcgggggctgggccggggcctggcat

SEQ ID NO: 59337 - DNA, 18825 bp, Oryza sativa
  unsure (1)..(18825): unsure at all n locations
taagaaaatttaaatataggtactatttacatcattccataacatccataacaaacttgaagatctttaaaaggagtatatattttaggcatctagctacattaaaaatgcaaaaatatagaaaatatatctatgcctatccaatctctatgaattcccatgcttcttgattagatcttgagtaggccactgaatcatgatcatttaaccattgatcttttgaatctgcaaaaaattaaagtaggatgtcatgatagcacagacataatatgatatcaatgattcatcaaagtgtggaaatatatgtgtatgcatgcatgcttacacaaattgaaggccaagcaattgacattccttcagcatgaacatcaccaatgtcttgcaatgcttcattggccttactagctcctcgttttcttgaagaggatgattaacaaccacttttgtgaattgattacctatctcaacaccacccactttctctcttggattactactcataaaagtagcatatgccacatgttctttgttaggatattttgcagtcatcaaaattactgtggtacctgcctacaatatgattgaataagaatcactagttagttgcataaacaagaatcgaactgtactatttgaccttcatcacagaagaatgcatcctgtttgaaaccatgggatgtgtagtcctgttcagaccatcctttttctctctactcttcatagtcttttgttatagatattgttatcggatgaagggatagtaacattgttatatatattgttatcggatgaagaaatgaccaaaataaaatttatagatattgatgagttatacaactttattgttgatgactttttcagttgaaatcatttagtacttgaaaatattgtctaaagttgtcactatttgaaattcaaattcaaattataaaaacaaagtcatatagcaaaatgatcaaaacaaaatttatagatattgatgagttatacaactttgttgttgatgactttttcatttgaaatcatttagtatttgaaaatgttgtttgaagttgtcataatttgaaattcaaattcaaattattcaaacaaagtcatacagcaaaatgacaaaaacaaaagttgttgatcttgataagttatacaattttattattgacaattttttcatttgaaatcatttactaccctaaaaaatatttgaattgagaggaaggaggcattatagacttctcggcgagggaggagcaaaagggctgggccggcggcccaaagagggaggaggggaaggggaagccggcccatggagggagagagaggctgcgggctgtgggctaatagtgtatactttataccttatactatggtattttgctgtaatttttttagaatatttgttatgcaaattatacgaagttatagaagaatatatttttctgttgagacttaacaattagacttcatataattgtgttttatgatgaattgtagactgttaagacttgagaattgaacttgacaaaagtttgaagctcagtttgaggggtttttgtattccgataaattttcgttaccgtatccgcgccggttcgttttcgcttcattttcggtttcgataatattcgtttccgttttcgtttctggggtttccgattccaattctgattccgaaaaaaatatggaaacgaaaacgataaaggttgttttcatccgtttccgtaccgttttcacccctagtgctatagtgattcgtgccaaaacatgccatgcgattcattgcaggcagtgggtgttcacatctcagtgaggcagaaaaaatacgattggttattggagatagccaaagacacttctctcgaagatccatttgaaatgtttgattgatgacttcatgttgttgtgagggagatgcgcgtattctgattgaatgtgccccttttttgtcatacaacttccttaatatagctgctgtaattgcatttgaacaaagttgttacctcttgtacctgggaacccaaactgctgctcccggtacacccgcttattggattttaacacggacttggaattagtatgcacactaactttgcatgcatctcatgaagtcattcactgcataattccatcccgtcaattttgttcttccgagctctctgtttcatctcgcctattgcttttttatatattgtgggacttctctcgcatgttgctgctccagagtatcttatataatgtgcggaggcgcgtgcgcagctgcgcgtaatagaaacgccccgtgtttctatccgttctgatttgagatcggttgcagtcccaactacaactaactgcacgttagaggtactgtacacaatctcatccattttttttttcattttttttcgatcgaaagtacagattagccttgctatattaattgtgcggtgaatgcctaaagaaaatgagccaaaaggaaatgatttacctaagtttgagtttattcgtgcatgaaatagtctatcaattttgtggaacagtaacatttactagggaatgtctttgcaaaagcagctaagcatattgtttgtttttcagacctacctacctagcgtctagcaggcgaaaccgcataacagaggttcacccgtatggccgtatgcccgtatcagcaccacacggctgtttaaccagacggattttgcatcgaccataatgaaaaggacacacagcagaagagaaaccaaagataaatatactcgtataacaatcgacttggcagcaatgccttagtcaattcggacgcagataatacacatcaaatgggaacaaagtttgttctgagcaagttcatacaaaaatgaatatcgactgccactataaaattcattccttggtgaaacagagataattggcagatatagcaaaacaaatattggtggtagtaatgttttgcatacagaacagaaatgctcacaacttcatccctgataagttcaacttaataatgatagtacagaatacattactcatgcaatattcagaacctaaacagcccaaagtcttgcatgtagataaattaattcactagattattaacagctagagtttcagacctctgtggtcaaaactcaaaaggatcactacgagataaatcagatgctctttggaagctccaactgccgccttcttcgagaagggcatgtgtcgagtacactacttgacaatttttactcgcaggttttacagaatccagagccttcaaaaccagcttattcttctccaaagttgtgcaacttgcattggtggaaataatatcaatcttttgcagcacctgcgccctctccatgacaaacttgatgaaggcaagctcactctgcttcccttggaactcatcgaaaaccatctttttaacatgtgacttgatacattcaatttcaccagctcccttccagaacatggccttgtgctccccagtggcattgttgagttcgtcagctttgtcagactgaaaattaaaccagtgcaaggcaatcatggatcatgtagttaaaaagcaatcagacaccgattacgactcaaatatcaagtggagcgagtgggttcaccttgaggtgcagcgtttcgacgttgggaaagcactggaggaaactgcacaacatctgggcttcgttgagggtaccaaagtacaccttcaatgctaagatccgcacgcttggaaccatggtacttggggttgctcttgttctagcctgcaacaaaatccaccaaaaacagttcatattttggcgaaactgtcagcagtgggaactaacaaaagagggtttgcaccttgatggtggtggtgccgatctgcagcaagtgtcgccctggctccaggtatcctagtgacctcaacccctgggcaaggccgatcttgatcctcgtcgagaattttctcccttccgtggcccaaatatcgctcagtaagagccgatcgaggcatggggcgtccacagctgcaaggtccgccacgcaggagaagccgagctgcacacaacgtaggctgtggctgacaaagcggaggcgcactacgttctggctgagaaccacagtgagtatctcaaggacagggctcctggagataatggattcgagatcgcggtcctccatgagtacacagcaaaggccaagctccagcaggtgcgggaaggcggtgctgcattgggggaggccagcggtgttggggaacctccatacgccgatgtagaggcgtcggaggtatgtgcagctgaagagcgtggccgggaggcgcaggttgatgggccagggacggttgacgaagacgagctcctcgacggctttggcggcgaggagctggagccagcggtcgagctccgggaggtgtgcctccatgatgctgcaggacaggtcgacgcggtggaagggtcccgggtgagcagcgaggacgcgcgagaccgcattggtgacggagatggggtgggtgttcttgttctctctcagccacgtgagtcgtgaccgattcggacggatagctagccggcccatatcaatcagtttcggttcctacctaaggattctgaatggatcatgtccatgatcttttttttttgttttgggattattaactgcagtttaatttggaaagagtaaatctaatgtccctcatcttatcatcgagttataaaattatccttaaactgaaaagctagatatatgacatccctcaacctaccaaattggatcacttaagatgtgtttggttggatggatgagatggccgcacgagttttcgtgcggtttggttggagggcagggtggatgggacggcccagaatagggaatattctctcaatatactggatgagtgcatccggtcgatttggctggatgaaaccattcagttttgttattctgattggctgtggttggtttgatttcctgttaagcaaggttcaaacgatttttttcgcctaaaccgtttatctaatttatgatttgattacaccattatttttgttataattaaatctttaaaataagatctcggatgattatattttgataaaaaaaatatatatgacaaatgggtcccactaacttttggcttttcccatccatgatatatcccttcaaccaaagaaaaaattggatcgccatatccatacaaaccaaacaaaaaattggatcgccatatccaacaaaatatggattgccatatcttgtccatgtatgaccgtgaatagagatggcaacgggtgcatacccatcgggttcctttgcctcatacccacacccgcaatgtctaaatattcccacttaaatacccacacccgtgcgggtaacgggtatccatacccatataattgacttgtagcatttatatagttttgtactttaactagctatattagagttgtaaaccatcgatattttctctagcaacaatgctattaacattagcgttcaaaggtgagtaaaaaattatacaaccgcattatataatcaagaaatcaaataaaaattttatataactagactagaacaatgcttaagatgtgaaaggagttttatgctatgatttagtagtcgttgagactcatattgctaatagttttaggttcaatcaacgggtttttttttcacccacgggttggtgggtacgggtgggtaaagaacggaccatacccatatacccaatgggtaggagtttttgctcattagtggacccatgagtataagagttagaacacgattagctcctaatagagtaaaaacccatcgggtctcgggttatgggtccccagtgccatctctaaccgtgaaccaaacagacccgtccttaggcagttttgttcaacgtgacagctgcgtcagtatgacacccatgtgaaccccgcatgtcaatagcctcttcccctcatcttctcctcttcccataaggaagtaggtggagaaagcaaggctagagggagtaggcagtggcgggtggcggggagaatagaggtaggccaccatcatcaaatccccatccttcctcctccaccgacatcgacgccttcatccacaccgtcgtcggttgctgccacccgtgccctatggtcggggcaatgggatcttgcagccacccctaaaatagaagctaggtgagtggtcgagagcggggatgtcgtgtggtggccaagctccggtcattgatgctccagtcgtggtcgatgccaactacggtggtggcgagaggttcttgcccgagggcgagagagagagaggagcatagagcagaggaggaggtgtggagcagtggatgcagctaggggtgggcacaaaatcaccgagccgaatcgtcggttttttcggggctcggttttctcttcggcttttactccgttgtagttcgatcgttggtatcttcgtcggttttacgtcttcaaatactgaactgtacgaatattccaaacaaaccgatcccaggccaaacaaaccgatcccaggccagtgcgggggcgtgggcgagcgcccagtggccagtcaaccttcccccttaactccctcgaggactcttaggccccgttcggtctccaaaactttgagagaaatttttttcattagaagaaagaaaattatttaaaaggtattaaagaaacaaaaggggcttaaattacaagatttgtaaccaatcaaggggcttagagagagaattttgttgcacgtaaaatgaaaaacctctttagcacataattaattaagtattaactattataaatttaaaaatagatttattctttttgttaaaataactttcatatataaacttttgtaaaaaaaaatacaccatttaacagtttgaaaagcatgctaatgaaaaaaagaggaagttgaagttgggagttgaagaatagaaaaggacatcaatctactatagcatttcattatctttaatatccgtacagttctttttttcctaacgagtcaagcacatctcgccacgagaataattacaatgcgtgtcagtatcagtatcacagcatgcagcaaaagccctggatttcacttgattaaccggacggacaagctaagtgccggcggaaaacattacgatgtcctcttactggcttctagcactattgatcctcaagtcttctgttgctacggcaagtattcgtacgtacaaccctccttgcgagcaagataattttcggctacaagatgatcgatcctcatttgtatgaggtcgtcatcgacctgcagcgaagaaaacttcgtcatcgacaaagaaaaatgaattaaaagaaaatccaaagatcaatctaattttgttctacacaagcagtttcgttctctaaaacgaccacatgtgcagactaaaaaaaaatgcaaataatggacatcttttcagaagttgcactacatatggccagaggacgtgcctaaaaaaaatgcgccagaaagcaattaaggaaaactgccacaagcattctttagtggaggatatactgtagtatgttagtaccttgaaataaggatcacacaacttcttgcattcctccacgagtttctcatgatccaatgtcttcctatccttcattatacgcacaattgcgcaatcgacattttgcttccggtacctcctgacatcttccatggtctcactggcacggaaatcacccctgtcaacatgatgaagcggtacctgcagcacacattacagtcacctcagagagagagagagagagagagaggcgctaacagaagttctggttacaaaaggatcacctttatctttcccgttttaacactgaagttattgttgaactcaaatatgtcgtctggagcaattgttttgttgctcggctccttttttaggatgctgtactttccacatgataaagaatacagcattacttttgcatcattgtccatgatttccaacttagccacaatgtcattataacttaatcgatcatcttcattgaatagcagcagcaatgcagcctggcaaaaatagatcaagggcataaaaaggtcatgcttagcccatgtgggcgtggctctgtgttcaaacttaagggatttgaactcacctgcattggtgagacaatcatctcaactgatttgccttcaaagtttccaacaatattgcaatttccaagggaatagatccaggtaagcgttctacccctcctatttcctgtcgcttgtccatgaaactcttgatagaacttctcgaaagcttcagcacaattgagctgagaaaaagaacatctcagatcttaccttattagaaatatggataaccaaaataactccataatgaactagaaaatggttaagagaggcaccatatcaggggggagcgataaatgctgtttttgttgagaaggaaaatgaccctgtttcagaaccattgtgtccatgtccaccagagtatttgattctgggttcatgctcatatagtctttgaagaatttttgtagttcttttgaaattgaataatcttctagcatatcttccaggattgagacgtccaagactagttttagctttgtgataaagcttgtctcgacctcaatgttgcaaccaatggatagtcttcctaagagcctgttcctgcaatacattttcagggggaaaatggattcctcaaacttcagttgtcttctaaggagtcaaacaaccatagctcccaagttaaagaagcaaccacaaacctgtacagctcaacaaggtaatccttactgtgcaggtacggtagaagcttaacgacctgaaaattcagtatccacattggcaaattgtttccgtaagcctagggatgtgagctttagaattgcaaaaacaagccagtagtagcatacctttgcaagggtatcttcaacagagtcatcgtctagcttgccacatgtacgttgttcaatgagtctctcaaggaatattatgaaaattccccatcactaaaatcagcaatgtttctgttgcagatcatcctaaagttctcatccagggcctgcacaaagacagaattccctagtaaccaacatcatactatcatgttttagcaagtaattacaatgatctaaggcaatgttcaaagtattgactatcgagtcattccaaccaagcaaaccttgcgaaacaaaatgtgattgtcaaaattattgatcacatgcgcttcgtatttttgaagaaccttcatgattctcaatacaaatacctaagatcaagatgctatgcattagtaatccccctaaagacgtgtgcaagcacccacacacatgaaangggggaggggaggggggaggggggagttccgtttaaaccaggattctacaaatgctgacctctacaattgaatttgatggttccttaccctgtggattgcacaaaacaaaataatatgttatttcattgcaaaaaagtggcgcatataaatcataataaactggtggctaacatgattgttgcatatattaagatagaagaattatgttaagtaaaacacaagctaagtagcgaactaactggcaaaactgtcactttggtatcaataaatgaaatagagagcctccctctgttttccaaaaacaaaacaactaacacgtaaaacaatcaagtaaattacttttatggtaatagcagtagcagaacaatgatatatgacaactcttacaaggagaacaagcaatatctcttaagtcatatttacctaggttagagtagaggtttatccaaactttaaaaagcttattttcataacatctagttcttttttatcttatccttttttttgtatgtccatcatgtacttttttttttagtaaatccatcgcgttagtatgtgccaataggtgtggaatcttgtgataattatgctctttagcagttagtctcaaagacggctaaacatgcaatacactgtttaacaaggtatagaaaagaatacaatatgcaaggatgtattaagtaagaaaacaaaacagaacataaaacaacatatggtaaggtccatgctctgtttcatacgataaaagcaatctgtgttatcatataggtgctcccacttcatattaaacacatttaaagaatttgaaattaatttttcgccggacaaatttgaaattaaataataaggggaaagtttcaacttacaagaaaaatatcatagatcagtcagtgggttatcaagataggattgatgattatgttacacacaactgaaatcttcacaattattttacacgtcaagctattgaaatttggatgttcagaacaccaatacaaggaacatgaaactagcaacagaaatcatccatcacggaaaaggccacatgaagttgaaacaagaatggatatgaagtacaatgtgcgagcacaagatgcatcaccttttccatgtgtgcagcaccaactgcctgttgcaggatgtccctaatatgctgcagtgtacaaaagtaacatattaaggtcactgatcttgacaaagaaatatatatcattagcataatgtgaagtatagcttacttgctggaaggctatggccatgacaataaaccaccagaaatcctggagaaaactctgaacatcaagttcagttcgttaccctgtagtaagaaagacatattcatttaaactgattctacatatttgctcatatagtaaggctttggtctctttctatcaaacctttccatcatctagcagatcattttctgccgcaaggatacctctaaaacctgatttatcatcatcaagtagccattcagcttgcctggatactaattccaggagtactgtctgtaagtattcaatgtaacgggttggaagttaaattccaactgagcaggcaatgaatgcgtacatgataaaacaggcttgtgaagaaaacaagctaacaaatgcacagaagaaatgggaaaataaataaacctatcacaaacctttgacagtcttgcctcagtccatggcttcaaataattctggatcctttcctcttcctcttgtatagattttatcacctgcagaacataaaactcatgacaaagaataagtggtatgctagattacagagaatattgcaaggacttaacgtagataccttgaccaaatatttagaacaagaaccacgggacacccaagcttgggcctttcttcagtaatgttctgctgtgtttttgaggaacacttcttcgaaaccttcataaacatccattccattaccacctctaccaagttcagcttagacactgagagtcatcttgatcaaattgcaatccataaccttccctgccctgtcctcctcaatctggtaaatcaatgcaccagcaccattgtaacatccttttatgcatcttggacaatcggtcagaaaacgaaacaagcaggaggaagatattaccatttcgatgatgatttgtcattttcttatttaactcttcgaaaacctacaaccaagggcagtaggcagcatgggtttagctgaaatcttttgcacagcagaatacacgtgtaaacttcagaatatgcttcttaccacgttcttgaacaaattcagagcaatatccattataggtggaagtgacctctgattagtgaatgccaatcgcaagtacatgcagacggatttgagccatttcatcaacaccttgtggttttcccagtgatgaacgaagttctttaaaaggggctctccctgcatatcctggagggacggtagcacctgcatgatcaggtaacaaagacacgaacataaagatatcaacagcgagcgttctctcacacaggtattagctaagggcaactgcaggatgcatcaaacacaagctaagcaggttgggaacagattaacagatatcgatcgatgcaactgagaatacttcacacattgattaggtgcgcagaataaaaattgatgataatcgcgggggcagggggaaccggaaaaggcggcacatacctgataaacgatgtgatgcctgattgtcttatcccaccgatcatacatctccgcggcgtgaccggcaggactctcgtaacacagtttatatgtgatcctacgccgcggaagacgccccatgtcaatgtgtgttagattaaaccccaaagagaacagaaaaaagcaaaaggaagtcgagaagaacagcgttccatactggagaagctcactgtactcggcacccgagaaggatagcctttcctccccgtcgagaatgcgcaacagtttctggaacccggccgctagccggcgccagccgtcctcgatgtccatcggaggcggccgcgctatcgccgtccttgtcattgatccgagagaatgaaacctaggcagccgcgaaggaggggagagtgtcgtgggattggggatttgggcttggggattgtgtcaatatggggtaaaggagagttgtaaaattggaacttggaactggagatggtgcttgatattgctcgtgcacagcgagtgactgaacaaagccagctgtctagagcaaactcaccgctttcgtgggctgaatgcgcggacaaatcactcacgggcccgaatccccacatctcgggctgtggtcggaaactcggaatctgaggacttgtgcacttttcttaactcgccgttacaacttcgtttttcattcgcatattatttaaattattaaatgatgttttctttaattttactatatattttagatctattttaaaattttataataattaacacttaattattgggactctctgtatagcgaatccctaattattaatgtgctagtattttactttattctacgtgcaactaaaaagttaaatctaagtcggagattccaacagatcgcccaatacgtcaactgatgaacattgatgtatgaaatactaatgggctatatctgtaggctgtagccaaacattctttttgtgccccaagggttctagggctgttctcgatcgaagaacttgtagaaattaattattagtagtactatctcaatttcatattataattactccctccgtttcacaatgtaaatcatttaatctagacatatatatatatctatctagatttattaacatcaatatgaatctagaaaatactagaatgatttatattgtgaaacggataaagtagttttgacttttcttaagtcaaacttttttttagatttgatcaaatttataaaaaaaatatagcaatatttttagaaaaaaatatgttcaatattaaatgtaatgaaactaatttggtgctataactgtttttatatttttctataataaatttgattaaactttgaagtagtttgacttaaaaaaagtcgaaacaaagtacaaatttcaacgaccgagatcatcaattacgccggataaccctattgccttcatggtatttctctgagactatgacctcgtttagggaaagctgaagataagaagtttctccatggctccgttctaagaagcagctgatgaatagagccagttggtgacaatccaaacatctggaaacagctgatgagtatctaaaaatctaggtttcaattagctagtgctaatctcactgtctgcatcatatagcaatgcggctgacagagtgagaatctaccttatcaaagagggctagagattatgagtgtcaaaagctttctaaacagttcctatgcagctatgcttctttcccatacttcaaattctagtcaaatagacctttccaacttcaaaaaatctaaattcatccaaggcaagaggggaaaccaaacaaaatcctacccaaaagtaaaatcgaaaatactagaagaggacagtgaccctttatggaaactccgtgcattgctatgaaaagttacgtgaaaaatggtaggataaggtagataaacatgagcggcaatgtagatttgctttgtacctcctaggcatttgacaagagaattcttgacaaaccaaaccacaagtatggatcatggcacattatctcccaactagaaaatgagaaaagtacaggagcggtctaaattttgttcaaaaagtaactgtcaagtcatcatgacaggtgatgggactaactgtaaaaaaaacaataatatggtcttagtaggcattaaaacaacagatcagtttttttagatattgaaacaacagatcagttagcttggcacaaataacatattgtgttgttccttttctgaagttcgtcaacaagtccagcatcctcttcccagtgtccaaaatgcttatccaattgcactttcaagctccaaatgtagacagcttttgacatatcctgcaaagcacaaaataggttttatatttcgagacagtacagctgtttgacagtccatgtaaaaagtatgtggcaaaatatttcagaagccgcaaatatgtggcaaaatatttcagaagccgcaaataacttgtgattcatgtccacaaagtacgtaacactgatcgatcacacacaaatagcaatccgcaccaatcaaatattcaaattacatggcatacaacaattgatcaactaatctaacattgtctgtgaaggctgaacaactacccaaaccacacaatcatacacacccttgccccaatttcatctcctgcccccaaagccaaaattaggtaaatgcgtagtcagaatagattcaatgactggtgtttaatcaagattttatctgactgcaattatttaagagtccacctctatcaccctctcccctggcccggtctaggtgtttgggtctggttctaactatgcttctaatgagtctggccatccgtccctcccttcctagtcagaattggttcgatggctcatgtttaatcaagatttcatctcactgcaattgcttaagagtccacctgctatctccctttcccctggcccggtctaggtgctttgatctggtttttgtaactatgcttctaatgagtcccaaatcctaatcgagcagtgataaaaggaaagctaaacataactattagctattttcactaaacaaaatcatggaataaataatagtcatacagcaaatgacaatatggacgttggcttcaatcaacaaagcagttagcaagtatcgcaaaaatgagaagagaaattctgcataaaagtcattggttagggttacataaattagaatgatgatattcatgctgagcacatccacttgagctgagtaaatcgaatgtgcaaatctagaattcgtgcagaaatcctaagcttgacctaaaaaaataattgctaggcaactgaaaagtataacaagccatgccttattgaacattcaacattgaaaaaagcaaaacaagcaccacatcatggtccagccaacactgaaatataagttacctcatggtttagatgctaagtgatcggcgtttagggcttcttgtagagtccatgaagactcagggcatgcacaaaagttcaactcaactgtggcaccgagcatggctgcttgtaaggaagagtgtgacttgttgattactaaatcactgatctcacggtcatagaatatcgtcattttttgcagggaagggagcctctgcaataacacggatgctaagcataactcatggtcagaacctttaaaagcctcatatacaaccatcatgatcttacgatcttctattggctcaaacaagtcaataatgcgatcttctgttagatctatagtgacattgtccagtttagtactctgcaaatcaagaggcacgtgtcatttaactcaggcatgatggtaccaagcaagtaaaaaaatatgttatacctgtatgtataggttctccacagatggaaagtatttcaatagacgccgcatggtgtgaaactcattatcatgcccaaacccaagttgaactcccaaagtcctaacagacttgcaagattgcccttcactcaatagtggcacatgggagttcaggtcaatgtaacctaaaacttcaagatccatatcgatttctgagttcatagataacaccatggttcgatggtcgccaggatcagggtgctcatcatggggctgaggctcagaagtgccaacattatgcaatatgagtctgcatagttttggggccacaattctaacactgtctcttgcagaataattccagagcaccatcctcttgaggctattagactcaaagtgaatcttggtagaaaactcgagaaaagccagagataacctttcgagctttgggcactgtgcaaccatcttcatcagtgtatcatggtggaactcacaattgacaatccccaattccgcgagattcggcaaatggaaatcaatggttccagaggggtccttgaacctgatttgacataaatacagggtctcgagcctccaccacttaagaatgttttctggcacaaataaaagtttagccgttggctgagctctattgagaaagatgaacttggtcaccttcttcgagttaaagagattaaaccaagacatcagaataataaatgcagactcatcatcgtctgtacagaagagaaaattagaagaatataagtgcatgatactttaagcagcgactcatctttaacaagcaaattgatgcaaaacgaccaaagcttcaagaataattacctatgcaatgtaattcctgcaccccaaatggctgaaagcacaagttggtgagcctcaccgtagggaaaggcccatcttgtgtggaaaggactgacccaaccctctcaatgagatccacttgctcgccattctgggggagcagctgttcgtcgtcaatttccataacggtggatagccaaaattcgctggcgaataagggacctaactcccgcaccatctttaccgggagatgactgagaacgtccctcatcaccggggtaccacggatatttgcagcgactggagacgagcgtgtggcaccggcataattgaggttggtgacggcggcgggggcggggtcggagacgacggccatctccatggttttcctgcgggcgagcatcttgcggtgggtgatggtggtcgccggcggcggcgggaggcaggagattagctcctcgagctgcaccatgcttacgagtttttcgatcctctctctcgaagaagcaacgtggatacgagtataggattagctttgccggcggcgggctagggaggcagcggcgaccggtaggggaggggacggtggaggcgggacagtgaggagtgaggagtgaggactgaggggggacttgggcctagggttgtgacttgtccgtgcggatcgacggcctttacgggattttcttttcgtccttccatgtcatatagcccatgaacaagcagaccggcccaagtcactgttctgaagccctgtctacaacgaataagttcactgtgagtccctcatctttgacgacgagtttaaatccatcctaaaccgtaacaccagcagacttgagtcttgaccccttaacatgcaaaattaggttaaattagttcctttaaaagtgtagatggatggttttgctaatatggtaagtttatccggggccactcgtgctgactagacgtttacgtgacaagaacaaaaataaaccccacatgtcatacagtcatactcactcccctccactcttttatctccctactctctctccccctcctctcagtcttcttcctcatctctctccgtgtctcccctctcttctcatctctctcctgcctgacaaaagcgaagggaggcggtgtatggcagcgtcacattattattattattattattattattattattattattattattattattattattattattattattattattattattattattattattattattattattattattattattattattatgctgaaaatgatgccacatccgctaaaacagccgcccatattaccaaaggacctaatttagatggtttttccaagatgagaggcgaatatttctatattgcggtttaaggatacaaaattaaactagacataaatataagggaactgcaagtgaacttattctaactggagtatgaaacaaagaggcccagcacaagcatatgacggcccaattcctattggcccagtaggcctcatcacacccttagcgcagaggaataagttcaccggatgtccctcaatttaacagcgagattttttaatatcatttacccctaaactctcacacaccgttcaccggaggtccctcggcactcggcagtatttttgcccaattttgttgacgtggcatcctagtcagcaaaaaaaattaaaagaaaatatgtggggcccacatgtcagctgcacttttttttttctctattttcttctcctttctcctcttttctccgcgtcgggctggccggacagtatccagaagaatcaggtcaacgccgacgacgggcgagcgcgggggcggagcggcgccgggctgcaggcgaagcggaggcgggcatcgaagtagagcgtgggcgagtggacgcgggagagcgacgtggtgttgacggcgccgggctgcgggcggagcgcggcgggcgagagcggcgatgggcgggcggcgggcgagctccaggtcgctccgtgcgcgccgcatcaccaggggcgcgacgactgttgggtgtgggcggccgccctcctccggctttgccccctactccccgcacatctccacctcctgccggaggcaggcgggcgcggactgggcggcgatgacgacgactcgcctcctcctctccccatctcccgccggcctcctctcccacttctcccgccggtgcggtcggccggctcccccccccccctctcccgcgggcgcgctacaggttgacggagacatcggcgatggcccatagcccctgctcaatgctatgagctttggaga

SEQ ID NO: 59338 - DNA, 52148 bp, Oryza sativa
  unsure (1)..(52148): unsure at all n locations
ccatcttctgcattataaaatagaataaagctgccagttgagcctgaaaggttgaaagcagcatgagcagggaagctcataccccggaattcaaattttggggcacgtttataattcaaatccaaagacgaattggactcctataccatatatctcccgcgtgctgtatcctgtatcccccttgcgtgcaccggaaatagctaaatcgatatgcgccgcgcgaaaaatcgttggcttggacgcgaaagcgaaaccttggagcatcttggaaggaaccaaaggagccaaactcacactcttcaccagccgtgcgggacactataatttctacccctcgccgagtcgccgtataaaacacccaaactccccgccgatgtctcaccggaaagccggcggcgacacatgtcggtcggcgagaaagcggccggcgacggccagccgaagccgccgtcgcgcagcgcgcggttcgaccgcctcttgtccgggctgggcggcgggccgctcgtggacatcgagcccgacaaggtgaagggcgagctccggcggtgggccagggcggtggcgacgatggtgcgccagctgagcttcggcgcctggccggagaagggcggcggctcgtcggagcagcaggaggcgggcgacggcggatcgcctggctgagccgccgatggcgttgcttcacttcacacgcgtcaatacggaaaaggaagcactggtgcggttggcaacagttgtgacaagcagcagatgatgcacattccagttgattcgttacattgattacatttattcgttcaagcgacaggcgacggaggctgtagtatgtatctccaaatctcttctccattctgccagacataacaaatttgggttgcataaatcatggcagtcatgtgaatagaaataaacacgtgcatcgcaattctcatgtaagttgatcgaattattgtattccaaacaaaaagactctgcgcacaccttcattgaatttacctacgtatcaccatgcctgattctttctgtgctctaatctttgttagtgaaatctattctaatttcagataatacacagcacatacatggggggatacatccccagttcaactcaacaaatatatatagttagaaggaaaggaacacccttgcattcttacattgatgttgcagtcttgcaggaccttataaattatatagcgacatctacatttaccaattggaacagttagtggttgcacgatgttacctacctacaatttgtacgtgctcgcacaagacacatttgtgcactatcctaatctacaaaactactgccgccttatataaaacctggatacctcactccaatttcgcatccagttttgcaatgcttctcaggagttgtttggagcagacattctgcgcctgagctacatatcgcccacgatttgctttcacccatgcaggttcctatttgacaaattaagtcaagaaaccacatttaggtgctttagctatatagagatcagtaaaaacacaaagataacacataaagaatagaaaatcacctcgggaacaaagtgtgagaaaccaaacttgattaagaagagagcatgctccattatgaggatggctgccagtcctggctcaattttccatttaccctcctcatcatacagacaaacaagaagcaagcagtttgtacagattgccataacaaccaagaactgaaaagaatttttcacattgagtattacaaggcatgagacatgcaagtatatctatgaggaatatatattaaaaaaactgctaatgaacctggaatatgttcagccaagctccaatcgtagctgcatcacggggagcaggtcttttcaacatgaccaacaacttcaatgcatccgctctaatttcagtcacattattctgtcatgaaaataatttaagataagtttagcacacacaaatcaaacaagaacacacatgtatggcatgcgctcgacaagagggaaggacacaagaagagagagaacacaaatagctgtgatgaaccacataccagagcagcaaagcagaatatcgacggaaatgcacaagcaaacatcatgatcatcccaaactgaagagttagctcaagaaaatctgtgatggactcaacaatgtaagaacataacacagacatccaaaagaactgagaatagacaggatgattatttattgctgttaccatcaaataaaccatcttcaagttcttctccaatgcttgcagtatacgagggttttagatattctttctctactcttgtagataaccgaactgacttcccagctggcgattctttctcatgttttttcttgctacaagatggaagagatttcttacatctctgaattggtctggaaaaagaatagtaggacaaacagatttggctgcagaacttactgaacagctctatactttttatagctataattgaggtaaggaatggaattctcaatcagattttccaatacctgcaagttaatatgtatcatcaaaggaagactagcatttatgattataactaatgatggaataattacaatgcagacatgcctgggacacaatgagacgcttgattaggacttgccggagtgccataatgttgcggtgcagtgaagcatggtaaaacaatccaatatatgattgcataaagtaaagaccaaagacctgcatttgccaaaagagtaagaaacctaacataaagcgtgaaccatattcttggcatcattgtgtttaccttataaaccaaactatcagcactagactgttccccttggttgttttcatactttattagagtgacagacaccttgccacctatccttgtgtaatactgaattgcagcaagatacactgcagttaacacatacctgcataaacatcagcaataagaactgatgcttcatattttagtggtaaccataaacaacaaaataaaacataaggaatagatataaaacaattaggagaaaataagcttcaggtcaattgcacatcgttgataactcaagaatcatgaatagatcatagtgatattcctacaatcttaccttagcgcctcagtttttgtaatcgcatatagatgagcataggccaactcaaatggcagctgaagacaaatgatagccaaaacaatgatagcattattcctaattctaaggagaacaccaaaccactcatttctttgtactatacttttctccttgggagcaccaaatttcctnnnnnnnnnnnnnnnnnnnnnnntagaaaagcttaaagggtccagttcattgcccatagttttgtattccgaaaatgaataatttataccccatctgttgaaaacatcacataaaagaaaggcatgtttgtgagcacggtcttgaatatgtttcaaaggaacttaattgacttagatatatacagattgcatagaaaattgcatgctacctagcaaggacagctgaattcttccgtttccaaaattgcaaaaagaagacagcccaagaaataacgaagaaaaagaaagctggaagaaccaaccactgtaatgacctgaattcagacagcagagaaaaacatttagctgacgacaacaataaaatcccaatgatattttctagatgagaggtgcatacccaaaatctatcagctgggttgcaagtccaaaaacagctggaaagaacagccaacgtgtatacattccgaggaaagaaaaatatattgcaatctgcaattccagaattaaattttatggagtagaataaggtgatacttgatttgcttcagatagaatagttcataaattaaatatggtaggtgtaacatgtgcaatcacgctggtctacctttgttccaaagtaagagtaaatttcatcaataggttgccatgtgaaatcaaaccacttgagtgcccagcttctcaggagttgcttccttttaatttcatctgcagcaaaacagttggttatctaatactaagaatttcaaaaataattcaggttggtttaccatgcaaagggaagactagctttacgattccttcatcttccagcctggttaagagtgactcattttgagtccagtggaactctttatcgtcaaagctgagagttatatcagaatcggtcttgttcacctgcaagtctccatatctacctactgtcaaataaggaaatatgaagcacaacaagactaatcactttgtacattagctatatgttttattcatatctcatgtcaagcgaaaagaaaaactttgagacttgagagaataaccatagtataagcagaaatatactaaaccactttcctatttgcacttggcttgtttcttaaatgcaaatataatagacaggtcatctgatgcataatgaactatacttaaatctttgaatcagcagtgctgcaaaaaaaaaatcaattttgcaaaagccaggcaggacatacatgccatccgtgaaataccggtactaacaacgaagcagtgctggtctagaaaaatgccaacttagtgtggaatctccaaacataaataactataactacaatgtgccgaagtgggtaacaggaacaaaagcaactacaatgggagacaactgtgcacttacgatgctgtatatcaagtgccggaagcaggcaaaccgctctcgccagctaaacagggacccgtcgggctgcctgacgaatgctccaacctggtcccattcaaactgcagttccattcctgacaagcagagaaataaaccatgaacacatcatcaaatcacccattctgaaatactcacaggtggattagatcagttaccgatataagttagcttcttcatgttcatctccgctgcaactctccccagggtccccatgggcgcagacagctgaattcaaaatgcaaatccacaaacattacaacaagctcatggtttctcgccacatgattatagcgaagtgtagtgctccctttcccctaatcgcctcctcgtctcagaaattcaaaatcaggccaccgtgccaaacggcggaattcaaaatataataataaaagaaaaaaaaacaccggaccttgatgaactccgcggggacgccgcggacgcgctcgacgatcagccctacgtcctccagctcccgcaccagccgcgccacgcagttctcgacctcgccgcacccggccgcagcgccgcggtagagcttgggcacgacgatcccgacctcgaaccccgtcgcctcatccacggccgcgccctgcccctcgcccgctcccccttccctcatcctccacaacgacgacggatcagacgcggggaatggcggtggatgcaagggagcggatccgcatagggggaaagggaaatgcggcgagcgatggaaggaaaatttttttgcggtctttgggaaatgagaatggagtgagacgaggccaaaggacgcgagggtaggaagagcagtttctattgtaagtatagtaattaattagacttactattttgattagcacttaattaacctattgttagctgttgccaccgatgcctgtgggcgtagttaaactggcgatttgggaggaaaacgaggattaaatcgggaggtaatagcgattttgaaagctgtggtggctgagcggccagcaggtgcgcctagccgcctaggagtcctgggctttccacccgtagagtattttgacaggtgggcccacgagccaacggtccacgtgacgcgagagcaccgaacgaggcgtgggtagctgccacgagggacaacaggttcacgtttcgacaaaagagcgcgagctacgaattacccctgcggctgacactgggccacgggtgatggctttcgccgtcgtgccgatttgggtcacgacgtatgtctggttgatcgctggttcggataatgtgttcgacgtgaaatgtttcttccaacgctaatcttctcgtgatgacaagattaaggtttttgttagtgtgtaatttgctgcttgctggtgactaccgcgcagtagttcgatttattagttacgaatcaatcactgtttattccgcagaaaaaggaatcgttttgtctgcttatttgtagcaccactcgaacggcttcctcttctgctgcagctgatgcgctcccgagctgctgccgccgttcccgtagacgaaagaccggtacgccatggcgccgcgctcctggaccacgtcgcagagcgtctccgggcgcagcgccgcgacgtgcaggccgacggcgtcgaggtgccaccacccgctcctcccgctgaacccgaccaccacgccgccctccatcgggtactcgaacggcaccccgtcccccgacgcgtccccgaacggcccgtgcaccgcccccgtgctcgtccggaacgtcagcgaccgaaccaccgtcgatccgccgtgcgccaccgggccgcaccggccgccgacgccggtcaggaactcgtacgggtagtccagcttcacctgcatcgatcagagagagagggagagattcagagagatgcacattttttttggtagatgagctgacttgcaccggagcacgcacgcacgcacgcacctcggcagtgcggcttgttctgccgtcgccgccgccgccgtgcttctcgccgtggacagggtggccgttcctgtcgtactccaccctcatcgactcgaggaaccgcccgtacgtcagggcgatgctccggacgccgcggtgcgcgccgtcgtcccacgggctcccggcggtgcctccccacggcccgaccttgatggccttgctcgaagcaaccatcctcctctgctggtaatgacccggttgctgaaagagcaagaaaaaaaactgtgttcagctgcgttcgtcgtcagaaatgttcagcacgatcgagaattcgagaccacgacagttgatgtgccttaccatgtccattagactgacttgcttgtcacctgaaattcggagaagaacaggaagcacctggataagtggttgtatcctagtaggagtgtactatttttcgttaacaagtaggagagtgcacttatatagaactgaaatactcacttttgtaagaggtaagtggagagtacaaagaattagataccggatagcacaagctagaccatgatgttcttttaattttgtgcttcacctggggcaacaagaaaccttagcacataataatgtactttaatctgtgcttcatctgggtcctgggacagcaagaaacttagcattgtttatttgaaagaacctcagcattgttgctaatcacttttttttttgaatttttgctgctaatcactttgagtgttctcgggtcttagataaagcaggtatggctggagcgggcgaataagatgctgagcgattgtgattgggttctggcatattaggtggggaagaatcaaatgattggcgtatacttcctccgtcccaaaaaaaaaagtcaaaccatgattttccgtgtctaactttaactgcccgtcttatatgaaatttttttataattcgtattttcattgttgttagaggataaaacatgattaatattttatgcgtgacttttttttaaatttttttcataattttttcaaataagatggacggtcaaacgttgtacacgagtttttttttgggatggagggagtatgtacctggaattttctcgttcccaaaaactttttctggtctgaacttaggactgatcagtttgtccggtatcactccccgtatctgctatggattaatttatctgaatttgcaagcataagttcttttgttctgtgttcaataatataagcagcgtcgtagactgactgacgagctgatgaggaatcagaaactcttgtcgtatctgttgctttgtgcttattgctactgaaccaacattctggggaatattagctagtagctacggtacagattttcgcggttaacaaacactttcaggacagggccacaagaacatagaaactcttttaaaactctttgaagtattcgggtggatgttcatatgtttcttccatgtcaactaaataattaaaaaaaaaataaaaaaagatacattaatatgtaatatatcacttaacatgcatgttcaaaattaacttctaaaggttcgaaaaaataacaaatttagctataaatatactacctgtaacaaataatatgtaatatactagttggagtttattttgttatttttgttacaactcgtgcaaggtggattttaacttgcttgtttgtaaagtgatatattaatctatcttataaaaaatatttttttcataacaatttagtttgcagggaaaaaggtacatatggtgaaatttagaatccatctcccaggtggacgtccacaagaacagtccaattggaaacacaacagaaggcgaatgataatgctatgcacaccgcacagctcacctgcttatataattcagatatccagtagtggtagtttacactttacaaccgagcaacccccaaggctcccaatgcgtcgcaatcttcctgtcattaggcatgaatcggctcatttccaatagcaaatttatcagactagctgacactctagcagctatatgttttccactgtttcttcgctgagtaatcatggacacccaatcagcttcttgttcacgctgtcaaagtctcaaatgctatattttcaggaatgcgggacactccaacgcatatccactgttagctggggccttgtgccgtgctctaaagattcttggacacctcttattatggtgtatccggacagcagcttaactttgctcctacgtcaattatcagtagctcagggtcaggtgaactatctgtctatttgtgcttactagctttgactgaacggatcaggacatggcagctgttcttttcttttctctagcctgttgcttcagccttaacgtcttagcttgcactctgcagaatgagatgaaaccaacaactcaactctttgtgacttgtgagttgtgaactgttccgttcacgtcgggttcacctgcgatcttcggttgagcgcaggtcaagctgttcctgaacacgcctgcctgatcttgcggtctgacgagcaattcacgagggaaagaaaacttcgttcggacaggcggctggacgatgagtgaaacgaaacaggggatcaatcaaacgaaacggcgccaaaccatgcaaggcatgagggcgacggccgccccgccccaccggagcagccatcattggggaggggggggggggggggagcaccgaacgctttgcgcgcgcgcggcggcaacgatcgatcgcatgtggtgtgcggccccactctcgtcgccttcgaatgagttggctcaatcgaatgatcgaatcaaggttcatatactgttgctcgaaatccgtctttgagaacctaaatctcttcgtttcaatttcttgatgccatcgccgtgtatttgtcactcgcagcagtgcaatgttaaattcgggaatgagtactacggagtttcattccgttagccatcacctgcaaaaagccaagaacacgtaattcttgtaaacactaaaccaagaacaccggtcgttttgctcgtgagctgtctcggggtaggcaggccaggcagacagactgtgaaaccaagacctcttcagttataacagcgcgctctcctgcgcctcatcacacacacacacacacacacacacacacaccccacgcattcaagcagccctggtgttgtacagatcatccgaggcgacgtttctcgattcgatcatggccaccaagatgttccgcgccgccgtcgtcgtcgtcgctgccgcggtgtcttgcctcgccggggttgctctggctgccgatgggcccgcgccgagcccgacgtccggcgccgccgccgtctcgtcctcggtcgtcgccgccgttctctgcccggccgtggcgctcctcttcgccaacctgcgctactgagttggttgaggtcgtcgcagcgcgcgcgtgtccatgaggctggctccatgaacgactctgttcttctctgcttgatcactcgcctagtgtgccttctttacccccctggttcttacctgtacttagcttcttccttccggtgcgctagattaaccgttcttgccttcttgtgatacgcatctatgtgtattgattcagatcatttcataccatcatttggaactatttattaattgctccgttatatgccggcctgtgaaattaatcgtcgtggttttgtttcccgacggatatgattcaataacctgctacgaatatcacggattctagacgaatattgtggattatacggaggatgaactcatgaacaccaggcgattttcgctgtaactatcgtgtgtttctccagttctgtttcatttccaattttgttttcttttggctgttgtcactgggtgcaagaccgtcaatttgtaaacatttggttcactgatcgcctgaactcttcttctcagataatttctgcgtgcgtgcagcttatcagctttacaatttgcaccgcgctgggccgctggcgccgcatcgaacatgcaatcgcccattctacattcctacctaggttttcgtcagaatgccaaggtcgagcccagaattccttacagtgtaatcgtcgatgacaaaatccgccgcggatacctaacctcgaccatcttgagctccgcgaaccgccgtgcgcgtgggctgaacagagacgccgccggcgccgtggcgactcgacgtcgccaagtcggatgcaaggcagatgcagcgactggacgaaactagagttcctcgtgagggtgcgagccgccctcgcgccggcgttcgtccaggtacctcatggcgaggctggcgtgcaacgccgcgccgtacgggagcgcggcgtcgtcgacgcggaagtgcggcgagtgcgcgaggtgcaccagcccctccgcctcgttgcgcaccccgacgaagtagaagtgggacgccggcacggcctcggagaagacggcgaagtcctcgctccccatgcacggctccatcgcgccgaggaccgcggccgaggcgccgagcgtctccgccgcgacggcctggaagtgcgcgtgcagcgccgcgctgttgatggtcgggggcagcagcggcctgccccccgcgtggaagtccaccgccgcggcgcaccggtacaccgccgactgcgccacgatcacctcctcgatccgccgcttcagccgcaagaagccctcgttcgagaacacccggaacgtgccgccgatcgtgatcgactccgggatcacgttgagcgcgtcgccggcgaggaacctcgtcaccgtcaccacctgggcctccagcgggtcggcctcccgcgagacgaggccctgcagggcgaggacgacggtggaagcggccaagatggggtcgacgctggcgtgggggtgtgcggcgtggccgcccttcccggtgatcaccgcctcgaagaagccgcagccggcgagcagcgggccgggccgcgatcccaccacgccggtggggagctccacgctgacgtggaacccgaagatggcctccacgttgtccacggcgccggcttccaccatcctcctggccccggtgcccacctcctcccccggctggaagaggaggaccaccgtaccctgcaaaagaagaccagactttgcttaggctgtattgggggatgcagtcaagcaacaatattgcgagttagtacttagtactccctccgttcgttttctaagatatgacgccatttactttttctcacatatttaactattcatcttatttaaaaattttatacaaatatataatatataaatcacacttaaagtactatgggtgataaaacaactcataacaaaataaattataattacataaatttttttaataagacgaatggtcaaacatgtgagaaaaaatcaacgacgccatctattaaaaaacggagagagtacatgattaattaagtactccctccgtactcgtaaagaaaatcgttttggatagcgacacggtctccaaaacacaattttgacttcttgtttctataaaaatatttattgaaaagtgatatatgtatacttttatgaaaatatttttcaagacaaatctattcatgtaatttctacattttcaaactcaacaacatgagagttattcgtgatttatattcccaaggtttgatttacacattgtcctaaatgaattcatttataagtacggaaggagtattagcttaaaaaattttaaaaatagattaatattattttctaaagtaattaactaggtggcgcggctagcacccatacaaaattatctattttttaatataatttatttaaaaattgttaaatagctctttttttgtcttaagactttgaaagactaaaacttatcatctatgtgtttctaattttttagtttttaaaagttatatgtatttgctaccccttattttttgtcacattttttatttgcttgttcgatctatcactgtttctattcattttcctcagatcctttcaaaattagaccttacaaattttagagtttattgtctcgttgggtttcgtttttataatttttaggtgtcccgtcaaacattgccattatacttatctattacccgtccgttgtcttctctctttattgtcattgtgattttaaaaattgattttttttaactttcgaagacccgccaaaccatcggtagcatttccattgtactcctctacggctgtccgctgcctcccctctttattttcattgagatttcaaaatcgaacatgattatcattaggggtttatttttttctctctagaagtcccatcaaccgtcgtaactgctgcttaacagcctgtctgtcatcccaattttaatcatcattgagattctatttgaggttttgtttataactattagatggctcaaaaacagtcaccactctactcttctcttctctttattgtcatttatcatcattgtgttctaaatgtttttttaaaaaaattccatatttcttgttttgatattttttatttttaaattatattcatactttaacttttataatattttttctatttttagaatttattttatttgttataccaaattttagttaatcttgtcaagtgttctagatggtctcttctttcaataatctctactttttattacgaattttagttatttataaattgtattcctagttgaactcttatttttatttttataatttcagaattaattttgttttttatttcgaattttaattaatcttttattgtgttctatatggtctatccttttaatattccttattttgttattttcaatttcaattgttttaaaattgtattcgtacttaaactctcttttttatttttcaaattttggattttatttcaaataaacataaaatggattaatgtgattttaaaatcaacttacctaaatttttattttaaaaaacacaccgtttaatattttagaaagtgtgctttaactttgacagccgctgcgtcactcataataagtgtaccaatatatatagcaaaccgttgtctaccatattcagaaagtatattaaacacataccgctgatgctttcagctgcaaaatagagtactgaacaatatgaaactgacatcaccataggtgttcgcccgcaagaacaagcctctaggaaaatttacgacggttcgcctgtccttgtttggattctcctccaattcactgtctctcaggtcaggtgttgcttcaatgcatagcatcagaagggacataaattatcaaattgaagtcaaattattttttgttttttttgaaaaaaaaagaggcaaacttgaagtgcagtaactgattttggaaacgcctattgcccgaagaaaaaagtacgcatgctgctcctagattccatttggccgggataagcactctccacttctccagaagaggactcgatccgtccgcaagaaacaaagctttgtgacttgctgcaatttcatccacaggatgtcaggaacgacttcgctgacagacattactcgggctgaatacgttgacagagacgcccggcgtatcccgtcgaaaatcttgtttgatgttcacagggtgtattcactacgtagtactccagaactcaatttcagcgacgcttacgtatgatgtcaaactatccaacatgtctgcaatcgttccaataaaatctgaccattttaattcagtacaataatgctaaatatgtttcatattaaatcgttgtccccgtttactcacggggataaatttaggaaacgtttttaccccccatcgtccactaacgtctttttctaggaaccatgtgtcgttgacagaacaaagttacaaatctgataatgctaatcattttaattagttggttagggtcgcagttgaaaagcaaaatctcagcacgattttttcttttgagagaaaagaaatcgaagcaaagaaaagggaaatagagatatgattaaaatgaattataacaggctgatgtcgttgcttcaactgtgaacaagaaatatttgaagaatctgttgggaaaaagacaccgcaacaaacaaatgatcgagctaactgatatattatagcagtgcacagttttcccttttttttctaaaggatctcgcggttctgttccaaccacatacgccatttttttaaaaaaaaatcaaatcaaatcaaatcagacatctaaaatattcaagcctataactgttcaggggatagagatcacctgcagttgtaatgtggactgcaactttagcagtccttacgtgaccgttagatcaaagaaaaacatctcatattcggccagaacactgtagcacgcgtatagtcctgtagcgtactgtagcatatactgtagcgttgttagcttggttatgacgtggcacagccatctgtcgttcatcagcttgatccgacggttgtgaagggatgtgactgcctaacttgcagtcaatgtaataactgtaacggatcttgattcctgttcaggtcatcaggtgcactcacaagctcacagcgcaagggttcgcatctctcatctcatgcactctatgactgataagccgcaaaaagaaaatcaacgaaacaactgaaattatgtactccctcggtcccaaaataagtgcagttttgtactatttatgtctaacgtttgatcgtttgttttatttaaattttttatgattactatttttattgttattagatgataaaacatgaataattttcaggtgtgactattttttttattttttttataaaattttcaaataagacggattgtcaaatgttggacacggatttttacggctacacttattttgggacggaggtagtataaaacttttatacttaaatttttattttttaacaattgaaaatcaatgctaaaaaataaactataataaaaaatcaaaattaactaaaattaagtataaaaattaaaatttaactgtctctgataagccaacaggcaagctattgagcaagaagagcaaactttgaaagagataacagcggatgaggagcaagagggagtatagttgcaatagtaacctgcagctcatggcgtcgctcctggaggatcctggcggcgccgaggagcatggtggtgtgtgcgtcgtggccgcaggcgtgcatcttcatggccaccttactcttgtgctcccactgcacctcctcctgacaagtttttgttgaaggcttttgcagatcagtatatgaaagatagaatgaatatcccaatattcttttggtgcattgaacaaaacccagcagaatgtatctcaagctatcttaacgcttaagtacccatgttgcaaactttgatttcaatccacaaattattgtgtcaatagaatagactgtggaaccgtgtgtataaacattttgctgttgtggagttagtttttcatcccttaagtggtcataaaaagtctaacctatcaaatagtcataaaaactcttgaaaaaaattgttaagatttatacaatagtcgtctatgatgttctttttttttaaaaaaaatcataactatgtaaataacatgtaaagtatgggaggacatccaatcagaggatacaaacttttttgtgattttgttactaaaaaataagctcaagttaaatgtaagggtgtgtttgcaagagcaagctcccaacactccactttcattttagaatcaatttagcaattctctcaacttttgagtagaagataaaatcaatcataggtacgcatatgacttatgcggtgggacattataatggttaaacattttatttttattactaaaatgaaatgaaataatgtctcaaaattgacaacattttaaaatagatgtagtcaaacataaaaacaacttacaaaaacacaatgatttgacaaaaattgttatggaaaatgttttcatatggttataagttaagcatgttatagaatgcatgattaaaaaaacatgtttattggagacttgctgttgttttagacatcgtgtaaacaaagagatggtaactcactccggccatattttggacataatttaagtaaagtaattcgatgtacaaatgtctatatttgccctgaaaagtacataatactctaatttttatcaagtttattaaacatcaacttatagaattagaaggtgtggttagatttctgtacaacctaaacataacacaactcttctaggttctatgttactgtgcctctactgctttattaaacacaagcttgcgccttgcaacggcttaacaattatagctcgttgaaacgcaataattttgtaggtgctcataattttttttattttattcttctaaaaattcctttgaaattgctccattctaaagggaggctcgatttatatgcactgatgcctctccactgaacacctgaatttttcatccaattcacttaaatttttacctgagaaaaacataacacagaaaccctacagatcgattccgtcattcttttttttccctttccttttttttttttttgaaaaggcaggcagcaggttccatcattcaaatgactactccaaccaaaacgcttaacagataaaacaagaattccaatcaatacgtgcataagaaatcaatgagccatggcaggttgcccccccgggctgtctcccacatacgttacctgcatcgggagtgcatccatgtcggcgcgcagcgcgacgaacggcgggcgcccggtgcctacggtcgcgacgacgcccgtgccggcgaccgggtgcctgtacgcgacgcccatggcgtcgagctccgccctcaccagcctgctggtctcgatctcctcgaacgccagctctggccgctcgtggatggcccacctgacgcccgccatccacgccgcgaactccggccgcctcgcccgatcgagcacgtcgacgccgccgccgccgcccgccgacgcacctcggcacgcgagacatagcgccgccgcggcgacggcgacgacgacaacgaggtcatggctacgcaggtgcggaggaggagcggcgcccatggcagacgcacgcgcacgcgccatggcgcgcggtcgcgaccgaggacgagcggtaccggccgcgggtacggtaattggtaagtatacacgcgatgcgatgtcccccggccggcgcgcgcgtgtggcgggttatatatacacgtggacgccgggcgcgcgcgagcgagagcgacgtctccgcgagacgactccgcggctccgcctcctcctcaacgtgaggcggacgctgattacgtcgcgccgatggccgcgcgcgcgcctcgcgctgggcgcacgatccgaacgttcatatataataacggcggcggcgttgtgtgcagggattacagcatgtacaataacatattattagccagctataagataaaagataagagagaatagcaacgaactacagatatgtagccatgtgttatggctccaagacacaatgtatataaaacaagtatgatcatatattaatagtatagtactccgtaaaaaacgaattagctgttagatcgactataaataaattggagatagtactggactatactactacctctgttccaaaataagttaaaccgtggatattcgtactcaacgtttgaccattcgtcttatttaaaaaatttgtgaaaaaattaaaaatatttagtcacacataaagtactatttatgttttatcatctaataacaataaaaatactaatcataaaaaaattttaaataagacgaacagtcaaacgttgaacgtgaatagtgtaaaactacacttattttgagacggagggagtattaaacttgctcttagctagcggcatataggcgaggagaaaagacgtgacgggacgcgcgcgagagaggctcggggatcgttggagtggtgttggatcgactcgatcgtgggtccttgtgtctgcgcgagtattctcgcggatgaagaattcaacggctcaggtcaggtcttgccttgacgatcatcctcgcggccggctgggccgcaagtttagaatgcaacagttttaacgttttaagcgggtatatagctctacagatcaaaaggttctaaacggggcaatttgtccattaattgttggacatggacgccctcatggatattggagtcaaccgtgtgggttcgttttcgttttctccggtactggtgtcttcgtcagatcaaggcgtgtcacacacatactggattactggtgtacagtactccagaagacacgccacgtacgatcaaatagtaataaagcaactcattagaaaaacaacgtcaacgacgggacaaatataccagtgacgtcgtatgttgtgcaaccagccagcttattattaagagtatgaccgtaagctagctataaacacattttgagaagataaaaaagaagagagaagaacaatgggctacatatttgtagccagctgcagcacagactccaagttacatatgtatatgacaggtgagaccagatattaattatgtaatactccctatgtttcaggttttaagacgtttggactttcctcaaagtcaaaacgctttaagtttgaccaagtttgtaaaaaaatagtaacaaatttattacgaaaatatatttaattattgatttgatgaaactaatttagtattataaatattattatactccctccgtttcaaaatgtttgacaccgttgactgtttagtacgtgtttgactattcgtcttattcaaaaaattaagtaattatttattcttttcatatcatttgattcatagttaaatatacttttatgtatacatatagttttacatatttcacaattttttttttgaataagtcgaacggtcaaacatatgctaaaaagtcaacggtgttaaacattttaaaacggatggagtatttatcaataaacttagtcaacttaaaacagtttaactttaaccaaagtcgaaacgtcttataacctaaaacggatggagtatatatttatggataactattgtattcatggttcaagaaggcgctaggcgctagttgggcggatagggggcgcctagcgcctaattggcgcctaggccccgcctaggcggcgcctaggtcgggtcaaatagttaaattcaagaaattagtaggcatattgcatagaaattagactatataacactaaaatagcaataaaatactacctaagtaatttaaccgcctaatgcaccattgaatgcctaatcgcggcggctacccggcgcctagcgcctaatgggcgcctaggcggcacctagggccgatttttagaacactgattgtattaatgggctattaagttgactatatatgatttagagccggcagctggctatactattaaacttgctctaagtaatggcttgccttggctctaggttactacttgtcaaagcaaatttttattgccaaagcactttctaataattcctatattgttaataaaaagatatggtatctccattgattcgataaatcataccgtatatccgaaattatcatcgtaggtaacgctccaaacctatttattttacacgagatgggaattgagattctaaactaaatacaacctatagtctttatttattttaaatttcagacttgtccagacaaaaataggctacaaaataatactccagaccaaatacagctcgatcggcaccagttaattataacttttaaaaaatattaaataataaattttttttatatttttatcaatagcactaatatctgtgcattggacgaagtacgagtagtatgggctggtttggtttgtgatctaaatcgaccttaccaattttggcacattttggcataattaattttggaaggcaagttatgtttggattgaagccaaaatagcctaagttaactattgaaatggcctattttcttaagcatactaaaatttggcttcaaaacaaatagacactcaacactattaaaattaaaattgctaaatattggtaagccaaatttaagccacaaaccaaaccagccctatatgtccaattgaaatcgagattgctggcgcacgcggcagcatgcgcggaactatgcgcgtcgtttcgttcaacccagcacgtgatcttattaaaacgtctcgcttatcttaactctttttaagcagtcaaaaagaagccgtcacgctccaattaagttggcgattgcatagtttgagagatcagcatgaagaaatggcgttcccttttgacggagctatcatgagacatgtcgtttcaactttgtcgtgttcggattaaacgtcggccctagtaataagcagcgcatcaaattaacctgacattgaaaacgtgcatcattcatcgtttgctacggaggagacacaggacacaccgtggagcactgccaaaaatttagtgctagtacatcacaatcactgcttcgggggtgtttagatctaaggtcggaaagttttggtgtgtaactatatagggtgtcgtataaaatgttcggatactaatagagaaacaaattgtataatccatcaataaaccgcgagatgaatttattaagactaattaatccgttattagcaaatgtttactgtatcactatattttcaaatcatagagtaattaggcttaaagattcatctcgtaaattagtcgtaatctgtacaattagtaattttttagtttatatttaatattttatatagaagttcaaacgttcgatatgatatggcgtaaagttttagcataggatctaaacctggccttcgtctgttatcgtggtacaacgattgtacgggcctgtgttttttctcgagatgaacaaattgtaccggcatgtttatctcgctcgccgttggtgtggcgtcagaatggatcacacgctgggcgcttcgcctcgcacgtgaaaatattggggtttttgcagtttcgcacgctatcatgtgggctgtggcctctgccgcctgcgtggctgcgaccgtccgtacatgcgtcgtcagctgcactaacatttggacagaatttttcgtcagggcgcactgccagttgatgccgcgcctgcaggatcatcatcaactgccccgcgtcgcgttgcggctgcgcgcgtttcaggcgttgcggctgccggttgatctcgagacgcaggaacgcagaggcgcgagcacccatcgggccagccaatacggtactactacaccagtagaagcagcaggggatccggatctagggcctcgtatagatctcggaaaatttttgctaaaaatgtcacatcaaatatttgatcacctgcataggatattaaatatggagaaaaaataattacacattttacatataaattacgagacgaatcttttgagcccaaccacaccataatttgacaatgtgatgctatagtaaacatttgctaaagacggattaattaggcttaataaattcgtcccgcggtttacagacggaatctataatttgttttattattagtttacgtttaatacttcaaatgtgtgtccgtatacttcaaaaactttacaaccaagaaactaaacacacccctacgatactcattgagtcattgttagtgtgtgtgaaacttttaagcagtagtagtactgcttatcgttgaataccgaattgaacagtctaaattaattagcacaacagtgttagttgcaatgtactaggccctatttcgaagattagcctacgactaattttaagagctaatgtttagtattgaatttataggctaaacattagtctagggtgatatgtttggatccatgagctaattcagggataaaaggtggagagagagatggagatggggctgctttttcatggtctctatagaaaattagccacattagcatctctttaagaggctaatgttttgagggggctaattcactttagccccaaattaacctagttgtttgaatccttaggggctaatttagagctcaaaggtgggggctaataattagcccatgaaaccaaacagggccctggaaaaaataccatagcacaaaatactactagtagtacaaagatagttgtgaatctagactgttgaccacataaatgagaccactatgtactagtattatataatatactagtattatatagtacagctgttagggtagctatagttccatgtaggattgtatccgatcaggattgtaggccaagggattgttggccaagtttagtttcaaactttttttttaaacttttaactttttcatcatattaaaacttttctacacacataaactttcaacttttccgtcatatcgtttcaattttaaccaaactttcaatttttgcgtgaactaaacacacccggaatgtgatggatccgaatctgctgtagttgatactgtgaatgtaacttgtaggcctcatttgattttctagaaaaaaatggaggaaaaacataggaataagaatcctatgtgaattggtactgttcatccctttgatttgtaggaattgaacaaaggaaaagcatggggaaaaaaatcctatgatcatgatttcaatggaatttcatatgaaaattaacatccacctttagcgcatttttcttttcctatgtgtaggatcaaggcaaagcactattggatgatacagtttaccctagcaaaaccattcaaattctgatttgctattcctatgtttttcctatacaccaatcaaacgatcattcctatagttttcttatgttttttttaatcctctgtttagcatatgatttcatatgctattcttgtaatgtttcctattactacgttttttcaatcttgtgattcatcacaacgatggttacgacttgagcaatgatgatattatttattcgttggacccaaattgaacggtccaaactagccgcataagattgttcattgcaatattatagcaaaaaaaattattacttcaaaaggctattcatattcatactactaccgtagttgtcaatttggaccactaatcaatggagtaaaatggaagaccaacaatgcatgcaatccttaaggctcacacatctaaaagtgctaaatagtgcgtgtgttttttaaaaaaataatatatagaagtttctttcgaaaaccaaataaatcaaaattttaaatttgtaatatttaatacttaattaatcttccgcaatggtattttttttgttacgcatgcgacaaaaaagttaggcctaaatgtgctttcaaacaaagcttggatccagatttgctcggctcgtagagttgggaactaatcctcaaacatgtaaaaacagagcaacttattaagtattatctaaagtaactttaaaaataaattaatatgattttttgaagtaactttctatagaaattattttttttcaaaacataccacgtttaatagtttgggaagtgtgtgcgtgaaaaaatgacggaggtgaagttgaaattttgacttaagaacacaacctaagtagtatacttgtttcgcttatcattggatcagaactaaatgatctgaataagtgcaaaacattgttcatgagttgtccatgcttttttatagcttccatgttgagtgctgcaattaacatagaggccggtaaggggacaatacttcatgaacatgtaaaatcattttacatgtaaaatgcagtggcggctccaggatcgattcgttgggtggtcctgcttggcgtgccaaattgtcacaatgttataaaatcaagtcaaaattatcaaatacagtggaaatataattcaaatattgcaatatagctcagaacatcacaaattgattaaaaccatcatttaagttcgaagttacgaaagttattacaacataaataattcaaatatcttacaatgtctctattccttttcatgtgccactgcaatttgcaccacaaattaatgagaaaataagtcgtattgactactaactaagttgttgctaaaaaaaaaaatctaagtttcagttttcattcacattttttcatccatatttttcattcaccatcacgatgaccgatctattcaaagtaaatacaaaagactacgaatgacttaatgagtaactcacatatgccaaattgccaatgcactaggcagacaggcagtaggcagtcggcaggcaggggccagccggccgggggcagggcggctcgccggctcgtcagtctcggccagcaggagggatcagccgtcgcgccgcaaacccgccgccgccgtgcggtgtggcggggggtcatcggctggccgccgccggccggagtgctgccgagtgccgcgccaggcccgggctgtggcggtcgacgggcggcggctgcaggcgtcaggcgagggtgggaggggcagcaggtggccagtcgatggcctccggcgcagcggcgctggccgactgatgggagagcgagaggcggcacgatttggggaggattggagagccgagcgtttgccgcctacgtgcgcctctcctctgccagctgagctaaccctaacacatttggtgggctctttttttttgtgtgggccgtcgggggggggagagggggggctcctgggccaaaatccagggtggtccaaggaccacctggactacctgctagagccgaccctggaactaaaatgtattttaggatgaatttattgagctgtgaggctacctatcccgtctttaatctagttccataatttagctccatgagcgggcctgggtatacatgggacctgtttggcacagctccagctccagctccacctccagctccacccctcctggagctgagctcagccaaatagtttcaactccaccaaaactgggagtggagctgggtctcctggagctgagctcagccaaatagtttcaactccaccaaaactgggagtggagctgggtggagctctctcacaaaatgaactagagttgtggagctnantttangcanctccacaacttttttccagacccaactcctgaagctaaattaaggagttggagctgtaccaaacaggcccagagttgctgcagtttttctgagaaactttagcaccccaaacaataattattattcagattctgagtatttatagtcgtaaaatctataaataaactagaatatagaaactgggttttctagcttcttaaccagttgttctaaaactcccaaacaaaacgtaactaagggtcgatccaacatttgcctaggccttgggctgacccaaggtgcaatctgacccacacattgaatacatgatgaaattagataggctttcatggtacatactccgaggctcaggtgtcctaggaccacccctgaatcctattcatgatggaacgtgttttgtcttgcagactttcgttcctgggcgccatggggactgagagagagaaacatcttgttttccgcgcgcacgtttcccaaactactaaatggtgtattttttataaaaaaatttctataggaaaattattttaaaaaatcatattaatctatttttgaaatttaaaatagttaatactcaactaatagttaatacgctagtggcacacctcgttttgcgtatcttctcaatattctcttctcctctcctctcaaacactcccttaaggtcatgttcatttaagcttatggacttatcgactatacttaccacgatcgtcaaaccatgatttattaaaaaaaaacttccccatcagcattgcttacataatttttctaagttatttatgtttttgagagaatccattatataccactcagtttgccacatttctacgattcgtcgctgactttatcacgttctacaatataccatcgacttttgcttaacttctacgatttaccatcgccgtcctattagcctccgttaataccgtataattttttccaaatgaccaaaattcacttgggacaaaaactttcaaaatttggataataattatgaaatgtcagattttaattttttggccaaattttggatgtttacaatattatgttcataatatgatacaaaaagcaaatagagtattgtattttggatgtttacaatcttatgtttataatatgatattacggaatttttgtctaaattttggaagtttttgtcctagaggtattttggtcatttggataaaattatatagtattagcataggctaaccggacggtgatggtaaatcgtagatgttaagcaaaagtcgatgggtatattatagaacatgacaaagttagtggcaaatcataaacctgtgacaaaatcagtggcatttaatggattctcacttttttttataagactagcaatagtgcacgtgcgttgcaacgggaaaaactaccgtttgatagtatgacatctcgagaacctcaaattggtaaaaatcaagtctaatttgatatattaccaaaattggtagaaccgagtctaatttgatgaattagcataggatttaggatttagtcttagatttatttttcaagcctacttaggagtttatctgatggactttaattttaaaaaaatctgagccatttgatcaaatttgctttcgggccaggtcttcccaagtcagcccaaacttgggccggcccgtcttcgggcttgtcggtgacatgggaccgggggaatcatgactagaggcttgggcaggagcaatcacccacgaggcctgaccccctctgggggggtcgggcccgagggtgatatggtcgcccccctctttgtctccccgaggggtcggaccgctcccgtttcggccccgagggctgaggcgccccgaccccttgtagattttgcgccgcgtgtatgggttaggtgagcgcagcggggctcacctaaccgcatttattgcgttttggacgagcgcgtcacgccgcatgtaacgcagtgcagcgcgctcgtttatccggtctgagaccagtcacagaccgatcagatcgtgggttaggtggcgacaggcggtctgacgcacgcctcgccccatcccgtcaggacgagagcctctaaacactcgtccctagccggagccggcgtgttacctcctggagatggcacgttggtcccggtcagatatatgccaggcttcatcctaaccattacaagcaagacattgtatgaagaagggcgaacatgcagattgataaactgacgcgtggtggacaagaatgaccgatttgtgaccggtctgacactggtcatgtcgtcagcagacaaccatgttcccacgtcgcgcctgcctccggcggaagtggaggtaggtatgggccgtcccatcagaaggtcattcggacggcaaccatacaagtctccgtctatttatgaaaagataggataagtccccacacaaaagagagaaatggtgcatgtggtatccccttgaggtataaaaggaggaccttgcccacttagaaaggggattggggatcgagaacgatcagagagggagagagttagagttctctggctctccagctctttgtagcttcttcatacacaaatccactaaaacacaggagtagggtattacgcttctcagcggcccgaacctgtatacatcgcccgtgtcttgtgtgtttccactctcgcgaaccttccacacaccgagagcttagaacctcacccagggcccccggccgaaccagcaaaggggggcctgcgcggtctcccagtgaggagccccaagctccgtcatctggcgcgccaggtagggggctctgcgtgtgttcttctaagctctcgcactctttcgtgtgcgccaagcttttcctgttcagcccaatggccgaacaagcaaaggctcacaacctctctccgagtgttagcggtgacgacggggagccaaacccacgccgtcgagctcgtactccaccgccccctccacgccaaagtcctaggcgggaggaggcgctcgagagggtcgaaggatccgcgacttcgacatccacgggtgatggagaagggcgccgagatggggagcgtcgcctcctcgtctacggcgacggcagcacgccccagggcgcgctccaagctgcgggcgcgctcctacgtcacccgcccgttgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggctgttgctcgccattcggtcgccactccttcgtcagcgcctccgaccagggaagatctgcgtggggggccggatgcccgtatcagtatcgagcgccggcgtaatggccgacgtgctgcccacgcaacggagggcgcctcctcgtccggagtgtcacctcaacacggacgcggggatcagccctccgtgcccccggttggtggtgtcggctgtagagcctttgttgcgagccttcggaatgtccgttggcccccaaggttccggcccaccatcgccgaaaaatatgacgggagcgtcaaccctgccgagtttctccaggtctacacgaccgggatcgaggccgccgggggtgacgacagggttatggcgaatttctttcccatggccctgaagggacaggcgcggggttggctaatgaacttgccacccgcgtcggtccactcttgggaggatctgtgccaacagttcaccatgaactttcaaggcacatatccgcgcccaggtgaagaagcggacttacatgcagtccagcgaagcgatgatgagtcacttcgctcatacattcagcggttctgtcaagtccacaacaccataccatgcatccctgcacacgcggtgatctacgcgttcaggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcgacaaaaagaaggaggccggcgctcccagcagggagcgcccaaccggcaagtggtgcatcgtccacaacacctcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagtgcttctggccgcggcccctactcatgaggcgacgcgccaggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatgggggagcagccctcaacatcctttcccccgcagcctttgacgccatcaaggccccggggatggtgctccggccgtcccagccgattatcggtgtgatgccggggcacacttggccgctaggtcatatcgacctcccggacaccttcggtggatccgccaacttccgcacggagcgggtgaactttgatgtggcggacctcagtctgccctacaacgcggtcctagggaggcccgcattggtgaagttcatggcggcggtccactacgcctacctccagatgaagatgtcgggccccgatggccccatctctgtccatggcgacctcaaagttgcgcttgcttgtatggagcagcgcgcggaccacctcgccgccgcgtccaagcccgagggaggcgacgagaggcttggcacctccgcccccgccgccccgaggcagcggatagtcacatgcgacgaggtcccggtcaaggaggttgccctgggcgacggcccgtccaagaccacacggatcggtggtcttttggacggcaaataggaagacgtgctcgtctccttcctgcgggcaaacgctgacgtcttcgcatggagaccggcagatatgcccggggtccccagggaggtgattgagcaccgtctcgccgtgcggccgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcttcgcatagattagattgtcgactccacagcggggtgcgaccttttgtgttttctagatgcatactctggttaccatcagattcgcatggctagggaggatgaggaaaaaactgcatttattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaagctgaaccccgataagtgcgtgttcggtgtacctgcgggcaagcttctcgggttttttgtctctgcccgaggcatcgaggccaaccccgagaagatacgagctatagagcggatgcgccccccccagcaagcttagggatgtgcaatgcgtcaccggttgcatggccgccctaagtcggttcatatcgaggctgggagagaaggcgctacccttatttaagctcctcaaacgctccgggccgtttacttggacggagaaagctgaacgtgccctcactcagttgaaggcgtatctcagctttcccccagttctggtcgccccggagccaaatgaacccttgctactctacttagcggcgacccctcaagtggttagtgcggcgttggttgtggagcgcaatgaggacaatcctcattccgcgcacccccaccctgtgctggcttggcccgggaaagagcagggaggagaggcccccgagccgaacggtggcccaaggcccccgacgaccggagcaggccctctgcccgcttgtcagacggtgccaggtgcccccgacccccaggatggcccgggggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgatgacgccaggagcccccgacccccaggacggccccgaggccactgtgggaaggccgcccctatcgtcctccgaccccgaggtcgtcggcacagaagacgagtgcgccccgcgaggccgcttggacgaagagcgccccagggatgcggcccctagcgaagaggatcggccccaccgaaaggtgcagcggcccgtctactttgttagtgaggccctccgggacgtcaagacccgataccctcaggcccagaagatgctttacgctattctgatggcttctaggaaactgcgccattatttccaggcgcatcgggtcacggtggttacgtcttaccccctcggccaaatcttgcataatcgagagggtactggacgggtggtgaaatgggcaatcgaactttctgagtttgatttgcactttgaaccacgccatgctatcaagagccaggccctcgccgattttgtggcagagtggaccccagctcccgggcccgtctcagtccccgaggctagctcgggcccctcgcagctgcctcacacgcccactgggtgatgcagttcgacggctccctgtctcttcagggcgccggtgcgggggtcacgttgacctcgccgagcggagacgtcctcagatatttggttcgccttgactttcggacgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacgattgccgacgaactctcacggctcgcttcctcgcgagcccagaccccaccgggcgcctttgaggaaaggcttgcccagccgtcggcgcgacccgaccccttaggggagacggacgcgcctgacaggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcacgcggctaacggaatcctcctgaagtgcattcctcgggaacaaggcgtcgagcttcttgccgatatccatgaaggcgaatgcggagcccactccgcctcgcgcaccttggttggtaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggagggccccgggcaggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaaactctgcttcgcctcacctgcccaccccagaagcaacgaccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgaggtcccctcgggtcaccatgtactgcgaggctgatcaagatcagcttcgcagagatgacctcgactacttggaggagcgaaggcggcgcgcggccctccgagccgcacgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttatttctcttatatctgtatttcaataaaagcattttcaatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgtctcatacacacaacaaatagaattgacacaaaaaatttcctctttatttgattgcagattaaattagtttatacaagaagggggcccgaaggcctcggaagaagaaaagaagaaattatttaaagattggcgggggcctgggggctcactccgatgcgcccgggtcgccagcctcgtcgccactgtcgcccactccgccgtcatcgtcctcctcgtcggagttgagggcgaacgcgagccgaggggccgaaccctcgaagctgtggacgatatggtcggcggcgtcccggacctgcgcgcgcgccgtcctcggttccgggagggaacttgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcgacgagtctagcgcgccctgcagatcggcgatggtgtgttcagcagctgcgaggcaggcggctaagtcgctttcgcccgcggccgccccgccgctgcgcgccctcgcgtccagctccttctcccgcgcctcgagctcagcggcccgctggttcagtgcggccctctcggcgcgggcaccttccagattacggcgcgcctgctcctcccgcgctgcctcgcggaggaacaggctgtccgccagccgttgcgccgcggcctcggcctcctcgagagctcgctcccgctcggtgagcgcgtcctcgcggaggcggagcgcggactcctcttcggcgcaggcggcctcgtgcgccgccagcgttgcctcccggatggcaacggcggcctcgcaatccgccaggtccctctccacggcgcaggcacgctcttccagcgccatggcacgggcctcacgggcttcttcgcgccgccgggatgccacctcggtctccgccgcccgccgttctcgggcagcggcagcgtcaaggaccccccaggcggcgtcgagcttcttccctagctccgcctcccagctcccgtattgaaggcggagggtgtcctgcgcctcgttcatcacggtggtggcgatgagggcggccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcacccatgcggcgtcgagctccgcccgctctgcttgtagggcctccacctgggcacttaacccgtccaacaccgtggtgtttgcgatggccaaggcctgcaggaggggttctgcgctcagtggggcaacggaaggcgtggggaagagccgcctcggagaggatgccgcgcggcttggcccgccgatggacgtgccggactcggggatgtcccccggacctggtttgtcctgagcgtcgcatgagggagtgggcccaagcgatgtgcccgcggcctcgtcgcgagctgcctcggaagtcgtcgtcgcctcggcctggcgaagtctggcctcctcccgagcggtttcttcagcttgacgagctcggacggccacctgggcagcttcctcggcttcccgaaggcgatccgctgcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgaaggcgatccacggcttctcgccggtcagattcccgcctccgggcctctgtggtcgccgggtcctcggcctcagactggccggacttggaatggcgggagggacgcgacgggatctcgctgaaacaggagaaagaccagaagacaaacaagatgggtgagtgaaaactcgcgttgagggaatgaatacagccacgatgggcgtgggacgaacctgcgagggggtcggttaaacgaccaccttggaggggaaatgaggtttccccgggatggttctgtcccccccatcttgcggagccgcttcttctttcgctccccctcaggctgcggcgtcggcgtggctccctccgggcgcctgctgctgacgcgcgccgccccgccccctcggggaggagatgggggaggggttccttcctgcttcctcttcccccgggcgtcggcagggcggctgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcctagtcccatctaactccctggtgggtcctcatgtagtcttcggacccggtgtactcccaggcgccccgggcgcgccgctggagcggcgcaatccggcgacgaaggtagtcgccgtacaccatggcccctgtgagcccctgggatcgcaggcccgccaggcggtcgaggacggcgtcatagccatctcccagatctaccggcgcccgccagctggaggcctgcgccggaggctggctcggaagtcggaggcgcgcttcgtcggcaaggggggtgtagaaccagtcgctcttccagtcatcccacttcttgcggaggacgcaggggatgtagcggttcagcaccggcccccgcggctggaagtagcagccaccaaccaccgacggcggcgacaccgactgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaaaggcggaaccagccccgccattgcaaaagggaggaagaagacggaccgccctaggtagcatggtgccgggcgtccctcgcccagcgtgactatctcctggccggtgcaagattccggcatgaagcggcgcggcagcccggcctgcctctcactcacgatgcgggaaggcggcagcacgctaccatcgagcagagcggagccccgtgccatgacgccggaagaagatatgtttgagagcgagcgtgtgtggcgaaggtagggcacaggaaacaaggagttagggcgcaagcggcgaagacaaggggaataatggcgagaggaaggaagcaaatctcttcctcggtgtctctatacccttgccagcgctgtgcccggctcctcccttctcgcgcccactatctcgctccctcgtttctcgcgcccacgcttccactaatcccattcgcccgcttgcggcgcatgaggtggatatgcggctgtggcagtcgagatggaacatatcgtgcgcgcgttaattacgctcgccaaccgaagcgccatcaccatatctccaggcaaaacgaaccggctcgtcccgattcgcgtgctactcgagtaatgtggcagtcttgaagagaccgctcattattgacagcagagttaccattgccgatgtgcgtgatttgtgaccgttgggtttctgcccaaccgtggagaccagtcccacctgtcaccaggcctttggaagtggcgtcacgcccgatcgcttcccttgaggagggcgatcgccctggcataacgccgggggctactgtcggtgacatgggaccgggggaatcatgactagaggcttgggcaggagcaatcacccacgaggcctgaccccctcgggggggggtcgggcccgagggtgatatggccgcccccctctttgtctcctcgaggggtcggaccgctcccgtttcggccccgagggctgaggcgccccgaccccttgtagattttgcgccgcgtgtatgggttaggtgagcgcagcggggctcacctaaccgcatttattgcgttttggacgagcgcgtcacgccgcatgtaacgcagtgcagcgcgctcgtttatccggtctgagaccagtcacagaccgatcagatcgtgggttaggtggcgacaggcggtctgacgcacgcctcgccccatcccgtcaggacgagagcctctaaacactcgtccctagccggagccggcgtgttacctcctggagatggcacgttggtcccggtcagatatatgccaggcttcatcctaaccattacaagcaagacattgtatgaagaagggcgaacatgcagattgataaactgacgcgtggtggacaagaatgaccgatttgtgaccggtctgacactggtcatgtcgtcagcagacaaccatgttcccacgtcgcgcctgcctccggcggaagtggaggtaggtatgggccgtcccatcagaaggtcattcggacggcaaccatacaagtctccgtctatttatgaaaagataggataagtccccacacaaaagagagaaatggtgcatgtggtatccccttgaggtataaaaggaggaccttgcccacttagaaaggggattggggatcgagaacgatcagagagggagagagttagagttctctggctctccagctctttgtagcttcttcatacacagatccactaaaacacaggagtagggtattacgcttctcagcggcccgaacctgtatacatcgcccgtgtcttgtgtgtttccactctcgcgaaccttccacacaccgagagcttagaacctcacccagggcccccagccgaaccggcaaaggggggcctgcgcggtctcccggtgaggagccccaagctccgtcagggctagatgagtcaattcgacggcccgcaagccgagcagccaagcgcggcccacatacgcggcgacggcccgatgcacttccgcggcccattgggcagcataatcagcggtgacggtggcccgacgttgggcgaatttgagccgtccaatctgatagatggctccgatcgtccctgcgtcggatgaagcgccgaccgggagagaggggaaaaacccctagctcccaaatccttctctcccgatcctctttctattcggcaacgagcgagcggaacgacagtggtctggcgagcgaactttgccggctggggggcgcacccgagggcagcaccaagccatgccacggcatcgatggtccggccaggcgggcgtgcaaatggtgacgagcaccgagtggcccggacctcgtcggcgggaggggcgacgccaagccgacgcttcccgtctctggcaagggatggtggaggggtgctccaggacagcgcgcgcacggggaacctgacgcgactgcgaggaggtgaaggtgcggcggtgccgtttcccggaaagctccggcgagcttaggggcttcaagttcggtaagtaacccgatcccttagcttaattgatttggattttgactcttagggttcttatacgaaattagggttctttgaatttggggaattttatcagaaaatttcaatattttttattccctcttttcgagtttggggagtttcagtatcgtttatcccctcttttaattttggaaacttcaatctaatttatccctttgctcaatttcagggaagccattgaagccgatgtctggttttgcttttggttcgtcacctcttctcaacgccttttcaccattttgtttgtaacttgtggggctcgggggcaattcagatagaattctatctcttattttcttatttgatttgatctctgatctctctctctctctcttgctttggctagcgtttcatcgcgcaggtagggacagagggtgccgcttgttccctcggaaagattatgattaagacaatatcagattttcacggacgatgaaagtaaattgaatgggattttttttaattttttcgcccttttttcgttattacggacgacggaaacatttttaattttttaagtagtatagataaagatatataagatgtaatacttaatctatcgctataagcaattgtcgtaatatgttcagtcatccaaaaagtacacggccttataaatcatgaaagaccctattaacaaagtgacgaaaaagctcctaaatttactaaaataaaatccaaaagttattaaaaatcagcaagggagtgtagtcaaaactgagcaaaactaagaattgataggagaaatgcatgcttaacttgttttagttacatatgataaggaatccgaagttgcttcaaatacactattgtcacgcccggaatttctatccaaaattccaaacgcttacatgtgtgtgaaccctcgtccaggaatcagccgaggcacacaataacaaattgataatagagtacaaatattactctaattaataagcgaataatatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagtatttagcaaacatttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttactatgatgagaggtgtgagactaatcacgaaagacattgttagacccgcccataaccgtgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcacgaaaccatcattaaataatagtgagtcattagttatcccgaatgtgtactaatgtttctaagcagggctaagcaatcatatctaatatctagttgaaccaatataaataaagctcaactagtcaaattgtaataacccaaggtatcaaggaataaggtaatcaagtacgaaagggccataacaaagaataggtcaataccacccaatgacattcgaaaatagatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcatcaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagacggtttattgcgtcagcgggctagggtttggtggaccgggcgcacgggcggcggttcacacgaacggacggccgagatcgaaccaatccaaaacggacggccgagaccgatcgggtccacggcggctcacggcgaacgaccccaatgacgtcagcggtgacgtcaccgacagcggcggcggctcggcggaggagacggctcgaacggcgcacgctcgccggcgaacagcggcactaggacgcaaacggagggcaccaagacgtagaggacaacacggcgaactcaccggtgacctaaacggcggaggaagaccaacggacggcgacggccacgaggaggaagcggcgggaaccttcgggtcgacgacggcgatgctgctccggtgatctccggcgacggcgaaggggcggacgaggacggcgacgacttggcgagcacgacggtggtcttcccgagcgacggcgacggctgaaacgacggcggcgcacggctggagcggcggcggcgacggcaaagctagggcacacggcgctagggcttttccgacgacgagaggcgaaggcgaaggtggcaacgggtagaggagacaccgggggtccttttaaaggggctcggaggcggcggcgaaggcccaaggcggcgacaacgacgaaggaaagctcggcttggagagaaggaaaccgatccgaaacgaactcgattccacgaacttccaaaacgatttagccaaagattccaaaggagaaaaggtagaggagatcccggagatcatttcccctctattgattcggccggagaaggaaaggaacggccggatttggaaggaaacggcggcggcgcgaaactagggtttcggcggcggcggccgaaggaggacgatgggtccgacaggtgggacccacctgtcagcgaccgaacgcgcgcgcgcggcggctgcggactgggccagctgggccgaggagagagaagagaggttttgggccgactttcggcccaaagccaaaagagactttttttaaaacctttttcaatttaaattattccttaaatgcaattccatttattaaaaatacttccttagctcaaataaatcccagaaaaatctaggaattatagaattaagcaaagtatttaatgaaattttatctggccccattttatattggaatttattaattaaaattagattttcttttcaagacttttaaaattatttctaaaaattccaattaaacaacaatttatatattttgaattttcagggtgtgacaactatcgggaagcactgatcggggcattcgatatccacaggcttattagctactaaatggtaattggcacatacaatttgtccggttgcttcttgtggcttttcgtagggggtggctacctggcgactggtcgcgcctgccccatcgcacgcgagtacgcgacccgcccccactcctctatagtctctatagtactagtataatatactactagtagtactagtattactattactactacactactactatcagtactagtattatttatataaaaaatatatttttatatgtatatattgttgatgtataaaaaatatacacatatacaaactttgtatatgatgtgtacaaattttgtatacgacgtgcacaaactttgtatacgtacgtattaaaaaatcgaaaaaacaaaaaaacatcacatatacaaactttgtatacgtacgtatataaagtttgcacacatcatatataaagtttgtatacgtacgtatataaactttgtataagtatgtatgaactttatatacgtacgtatataaactagtttgtatacatatatataaactttgtatatgtacgtataaaaagtttgtatacgtatgtgttaaaaaaacgaaaacataaaaaacggaaagaaaaaaccgggaaaaaaaccagaaaaaccaaaacagaaagagaaccccaaaaaataacggaaaaactaaaacagacagagaaaaaaaagggaaaaaaccaaacagaaagagaaactgaataaaaccggagaaaaccaaacagaaagaaaaacgaaaaaaaggaaaatcctcccgtgcggcgcgccatccaccgcgccctctccgcgcgccacactagcgttttcgcttttcgtaaacctgctgcgcgaaattgggttaggcatttgaaatagaataaaaagtatactttgactcccttaactattatttgagcatgattcacgtccttgtcgacgtttgatatcgtgactacggaatttgcatagtatggagattgttagtaccagggtatatgcgagattgaggtaaaagagatggagatagggattttatacaggttcgggccccttatctgacaggtaatagccctactcctgttgaccgaagccggtgttgctcttattcatcataatcacatcagtacaataattaggataacttatgtagccgtcgttgacttagcggcatggataaccaacacgtagtcgatgacagggtagtcatccctcaagtccgcactcagcgagatcggagatagcactagatccctcttgttggcctctgcagataccatattgggtttgtctaggcttatctctgatatcgatatccggcggcttgttttggcacatgttagcttgtgaatcgtgtgtcgatatgttgttgttgttgcttgtcccatctcctcctagggggcttgtatttatacccataggtgtccccttgtccaagtagaactagggagaccaatatggatacaatccgagtagtcctgatagtttccatatataactctatttgtcattccttatccggaactccttatgtatacgaggtatgattccgtataagacatggtatgtggtgggccctaccgagcttagtcaactactattaattatgtggtatccataaccatgacagtcctccaaccacaaaaccggaaatattgactcctccaactattaaaccgatgcaaactatgtcccttggtgattttggctaacgtggcgcctacgtggcggtcccgaccgggtttttgtcctacgtggcgcttacgttacgtagcattattgtaataaaacaaaaataaaaaaattgtgggaccatatatcgtccacacaaaaatgtattgtgggacccacatgtcatcctccctctcctttctttcttcctaatccttccttcctctctccgccccacgcggccacaccagcgcgcccacaagctcggcggcaccgcctccccgtccccctcccccaatccccatcccgctcccgctcccgctcccgcccccacccccggcgacagcatcggccgccgccgccgccgccaccacctcctcgtccccgtcatatcctccccatgtcgcttcctgcctccctccgccaccgacgcctcctcctccacgcaaagggcagaggtggttgccggcagcgccccactcctatgtgcgtcggcgccgccaccgctcctccacaacacacgcgcgtcggtgtagccgcccaaccaccaccacttgtcttcctcatgaatcgaacatcacatcgctatccccatcctatgctcgccccatgtcgtcgcgtccgcctacgcttctgcccctgtgtttcgtctccaaatccccactcgccgcccccgtccccgtggacgcccaaagggaagagaagggggagagagagagaaaagggagaggtaggaaggagaggaagaaggaaggaaaggagagggagggtgaaatgtgggtcccacatattttttttatttttattttattataatgccaagtaggacaaaaacccggccaagaccgccacatagacgtcacatcagctaaaaccaccaagagacatagtttacaccggttttgattgttagaggagttgatatatccagttttgtagttggaggatatgaatcatattcaggcgatagttgagggaatcgaagtatacgttttcctttgaaatacttcagacctttgttgggccttcacttcccatgtttggactctcccacaatttgggccatatcagatgggccctgtattaagcccaacaagaccgtagcccaccacgcgccgtgacgagggccccggtttgcttagcgacacggcaactactactaaatcgtgcgggcccacctcgcagtgtcccaactcacacgcacaatgcgaccgcgaagccgcctccgctaatccacctatttttattcttctctcccaccccaaaatccccaaatcccgacccgatcaaaatcgaagcttccgccgagttccccgtcgccgactcgcctggatcggcccgccgtcgagctcgcccccgaccatccgctcgattggaggccggggagctgcgtctggtggtgaatcgcatccgccgcggagcggttcgatttcggcggcggatttcgcgggggtagaggagatcgaaggggggcagagcagccatgagcgaggtgttcgagggctacgagcggcagtactgcgaggtgtccgcctccctcttccgcaagtgcaccaccgcctccgccctcgatggaggtaaccgaccgatcccctctagtctaatcccgatatgccatcgagatcttacgcggaggagtttcccccttttcttggagtacgactaatcgggtgtccgatttctgcagagaaaaagaagcagaagctgtccgagattcagtccggcgtggaggaggctgagtcgctggtaaatatcgaacccatttctttgggatccctaacctgcatcattatgaggagtaccattctagtattgacttacattctgcggtaggttagcagttaaaaaaggctggtgattttgatatgcggatgcatactttttagtagatacctgctatttataacggtgtaaatgtatgtttcatctggggtacaggtgcagtatttaacgttttatttgtatgggtttgtgcatacagattcggaagatggacctggaggcgaggagcctacaaccgagcgtgaaggccggtttgcttgcgaagctgagggagtacaaatctgacctcaacaatctcaagagtgagcttaagaggatctcggcgcccaatgcaaggcaggctacacgggaggagctccttgagtcaggcttggctgacactctcgcggtgagctccatgatttgtattactagctcaatttgaccatattgcagattttaataattggcagcatctagttttgtttgtccattgtgttgctgtagtttgtagttttaatctatatcacaataggtgttttacgtatatcacgggcacaaacgactgacaggtagcattcatgagctcataatcactgatactagctgtacttatatttttttaattgtgatacttgttattggatggttaattgaggctgaattaatggtggttgttttctttttttttccccaaatctgtaccatttatgtatgtatcactgacaatttaatggttcttaagttctgtattggtatgtgattaatagtgttatgctgaacttcagttagaataaggtatttaaatattttaatatttgtgcaatctggattttagttttttcattgtatttaaaacctttaaacaatgagagcttcattttgtaacatgttcttgccactcaaggtttttcctatatgtgttttttgtgtctgttacatggcaacgttgtaattcagtaggagtgtatatcatcagtttatttccagttgtggtttattttcagatctggacccttactgtcaccattatcaactgtactacagatttcacacaatctcaatgagttctctgtaactattttgttttgaaatttcctacataattttctcattcatttgttaatgtggacacaattgacagatgtgtattatacaagatatttccattctgatcttcatggtacaattctgtagtcgcatgagtagtgagaactgtttcttgtcaaatttgtgtggtccaatttggtccttgatgaatatccgttgttctgattaaaaaaaaatgctgatctgtcaggagaataggaaatcggagttaacaccctcagaaactgtcctttctactttcagtaatctgcttaatgtttttgcgaaatgaatacattatccagccaatgtattcctggatgttgaaaagcttttgggaatgctacctttgcattctttgtccgtcatatttttctgctgatataatatcttatatcataatgcctcagcattacattgattctgatttcttaaacattctctcaaagttaatgccgttttttcttttgttgtttttcatgttgtaactgggattattatgtaaatcaggcgtctactgatcagaggggaagattgatgatgacaacagaaagactgaatcagtccaatgataagattaaagagagccgaagaaccatattggagacagaagaacttggtgtgtcaattcttcaggatcttcatcaacaacggcagtcactgctgcacgctcatactactgtacgtattctgtcataacctttttacacatttattggatttgccttcctattaatgtcatattcattcgtcttctgggcatgtcttatgtttattatttgaaccatcctgtgttgtctggttttacaggtaaatatggcataggaatactattacttaggttctagatttgttgctttgctctatcttggagaattggctttttagcaagttaaggttgccttttgcttggcttttaaagttgacccaattaattccttgtttggtttggaggtgattctacaataggtgtggaataaatcctctccaatccctcctccctcttggggattaaccgaacaaggcctaaaggaacctaccaaccaccacatcaaaaaccacttacaagttaaaacaaaatataagtacttcattgtttatactcttgaatgcaaagagcaaacagtagacgatgcatatgcatgcaaagccatggtcgacgattcattgttgaagtgaatactggaaaattcctgtataaaaaatgtgctatccaaaatatttgcagcaagattcacatcattaacagtaatagatttagctgcaagctaatggcaacagtaatcatgcaatgcagtctacttatttcatatatgttaatggcgtcatttttctcacagttgcatggggttgatgataatgttggcaagagtaaaaagatcctggcggcaatgtcaaagaggatggacaggaacaagtggatcattggggggataattgcagctcttgttctagccatccttctcatactgtactttaagctcgcttattgagcttgctttctggtagggtcttcaaagcaatttccgctcagtaaatgtgtgataaaatagttgcctgaatgttgtacattgggcaacacatatctctgcaagcacacacttgtttccccaaacttatggtatttgtgtggctcatcgcccatgtcatgtaatgtacagttaacgtgcactccaatatgtgaaatgtctaaaaagggcttaaaatgaaaggtgactcatttatccaagtactgctttctgttacactagaggtattgaattctattctggtacactatagggagtgtgtattcctatacctgaactgatgtcactgttgaccatcctatcattgtgatttgccagcgttggccagtttgttatcgttgtcgactttggtcgcattagatgctttctgaattattgtgcagtgtgtgggggctcttgtgctggtgtgcatgcggaagctagcgtagacgatgcagatctgtcatctgcggttgcagggctaggttgtctagtaggggcaacacgatatggctgtatgcatgtatgtcattgtttgattggcctcccgtttgggcaatggacgaggttgatggtgatagtctcatggttgtagtaagcattcgtccaatggaagagaagtcggttttacgagtactgcagcaagccgatgattgatgtaccggccgggttcatagaaggaaaggctttgctctgttgatcagttcggaattccgggataaacttagcgagcggcatgggaagcaatagcgcatctccaacagcatcttttaactcgggctctccaaacacctatatagctaactctctatctaatttggctagtcaaactagttagtaactccaatggactatccatcaacactctccattatgaatctataatagtgggacctgtatgtcagcctctaataccccttcttcctcctcttttctcccctttttcttcacccacttctctccaattcttctcctctcttctctgcagtgcggcacccacttcagtgcggtgcggggatggaggcggtgccggcaggagcggcacgggcggcggaggatgacgtgagcggcatggggatggaggtgggagcggcgcgggcggcataggccagtgggaacgacaactatggtgcctgcacctccctcccctgcgagcggaggacgacgcgagtggcgtggggatggaggcagcgtcggtggtcgaggacgcgagcggcacgggcggcgtaggccggtgggagcggcaactatggcgcctgtgcctccctgctccactgcctccttccacggccggtgacctccaccgcggcgacgaagctcgagcgccacccacatctctctctctctctctctctctctctctctctctctctctctccctctcgttttcttccttgcgctcgcgatggagcagaggtgcggcgcgcagccacggctcagctgcggggagggcgagcagcggcgcaccgccggggactcaccactggcgacgtagaggcgcggcggtcacacgatgcacggcacggcaacatcgagcacgcgagctcctcagcatacgacggctcccgactttcggtgacggaattgcgtagacaccaccacctcaccccgccaccagcttcagccg

SEQ ID NO: 59339 - DNA, 30548 bp, Oryza sativa
agtacggccgcaagctctttatgggcggccaaaattgcaattagccccttgccgccctctgtacgggcggcaagggcctaatcgcaattttggccgacggcggcagacggcgcggtcgacccaccgtctaccacgtcagattgccgcccaccattagggcgacaggggctatttctgcaatttttttggtccatagattatttctgtaaatattaaaaaaaaatctaaaaacgaaaaaagttcgatttgacgacgtgtatgttcggcgaaatctttgggcctgggattgcccttatcaaaatttgcctaaccaaccaaacatctctattactccctccgttttgaaatgtttgacaccgttaactttttaagtacatatttgaccattcgtcttattcaaaaacttttgtgaaatatgtaaaattatatgcctacataaaaatatatttaacaatgaatcaaatgatagaaaaagaattaataattacttaaattttttttaataagacgaacggtcaaacatgtgttaaaaagtcacggcgtcaaacatttcgaaacggagggagtagaacacaactttaacatgaactagctgggtggcccgcgcaattgcgcggctagcaaaaaaatcatatattttttaagtatgattttacttagaattaattaaatagctatctcattgttaagattttgaaaaaccaaaccttatcatcctcatgtttctaattatatagtttttaaaaatttgctatcccttatgtcatctccttttttatttgcttgctcgatctatcactatttctattcattcttcttggaacatttaaaaattggattttctagtttttagagtttattatcacattgggtttcgtttttataatttctagatgtcccgtcaaacattgccattatgctcctctatgcccatccactatctcttctctttattgtcattgagattttaataagtcaaacataattatcgtttgggttcatttttactttctagaagtcccgccaaactgtcagcggttttgccattgtactcctctacggctcgctcgctgcctcccttctttattgtcattgagactttaaaatcggacatgattatcattggttttttttttactttttagaattttcgaaccttcaaaaattagacttgtagtttcattttttataatttttagaagtcctagcaaacgatgccactatgcccctctacagaccgtccgccgcctattctttattatcattgtgattctaaaaatcaaacataactattgttgtaattcattttttattttctagaagtcccgtcaaccatcggcggctttgcaactatactcttatacaccctgcccgctgcttctcctttttattgtcattgagattttaaaatttgaatatgattatcaatgtgttttttttttactttctagaagtcccggcaaccgccttacttgtttgcttcacggcatgcccgacgtccctccttttaatcgtcattaggattctatttggtgttttattaacaatttttatatgacgtatcaaccgccaccaactctactcctttataggcatgttacttaatttatctcgtcacgtgttttagatggtcttttctttcaatagtctttatttttatcaaaaaattagttatttataaattttattcctaattgaaatcttttttttctaatttcagaatttattttttttaaaaaaaattagttaataccgtattgtgttcttttaatgtttttatttttttattttcaacttcagttgtttcaaaattgtattcctacttgaactctcttttaatttttctaattttggatattattatattttttattcaaaattttaattaatctcgtattgggttcttatatagattcttgtttcaatattgcttatttttaattatgaattttagctatttttaaattgtattcctactttgaactcttctttattttcttttgctaatttcggatttatttttatttttattctgatttttaattaatcttatattgggttcttatatggactcttcttttaatatttcttatttttaattccgaatttcagctatttttaaattgtattcctacttggactctcctttccttttctaattttggattttattttattttatttcaaaatttgattaatcttgtatttggttcttatatggaaacttctttcaatattgcttatttttaattcctagtttcagctatttttaaattgtacttctacttggactctccttttcttttctaattttggattttattttatttcgagttttgattaatctcgtattgggttcatacatggaaacttctttcaatatctcttattttaattccgaattttagctaatttaaattgtacttctacttcgactctccttttcttttctttttctttttctccgattaatgtggaaatttctagcccaaacagtgaacatggtgcctcctttcagagctgttttaataatataatagatagatttagctttgcctgtaaacttgtgtcttataagcatagtttgacttcaatccaaatcaatattttcaactatagcatactaaaattttgttggtgctaaaactctaccaaatatttagtttaatccaaatagtccctttaatccacgaactatcgtggttaggtcaaccaaattatctccttaaactaaaataccaaacattttacaacatgaactattcatactagacaaataatcctcttagcattgttttagtcggttttaaattgagcttgcacacatgacatcagtgtggcaatccaaccaacaaagaattttctcttcctatgtccaatcacatccctagtcccctgctctctctctctctctatctctctcatgctggagattggagaaggtggacaatggtggaagatattgatgcaaagctcacggcgatggcgaacttgcgagcctccgcatggcttcagcttggttgggcaacaccatcctcgtcgtagagcgagtggcctccagacctatggtcgcgtgctccactgctctagcttgacagcaaggttagaggagagcctgcaacggagctcaaacttcattggggaggtgttggcggcggagtcaagctctttgtgggaaggatagctgagctcaagctctctaggcattatctcctggagctcgattgggtggaaaaggccgcaggcggcggcggagtcgagctctttgtgcgaagggcagctgagctcgagctctctaggcattatctcctagagctcgatttggtggaaaaggccacaggcggtggcgagcatcagtgcacgtggtggcgaagatgttcgaagagtattttggttgcggagcttggcgagatgtgcagctgcgtccgtgtgagtggtggtggagatgatgcgaccgtcggggtccatatatgagacttgtgcttttatccggatgtgcggcatcttcgttgtctccctcgctatcactgtcatattcccatcctcctcttcctcccccgtgtatcctccctctcccatggagaccagtggccaaacgtggcgtggacgcagcaagcgacggtgcgacgtatggtggtggtcgccaccggggacgagttcctagtgaggacgggattctcgaccccaagttggtttcgagctctacatccatgtgcctccactctgcctcgggttgctgcctcctcgatccgccttgcccaagcggtctccgcctttgccctccttctctagccataggtgtagagagagaagaggggaaactagggatagattggcttaggggcgggtgggtctagagattttttttatttgttaattggattgtcacgtttggcgtcacgtgtgtaagctcgagcaaaaaccacccaaaacaatgctcaaggagtttatttgtccaatattaatagtttatggtgtaaattatctagtattccagaccatgaagtaattcaatcgagcgcaatcgttaacagtaattcttttttgctacgaacaaattcttcacgcaggtgcagtaaagatgagttaagcacacgtaattatagagatttccccgcaaaaaaaatatagagatttattaacataacagcctatccacgtgggtccaactgtcagtgtgtgtgtgtcacgcgttcttctgacttctgactgagtgctgcgcccaccgatccgcccaatttggccccacctcgcagtgaccaggggaagaaaagttcggtcagatcccacgtgtacgcttagcaaattcacaaatcccaacctccccgatacatacgggtctccttcccacgaggccaccagcaaccgaaatcccctcctgacctccttcctcctctctccccgattccccccacccacccaccaagcgcgtcggaagcgatggcgtcggcggcggagatgcagccgctggccccggcgggctaccgccgggcgccggagatgaaggagaaggtggacgcctccgcggtggacctggaggccggcaccggggagacgctgtacccggggatctcgcgcggggagagcgccctccggtgggggttcgtccgcaaggtgtacggcatcctcgccgcgcagctgctcctcaccaccgccgtctccgcgctcaccgtcctccaccccaccctcaacgccacgctctcctcctccccgaccctcgccctcgtgctcgccgtcctccccttcgtccgtacgtgtgccctcctccccatctgatgatgcttcggttgacctctatcttagatttcttgtgcttgatgagaaattgagaatggttttattctgtgatcggtcgtagattcatccgcgtcccgctgattagcagctggtttgatttgtaggctacatagttgaatctagatagatcggtgcgttactatatgccttgctgttggaatcaaaactttggcctctagatctaggatctaattagttcacgaattaatacttagaattagacgtagtaagttctgcatcatggatttgcccactcgcattctgaattgggatgtgaagtaaatgtttgtgttatattataaactaatgctgcaattgcttttcctataaattgtgaatagcatttctatagatcatgttcagcgacgagtttatgacaaactagttaatgcaaacgctgtcggaaaattttgttacaaatgttatgagaccttaaatgatatgattcatatgcattttggtttggccttatttgtttcccttgacatcatatgatgcgtttgtgttagtcaagtgcggagtgtgatgatatgggcatggtggggctgtctttagaagtgtagaactcttctgaacacttgtgtatccagattatttttttttctttcaattctgaaatttctgctttgtgtttgccatagacaagattgttttatcccctagttggatcaagtaggcagcacacataactgtgtaagagatagtcaatgtatttagtccggtatgagttatattttaatagtatatggaaaaatatcaaggaaagtctcaaatcttggatcagtggggctgtttttttttactccctgctttttgttcatgttagtgttgcgagtaactaaacttcttcatctgaattttgagaaaagcctgagtagatgacattgttaattgtttggtaggatggaatggttttggtgctctcagctaattttgtgttatttcttgcagtgatggtcccattgtatcattatcagcacaaacacccacacaactttgtttacctgggtctgttcacgttgtgcttgagtttcagtattggtgtggcatgtgctaacactcaaggttggttttctttcctttgcaagttttagttagtttcttcaactgccaactgtactttttacataacaatcatttgtgtgctgcagggaaaattgtgcttgaggcattaatattgacctcagctgtggttgcctctttgactgcgtatactttctgggcttcaaagaaggggaaagaatttggttatcttggaccaattctgttttctgctcttgttttacttgttgtgataagctttattcaggcaagtgtacactcattttgatacaatatacttaattcaaatagcgatcttaccattacgaaaccaccaattgtaataagcactttgccgtgatatgctgtgttgcaggtgttcttcccattgggctctggaccagttgcattgtttggtggccttggagctttagttttctcaggtttcatcatctacgacacagagaacttgataaagcgccacacttatgacgactacatttgggcctctgttgagctctaccttgacatcctcaacttgttcctttatatcctgaacatgatcaggagcatgcaaagtgataactagccagtccatcagcaccaaccagacgtattgtcaacttgctcagtgacgtcagtgtgtcctgctctattaagtactattttgaacagcgatctatataaccgtgaaaacctcgtgatgtattttgctgtcgtctgactcaaaggatgagaccgaagtacaatatatgtatagttttggttgtgttgagtatgactgtcggaaatgtgatcccatgattgtgacgtggtgccaataatttttaccctgcgatgttcgtgaatggttttttttttcgtcttctgcaagtagaggttttggttcgtaattaggctctgaatgagcccatcttctcctcagttagtggtggagacaggagatcagcaggcaagcatgtacatcgacggtaggatactgaagttcactaatgtttctgatcttcgttacagaacaatctttcagaagaagggatattttattaaccactactcttgatcttgtttgttggcaacagattacttcgctcgagctctagtgtacagaaactataccagcatgctctttttctctgaaatttgaatgaaaagaaccacaaacgccagtaatattgggatttgaacatccgaacagcaaatcaaattgtacagaggaatgaatctcaggtatatgtgcgaaaattttgcacaaattttcagccatatataagcaaaccggatgtaaagctgcagccggcgtagaagtagaacacagcagaggccagcagggaactcgtgggatgtggctgcagcctgcagcggtggccggttaagttgacgggccgcagcggtggagtgcacgtctaccacaattcatttctgggccatataaatgttggatgcctgtaggtgtagacgtaaaacacgaggcatgagagatctgcttaactccagtacaggtccaaaactcgccttcgggtatgctagcgtgccagttgatttgattccgtaattaacaagaaataaaaacaaataaaccgcggttaaacctataaacgatagcaaatcggctaggtgccgatgacatatcatttatctttgagccgatgtcatatgtaaatcgatcggcggttgtaaatagataataaagaactaaatctactcgatcggttgtagatattggcaatatataattcttatatcgatatatacttaaatcaagtgattgagatagatcggtcgccatgccgagacagtataaatcacttagatcgaaatatatattaataacatgattatatatgttcatagcatagccgatcagatagatctagcatgtatcggctaatactccgatacaactctatattacgatgttaaaacagaagctgaatatacttagatgcaataatatcttaacataaagggcatatttaacgggtcaatgaagcgcatagagcaaatatagttaaatcagataagatcggctgccctctaccgatagatgttagccgattgtaggttagatagcgatattgccaaagattatgtaagatatatgataactcgacgaattacataaacaagattagagtatcataaagatggaagcgctaatcccgagaacgcaaaccgtcatgacaatttttacctcttgttgaagatcgaaaccgatgcagctcaacccgaaagcaagaactcgtcgaaataaaactaaagcaaaagggtggcgatgcgccgaaattgtattgaacgtgtgtgttaattgattacatgaggttcggggtctatttatacccgaaaattacaaactatattcatatcggacacgattattatctctaacaatctctaagataccacaagcctttgcggcagacttttacccaaacatatctctaaggaatttacataaaatatcctaattaatagatacaattgccttctcaggactctatccatgcacggcaatcatcttgaagcatatcaacccaacccgatgttgtacaccaagtcgtattgtcggaatcagctgtatcggctcacctagtttaactcggacacagccgatcctgactgtagccgatctggactccagccgattcttgctctgttctcagatcgatcttcgccttcgactccactttgatccaatcctcctttccgatgatgatattaccaaatttggtcgttaacagtaggccacaatctcattccggcccataaattatgcccttcgaccttgttcaatagaggaattgaatgggattgaaggacaataatttctcaccacaatcctcgcagacactcacgggggattaaggaaaatttaaagggatttatttcacacgtatagaattattccctatcaataccctccaatttctttctcctggggattaaacaaaggaaaaagtacaccaaaggtctctcaacttgtcacctagttacaaaattgttcttgaactgaaaaaccggatataacatattccccaacttacaaaaccagtgcaaactaggtcctttggctgttttgactccggttttatccaacgtggcagttgactcagcgtggggcccacgtgggctccatacgtcagcctctcctcctctcttcctctctcctctcctctctctcctctccatgggcgggacgggggagtagctgggcacggcaggcaggtgcggtgggcgtgggcggcgaccttcgatgtaactcgagtccgggagccaccaccaccaccagctcgccacccacccatccatggcgaacccaaggatagccatcgcgctatggcccccgctgttgtgtcgtcgtcatcgctgttgtcgtcgctgttgcgcttcctaaagcggccgacgtcgctccccttcctgctccccctcttcgtgttcctcacctagatctgccggcccttctccccatgcgccgttgtagagaagatggggacggctggtctagctcggtgacgcctgcgcccgcgcgcccatgcacaccggcctgccgggccttttccccgtgtgccgtcgtcgagaaaatggcgacggccggttgagctggtggcaccaccgcggtcgcctcctcccatcctactgctggtcgtcgtggcgcgctgccaggatgccagtggcggtggacgtctcgtggtggccaggcaacggccccggcctccgccgctcagcgatgtccgtcgttgacgccgcgcaccccatcacagccgacgaaggggagggacgacggcgagcgggggacgacgttgcccacgaaaccccaggttttccccgcctgtcaccgaccgcagacgatgcccttttccttcttccgcctctcgggccgctccaaccccgagctcgcacacgcggcgatgtcaccaccttctccggcgtcgtcgttgccgccactccggccgccgccgctgcgttgccggctgccgacgccctcctcttctcctgcctcggcccaccccgccagcctcctccccacctgccgccagcctacacagagaagactgagttagagaggaggaagggagaggaggggaaatagagggtgatgatgtggttacaccgatatatgggtcctacgctgactcagctgtcacgtcggataaaaccagagccaaaaccacctagggacccagagttatccggttttgatagttgagggatgacttatatccggttggttgagggacgattttgtaatccgatgacagggacctcatacgtactttttcgttaaacaaacaaggccttaacatgtcccaatcccgttctggtccataaatacaagagtgaccggtccggtccatccagtatgggccacacgttcgctgtaatacctttccagcccatgatggatgggcctcacgtaacacgttctagcagcccacaagttacgggccgcacgtatgagcgacaaccgcgtttccgcaagatcgagcagagctgcagaggaagccaaacgttttatcttcttggctaccgatgcatcatgcatcatcctactatcctagttctaagagcaagtataatagaatagtccactactaactccaattcatttatagccgatctaatagttaattcatataatagttgcttactatactattaatatatggtctcacctgtcatacatacattgcgtcttaaagtctatactgtagctagctatagatctgtagctcgctactcttctttcttatattttatctcattaaaatatatttttagctggttaatagtgtgctattgtacttgctctaactagtttaggatcgccttaactttggtattactgagtacgttgaaccacaaaatcccgaaagaacatgctactccggtagtactaatgaactggaatatcttgccacgccttgccaccctaactcagaatgcaagaacttcacataaattttacaaaggtgtgtttagttcatgtcaaaattaaaagtttaataaaaaaaaagttgaaaactaaaccaggctttaatcttaaatacgcactccgtccatagaccatagaacaattttccgcacctttaaactttcatccttttccattccgttacctcgagaagccaacaccgaccccgcggccccgtccatccccttgggaaattgcacgcgaatgattgcgccggagcctctcttttccccgtgagcgatccagcgccggtcttttccgcggccgcgggccccgtgctccccgcggcagcaaaaggcgcacacacacgcaaaaaaaaaaaaaaagcggcatcacaccaccgtgcgctcgcgcgggcggacacgaatcagccgtcacgtcgcctcgtgccggcgattcccagccatccgcgcaaagcgagagcacgaacgatcgcgccggcgcccttttttttcccctcccgagacagcggctgtttgctgggcaagtactgtgcgtgcacgctgcacgctgttcgactcacatgaaacccaagttgccgatggtcgatgggcgagcagacaagcaggttccgcgagcaaaactgagaagccacgataagaattcgatctaccggcgggagcgttgggtaaatagtgccagccatttttgatcaggaatgatgacgttgtgctcatattcttcatcggtactctctccgcctccataatataagagattttagagggatgtgacaaattccttatattatgagacgcagggagtaacgaagaaaaagtagcagagataaattcatatgcatcgttcttatgatagagagaaccttatgttactctactggaaagttagagagcactaaggccatggccaacgctccatgctagagcgtggtctcacccgcgaatattcgcgtcgcgtggtctcacccctcccgacgcgaatattcgcgccagctcggccgggaccgcgctctcgtagagctccctgaccccccgcatagcatcgcatagtttcattagcttttggcgaggaacgggcgagcagccgtgttgggggagaggcgtcgctccgtaccgtaaccctggaacgttgtagccaactacctcccgcgccaaggccaaaaatggcgaggaagtaggcgggggagaagaagatggggcaccgccgctgccgccgcatctatccggcgctgccgcgcctcgatccggcgccaccgcagcctccatccgccctaccgccgccgcctcgatccagcgccggggagacaggtggcaccgccggagaggggagcgccggggagagagggccggggaggggagaggcgacgcgctggggagagactccccggcggtgccggcgaggggagaagcggagagaaaggagacgcagggagagattgggtgggagatatggtgatgagaggaggggttgacgtttatatatgtttgtgatttttagagggtatactgtaaatattggacgtatatgcaaattaaaataatccaagggtttaaaagcaaaaatatgaccgactaacatgtactgaattaaaaattaagatgggggtatggcttacactgtgcgagggatatcactggtgtgattttatcctatttagcatcacccttttttatgagactatactctgcgttggccatgccctaataagatgggcagatgtaacggttttagtttcacaagagaacctcagacccagaggtgtgacttttatgcgattggctgtgtatggcagtatatggccatatggggtacggtccagacatatcagactgttgaaagaatgcgttaattgagcagagaaatcttggccccctgtagtgactatcggcaagattgtactatcatcatactatgaatggagaatattgaaaaatgaggattatatgtgggccttcatatcaacttatggtcccaatctggtagtgttcattaaaatctctttatatctctcatgaggtataataaagccacagctcttcggaacaatcattacctaaagaatttttgttttcccggggtcaagggtaataaaagaaacaattatggctacatctgattattagtgatagtactacctactatcttcattcataaatactccctccgtactcgtaaagaagtcatttagaatagcgacacggtctccaaaacacaactttaacttcttgtttctataaaaatatttattaaaaagtgatatatgtatacttttatgaaagtatttttcaagacaaatctattcatataatttttacatttttaaacttaataacttgagagttatttatgatttatatttctaaggtttgatttaaacattgtcatcaatgattttctttacgaatacggaggaagtatgatagatccgtgcattgaaacaccatagcaatcggaaaacatcatagtaagaaattagtacgatcaaacgcggaccaaacagacggcacagaaacagatacgtgatgagaatacatgcaagagttgctcatggccccgaagtccatatacaaagtttacaaactcatcgcagtcttttaccttttttttatttatgctataaacctaattaagttaatatctgaacttacggtctgatctaatctacaacaatactaatctagattgcatataaagaggaaagtccatcctattagcttaattttatttggcctcagaaacatattctttgttacgctagtccctcttttttttttcctgtgcattgtctaagagtaggaccatgtaaattaacgcttgtatactttttttatattgtttcaatctaaagtttgctttgcaaaacatgtcatcataaactttggtttgcaatttatttaacgcaaaaactaatcggcgaggcctttcgatattgtcttatcgcgcaacgccaaccatagaagccgtggagaagccagcgcacatacatgtcttttttttctattacacatacatgtattttttttcctcttcttacaaagttttctctcaaattacttattcgatctataatccgattacatgtgttcgttgcaattaaatcttcaaaactagatcttacatgattatactgcaatgaaaaaatatttatatttgtaaattacttttattatatacttaagttacttttatcatatatataaattactttgagatttgactaaattactatttatatattcataatgctttaagttgattatgtttattatagtttttagtcaattctataatttatggactttaaatttaatttttagatacaaaatatttttctctcgaatttacttttaatgttgtaacaacttacttctattttgtgctaacttacttctattgcatagctaagttactactacaatttaaataaattacttttaaattaatgaaatgtttaaatatattcaacatggatcttgttttgtctcatattttacgtagagtataatgatgtaaatagatcatgaaaattatacgtgatttaaaagatataagttattaaagagcttaaatctgaaagtaatttatgtataggacaaaagtaacttacatatataataaaagtaatttacaatatagatatttttatcagaatataatcgtgtaagatcttattgtaaagatttaattgcaacaaccataatggtgtaatcggattatagatcggataagtaatttaggagaaaattctctaggaagaaaaaaaaagacatgtactgttgagtgtactagtaactgttttttggaatagaagggcgtcgctggttagcaatatgccgctagcgcgcgatctagccgtatcctttatttaaatatgcatatgggctgagcgattcaagatatatccatccatgcgagaccaaacttatagccggaacggaacatcggagaatgtttcatcgtacaactatcgtaaaaaacatatcatacgtatagcagccctcatagcaaactcataccaatgttgctactataattccttgataagtaactgataagcgtggaagagggtaatgacaaccataaaaaaaaatcatatcttctatatcaattttgatggtggataacatgcggcccagttgcctaattgttgacttaaaagctcaacaaaaagtaactaacatcgaatgaaaagaaagacaaataatcactccgtcaacaaaaataagagatacaacttatttagacatgaaccctattagtaaatcttgattcaaagttgacgaaaatccatataaccatagtctctaaattttggcatgcaagaaaaatggattcctttttctcatcacacctttgtagattggcctaaaactagtctctggattatcatttcaactttttcatgataaattatccttggtaagagaacttattccgtagattgcatcgcatacgtgttcgcgaaaaaaaattgcatcgtcgcatacaatgtgcataacccttcattgtacctgactgaaaaataaaataggtctagaaacaaagcaacagctttgtgtaaaaccttttaaaaacaaatttgtttaacaaaaatctaaaaggccatataattgatgcctacaaatctgcagttgcccaattaggcaacgaccttgcccaagcagatatggtttataaatgacctctgaaaaagcaaaagtgaggttcatgcgtactttgtgtagcttctatgagaggtttgtcgcttaaaggctaacgactgttcatgatgcaaagcaaacataagctaaggctggacgacggcaaagtgatcttaaaagcgccttttaaatttgtgcaaaatttgcaggaatgagctgacgagaatcagacaggcaccatatgatggtacagtacttctacgtttgctatggtataattaaagtgtagagattgcaagtctgtggtgtactgagacgaactaaagagcaggggaatatagcattatttatcaaatattccaatattgcttgccttggcaggaatataataaagtaagtacatacatgcactccactggttggtctagcttttcggtgaaatttaccatcttattccaacttgatcgttacgggtgcctgtaataagcaaatagaataaaactgagcagaatacctatacttgtatgggaaactattataaactctcgagggaatgtctccttgttgtttacatctcactcaaatagttataaaaaaaataagaagatatattaatatgtaatatattatttcacaaacatataacttaaaaattcgacttctacatatcgcaacaaaaaacaaattaaactacagctagttaacatatattcacggtcaattttttctctgttgtgatgtattgaagttgaatttaagttctatgtttgtagagtgatatatcacatgttaatattttttttaaaaaaaataaattcataactatttgagtggtatgtaagcaatgaggggatgtcccttcgagagtttaaaatccactctcgtatttgaacatgtgaaaatcatggagggcatacgatttagcaagtagttagttaagagcaacataagtcggacggcttttagtattgatatatgattttcacaaattaataattctaaaattcataattactacatatgggacttagtaccggatgaaatacattatagtttgtattcttagtgacagccactactacgaaaaccatttttcgtggcggccattttggatttttgatggcagaatttgcaaccgccacaaagcaaaggccagtgaaaatcaagatcttcgctagcggttattgaccgccagcaaaaatccaatttcgggcggtcgtctttgagctagccgccagcaaaaaaccattttcgctagcattggcttaagacggccgccagcgattcgctggcggctgtgttaaatcggtggctgtgttaaatcggccgccagtgaaaatctattttgagcccaaaaagaaatacccatgcagctatacagccgccagcgaaaatacccatgcagccgcctattgattcattaatttcaaaattcaaatccacatctagattcgctgctcatttccaaattcaaacatgaaatacaaaatcatcatcagcacagatcaaacatcatttacacagatcaaaacatgtgcatcatatggaacaacatgcaaaaaaaagaaggaaaaaaaaatcaaatatagcagcatggtcggaggggggagccgcgggagcacggtcgacggcatcgaggtcggtgccgccctccccgtggtccggcgacggctgatccagccttcccgtggccgagcggcggcggatccggcctccccgaggcccggcggcggcggatccaccgtccccgcgcacctgagctcctccccccgctcccgagagccgctgcccccacgcccgagagtcaccgccgcgctcgcgcccgagctccgccagcacccgcgcccgcgcctgagagccgctgcccgcgcccgagctcaccgccgccttcgccgcccactccgtggagggagagagggagttagaagaggaagagaatggggccggatcggcggtcgtatgcggcggtggagctgcggcgacggcagccggcggtggtggggaggcgacgaggcgcggcggtggagaaggaagggaggagagacggagaagggagagaggcggactgggcgatgggaagggagaagggaaaagggataaggacggacttggcggtgggcggtgggtggattttgttcgcctcaaaaaagttttgtagtggtatttcttacctaccaccagcgaaaacgtgactttcgctagcggacacttaagaagtccgcctaaaaaaaatagagttttttttatggcggacctctgagcgtggccgccagcgaaaatcggttttcgctggcggtccatggccccccacccctcgatatgtttttgctagtggttttcgtgtatggccgccaacgaaaataatagaccaacaccatgaaaaatcgtttttctagtagtgagctattccatgtttggtaagtctaaaattttgaagtcctaattatagatttagcatgattccaaatatgtactagtatcgagttgtactcgattcggggtctgaattgtagccattttcatgtttatcagtattataaaattcggagttaatattatcaaggttgtatggactttactatttttaatgactagaaaaagtacccgtgcgttgctacggaaaaactaaatcgtggcatattttttatgcagtatttgagcattatgaattgtgaaattgtctcacgtggctggttattgcattgcgatggcttcatcctgattatgaaaatctcacaaaaaaaaacataataggaatattccaaattcataaatgatagaaataacatgaagatatgtctacatgggtgtttatgcagcaacctttgaaaaatagccaagctgtatcatctcatccatatcacaatcggatcaggaagagcatgcagccgatgctagctgcgcttctttctaaactaataaagagaaatttacgtctgtgcagtatattctagtacgaatcgatctgatgacctgttctcttcttctatacatgcgagcaacaaattcgagacatacatgtacatgtatttgagacttttttttatggcgattaaataggatacggatttgaagtcggactatcgtatccgtactcgaatcggacgacataccaaacaatcatcaaaagattcgagatcaaaaccttatcccctgtgtatgtgttcttaagagagagaaaatcgtgctcctaatagtgctcgaagttactgtagctgggtgatatagttcaacgcattttcaatggcggtcgtcatatgtcggttcgtttgaaccgccatagaaaatgatttgaggtggtggagggttaagatggccgccagcgaagatgtaggtatcttcgctggctgtcggtgatatgggcccgggggtatcaggtttagagggaggaggctgccccccgatgccacgtggccctcccccgaggggagtcaggcccgaggtaggacggtggccactccttcccagagactggatggaggaggctgtcctccaatgccacgtggctctcccccgagaagggtcgggcccgaggtagggcggcggccactccctggccgagactagagggagaaggccgccccaggtgccacgtggctcccccctgaggggggatcagacccgaggtcgggcggcggccgccccctcccgtgactaggggtcgggcacccccgaccccctctctaggtcaccacatatggtgggttaggtgtccgccttcaggtgtccacctacccgcatttatggcgtcccgagcggtcgcgccatgccgcatttaatgcagcgtgcagtgcactcaactggtctgtgatcggtcgaatgaccgatgggactggctagtgcgcctgtgcgctgctcgtgtgtcaggcggcgtgcagcctgacatgtcccatcaaatagtgatggtgagaggttctcatcctcttatcccagccggagtcggtcctgctgctctggtcaaagcaaggcttccgtttcccggtataataggagcagagaagtcttcacccattaaatggtgactgacagtggcaccccccgtgtcaggcggcaagatttacaggcctcatcatcaagacgacgtgtgcttggcttcccaagtcaagagacaagacatgcatttaatgcaaagattataatacttctccaccggagctaggttaggttgttgggcccatgtggtaaccccttgaggtataaatggaggtccaggcctagtggtggaggggggacttcggagcgaactggcgcttgggtctcacaaccccaagcacttgtgttctatattcaatcaatcacgcacaggagtagggtattacgcttctcagcggcccgaacctgtataaacctcttttgtttcatcgtcttgggagggtctaaccccctcaagatcacacagctccgctcaccaagccctcgaatctcacccgctgccccaggccgaactcacaaaggggggcctcacggttccctggtggaggagttctttctccgacatctggcgcgccaggtagggggcgcgttcgtgatttttgaggttctttcgagcgccggcatggtgagtgtcgcgccgccgctacgggggaaggcgcagcatcctcatgagtgtcgcgccaccccaggcagggggcaaggccccccacatctccaccaggtaagcttggctaccaggtctttgtggcgagtcttcggaatgtccgagggcccccaaagctccagccctgcctcaccgagaagtacgacgatggcgccgacccctccgagtccctccagatctgcacggtgatcatagaggcggcggggggtggcgaccgggtcatggcgaacgtcttccccatggccctcagtggccaagcgcgaggttggcccatgaacctgctgccgcctcagttcactcctgggaggactcttgcagttttgagctccgggtgtcgtcgaagcccgggaccacctgtgctggctcttctgtagcggctggctttggtcccgccggctggctacgatgcccggcccggctcaactgatcgtcctttcaagcttcaagtattttcaaattttcaattcattagcttgaaatcttatatttatttccccccattctattctcatggccctgaaacgcccgcgtattgcgcatttgtttgctccctcggtggtaagagcacaacctctctcccatctacatgaacgattctttgctaagtgtgggggctaaattttctagccttatcctagccttaagttgagccccgggtgccatcgacgcccgggaccccatgtgctggctcttccgtagcggctggctttggtcccaccggctggctacggtactcggcctggctcaactgtggacagggattgctggctctagagttttcggctctcacactcgtgcgaaagtaatcgtccatgtagaaggaaaagagattggaaggaggccactgaaaggaaagagcaaacagaatgtgtagcgtggggacacaggctcgtgggaacctgacctcgtttgctaagtggtcacatgtttcccaagatggttcggaacccatggtgggaggccctcttcgagctaaaggtttgtgtttgcttcattcatacatgcaattctttgctataagtgtgggggttatgattccaagctctatcctagccctgcgtcgagctctgggtaccgtcgacgcccggggccccctgtgctagctcttccgtagcggctggctttggccccgtcggctggttacgacgctcagcttcgcttgatcgcaggcgaagattgccggctatagaaagttcagtcctcacactcacgcgaagataatcgtttgcataaaattattattgcttatatttatctctcgcccatctcttcctcgcggtcctgcggtacctatgtgtcgcgcgccggcttgactcccttggtaacaaaaagtttgtattcgcttcatccattcaaacgattctttgcttaaagtgcgggggctacgattcctagctctatcctagccctgcgtcgagctctgggtaccgtcgacgcccggggccccctgtgctagctcttctgtagcggctggctttggccccgctggctggctacggcgcccagcttagcttgatcgcgggtgaagattgctggctatggaaagttcaatcctcacactcacgaaaataatcatttgagtagatgaagtagaacatgaacagaggttaacaaatggcaggggcaagcgaggtacgtggcgtaaggtcacgggcccgagagaatataacaacgtttgctaaatatatacagaaaataagttcatagcctaaggtacgggctagcgagtcgccctcaggctggggcgaaaaaggcgcatgggtcctagtgccagcaaagaaagaataagagatcgggcccacatatcatcagactaggaaagtggcgtcaaccctgaccacctggggaaggttttggtcagggctaacgccaggggctactgtcggtgatatgagcccgatagtatcaggtttagagggaggaggctgccccccgatgccacgtggccctcccccgagggcagtcaggcccgaggtaggacgacggccactccttcctagagactggatggaggaggctgtcctccaatgccacgtggccctcccccgagaggggtcgggcccgaggtagggcggcggccactccctagccaagactagagggagaaggccgccccaggcgccacatggctcccccccgaggggggatcgggcccgaggtcgggcggcggctgccccctcccgtgactaggggtcgggcacccccgaccccctctctaggtcaccacgtacggtgggttaggtgtccgcttccaggtgcccatctacccgcatttatggcgtcccgagcggtcgcgccacgctatgcggcgtgcagtacactcaaccggtctgtgaccggtcgaatgaccgatgggactggctagtgcgcctgtgcgctgctcgtgtgtcaggcggcgtgcagcctgacatgtcccatcaaatagtgatggtgagaggttctcatccttttatcccaaccggagtaggtcctcccgctctggtcaaagcaaggctcccgtttcccggtgtaataggagcccagaagtcttcacccattaaatggtgactgacaggggcaccccccgtgtcaagcggcaagatttgacaggccccatcatcaagatgacgtgtgcttggcttcccaagtcaagagacaagacatgaatttaatgcaaagattataatacttctccaccagagctaggttaggttgttgggcccatgtggtaaccccttgaggtataaaagaaggtctaggcctagtggtggaggggggacttcggagcgaactggcgcttgggtctcgcaaccccaagcacttgtgttctacattcaatcaatcatacacaggagtagggtattacgcttctcagcggcccgaacctgtataaacctcttttgtctcatcgtcttggtggggcctaacgcccttagatcacacagctccgctcaccaagccctcgaatctcacccgctgctcccggccgaactcacaaaggggggcctcacggttccttggtggaggagttcattctccgacactggcggtccacgtcaccacaccaccagcgaagatatggtatcttcgctgtcgtcaacttaagagggccgccagagaagatatcctatcttcgctggcggccggcttaagatgaccgctagcgaagatgtgtttccgctggcagcccgtgacccccacgattttttgtgctggcggtttttccacttagccgccataaaaactattttccaaacgccatgaaaaatcgtttttctagtagtgacatcttcaatttgtataatagtagagatttattaattcctaaattaataattaatgtatatctaattatcaaaatttaggtgaattttgacgtggcaacaccatctagaacaaatgactttttgatatagcacactattaaatataaatattcgatcacaataatatgatctatctaattacaatattgattggttaatgtgtcaactcgtaagaagtgttcgtatatacatatctatagtagtataaaagacactaaagatgctgatgcataatatcaaggacactctaataagcaaataaataacactagcatattttttaaagaacttgtttatgttatatattattgtgtattttattttgcccacaataaatcatgggtattttactagtaaatataaatatatagatagatagatttctgcgtgttctcatgcacagcaatttctacagcccgcacgaaatctactacaacggtcctttggcacgatttggcaccaacggcagcatacgctcgctccggcgagagctgggggtttttgtcgtctgtcgactgtcgctgaccacctcattaattccatctcttcgtccatggagtacatcggtataccgcggcacgtcactgcgagcgatcgagcacgaacacacaggaacgagctagaaatattacgtacgagctgcatatatcgcgatcgcagcgactagcataggatagatcgcactacacggcaatacggcacggcgcggctcggctcggctcggctggttccgtgtgcgtgcactcatcatcaccctctcacccatctctctcggtcgacctctctctctcccggccccctccgtatggccggtcgatggggaaaagctaaccgattccgatgccgttgcaaagccgaaacgtacgcatgctgaaaaagcaattaatctagtatctgctactgccttctcgctctcgccgagcgggcggttgcactccctactgtgctactgtgctggtgcgtagtgtagatcaacctgcagatgccggtgccagcctcgcgcgatctcgatcgagtgcatgtcatcttccggtccatggttgatttgatcattgaggtgcagcggcagtacagatcagtggccgcgggccagccagatgctcgctaattattaccctgcagctacgatcgacgaggccatgtaccggaacggaaaaacgtatttctttctacaggtagtttccaaccggcctagctagatagctacttgtcctgtcaaatgtaacgctagctgctagcggcatccagtacgagagcatataattaacgtgcttttgtataggtgtactttggtttgctgctgatcgatcgcgatcgatctcgtgccgagaactcgttgtcatgtgtgttggcgatcgatgctgcactactgcaccggctagctagatatgtatacgtactggcagtgtcatccgaaactgcgcgtgtattgcgatgccaataatttagccggaatatataccccgagaaaaagcagaggatatatatagtactgtttctttcatacatagggccgcatggtgtaggtgtattggttatttggtttggtgcatgttggaattaatagatggggtaaggcctatttaaagattaattctttggaaaatcacaaaagcctatctcatgagatggcatgcatgtcgagtttagtaccaccttacttattctagaagagggggacctccttaaaagggaggatgccctcctagccacttgaagcatgtgtggtggagagaagagggggaacacgcgctcgctcgctcactcgcctcgcctcgtctagcagggcaggtggcggcgcgcgtgcacgacgtacgcgtcgaatggtccgcaaaattggctcctcacccttgctgcagatgcagcctccttttgcagttttgttttgctgcaggaaaattcggatttgttttgttttggaaacattccgaaaaattcggtgcgtgaaaacgacatggagtccggataagttacgcgcgacttatccggttcggttacacggagtggagatcgtgcgggcgccctgattaagcgacctatctctatataaaccgagccgccgccttcacgcaaaacacacaaaatcaatctagggtttgcctcctcctctgtgctgcgccgtcgctcgtagactactccatcccgctcgtcggcgtgcacctgcgatcgggagagcaggtctccggaacctctgccttcgacgtcctacactgggagaaggcggcaataaggtttttgggaagcgcttcgcgcgactgctccctgttcatccgcgacggctcgccttcctctccgctcacgtgctgcgcgcctttgtcgctgctcgcaaccgcgagtagttcctgccgagcaaccggtctttccgtcacctcggtacgtgttcgacatgttgcgcatatttgatctgttcatgttttactgcttagtttacatgtgtagatctaatgatgcgttaatgctattatacatctgtaatgtcatgatttatttatggaatatattaaatcattatatgcctatattctcaacaatccaaaaaccttattataggcgctgtgattttactatggctggttttgccgatgcactgaggccggataaatttaccggtgtgcactttaagagatggcagatcaagatcactctgtggctgatagctatgaaatgcttctgggtgagtactggcaagcctatgggcgttcttaatgctgatcagcagaaagaattcgatgaggccactactctctttgtgggatgcattcttagcgtgcttggcgatcgtctggtcgaggtgtatatgcatatcaccgatgctaaggagttgtgggatgcactgaatactaaattcggtgctactgatgctagcaatgatctgtatatcatggagcagtttcatgactacaagatggctgacaaccgttctgtagtcgaacatgctcatgagatacaaaccatggctaaggaactcgaactccttaagtgtgtcttacccgataaatttgtggccgggtgcattattgcgaaactacctctatcttggagaggtttcggtactgcactcaaacacaagagacaggaatacgatccgttgaggggttgatagcgtctcttgatgttgaggagaaagctcgggaaaaagatgtcgcgtctaagggcgatggtgggcagtccactgccaatgttgtgcacaaggcccagaacaagagcaaggggaaatacaaagctcagcagaccaccaacttcaagaagaaaaacaacaacaacaattctaatcaggatgagaggacttgttttgtgtgtggtcaacctggccatctggccaggaagtgtccacaacgcaaggggatgaaggcacctgcagggcagacctctaagtctgctaatgtgaccattggcaacactggagatggaagcgggtatggtaatttacctactgttttttcagttaatcagtctactaattggtgggttaatacaggggccaatgtacatgtttgtgctgacatctcattgttttcttcttatcaggtcgcacggggttccaccgtactaatggggaatgggtcacatgcttctgttcatggtgttggcacggtagatctgaagtttacttcgggaaagatcgtgcagctgaagaacgtgcaacatgtcccttctatcgacaggaatcttgttagtggctcccgtctgactagagacggatttaagttggtttttgagtctaataaagtagtcgtgtctaaacatggatattttatttgtcaaggtcatgagtacagaggcctgttccgcttttccctttctgatttctgcaataagtctgtgaaccatatttttggcagtgtggatgatgaggctaatgtatgacactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctgaggacaataacttggcacctctagaactcctacactcagatctctgtgaaatgaatggggtgttgacgaagggtggaaaatgatatttcatgacgttgattgacgatgctactagattttgctatgtgtacttgttgaaaacgaaagacgaggctctagactattttaaaatttataaggcagaagttgaaaatcaacttcacagaaagataaaaagacttaggtctaatcgtggtggagagtttttctcaaacgagtttgacttattctgtgaggaacatggcattatacatgagaggacgcctccctattctcccgagtctaatgggattgctgaaaggaagaaccgtacactgatcgacttggtgaatgccatgttggacaccgcgggattacctaaggcatggtggggggaggcattgttgacctcgaatcatgtgttaaacagagttcctaacagaaataaggacaaaacaccatatgagatatggattgggagaaaaccatcactttcttacttgcgcacatgggggtgcttggcgaaagtcaatgtaccaataacgaagaagtgcaaacttggacctaagactgtggactgtgtctttctgggatatgctcaccacagcattgcctatagatttttaatagttaatctgaggtacctgacatgcatgttggtacaattatggagtctcgtgatgctaccttctttgagagctttttcccaatgaaggatacacatagtagttctagtcgaccctctgaaataatacccagttcaatcacaccaccagaacaaactgaacatacacatgaacatgttacagaggaggatgacagtgaagctcctcgaaggagcaaaagacaaaggacggctaagtcttttggtgatgatttcactgtgtaccttgtggatgacactcctaagtcaatttcagaagcatacgcatctcctgatgcagactactggaaggaggctgtccgtagtgaaatggattccattatcgctaacgggacttgggaggtgaaaacctgtggggtgcaagtgggtgttcaagaagaagctctggcctgacggtactattgaaaagtacaaggctcggcttgttgctaagggctatactcagaaagaaggcgaagatttatttgacacttactcacctgttgctagattgaccacaattcatgtgctactttccctagcagcctcacatggtcttctcgtttatcaaatggacgttaagatagcttttcttaatggagagctggatgaggagatctatatggatcaacctgattggtttgtagttgaaggtcaagaaggcaaagtgtgcaaattgttgaagtctttgtatggtctgaaacaagctcctaagcaatggcatgagaaatttgacaaaacattgacatttgcaggctttgcagtcaatgagacaaataaatgtgtatactatcgccatggtgggggtgagggagttattctgtgcttatatgttgatgacatactgatatttgggacaaaccttgcgtgataaatgaggttaaatcattattgtctcaaaattttgatatgaaggatttgggagtagctaatgttatcttaaacattaagctaattagaggtgagaatgggattacactcttgcagtcccattatgtggagaagatcttgaatcgctttggctacattgatagtaagcttctccaacaccttatgatcctaacttgttgcttcgcaagaataagagaattactaggaatcaactagaatactcccaaatcattggctcgctgatatatctggctagtgcaactaggcctgatatctcctttgctgtgagcaagttgagccggtttacctctaatccgggagatgatcactgcgtgcgcttgagcgagtaatgcgctatctgaaaggtactatggaattggggcttcactattctgggtatcctgcggtattggagggatatagtgattctaactggatctctgatgtggatgagatcaaagccactagtggatatgtctttacactgggtggtggtgctgtttcgtggaggtcttgcaaacagactattttgacgaggtcaaccatggaagcagaactgacggcactggatactgctactgttgaggcagaatggctgcgtgatctattaatggatctgcctattgttgaaaaaccggtgccggctatccttatgaactgtgacaatcaaacggtaattgtcaaagtgaatagttctaagaataatatgaaatcgtctagacatgtgaaaagacgattgaagtctgtcaggaaactgagaaactctggagttataacgttggattaaatccaaacagttagaaacctggcagatcctttcacgaagggactatcacgaaatgtgatagataatgcatcgaaggagatgtgtttgagacccatgtgagttatactatggtggtaacccagtctatgtgatcggagattccgtgaattagaacctgggaagaacaaaccattagtaaactagaggagagtaccaatctataccctctctaagtgaagatgcatgtactctcgtgagctgcaaggcaggttggctatgccttaatgagttctgttggctttaattagcgaagatgctgtcctgcaaagcattcatgaaagaactcacctttgtaagcttgactgttggtcgcagtctatgaagattttgggtgaatcttctaggaagcttactaaagacctaggagtatgacttatatgctccacccgaggggtagtctacagacggtctagtaccagataagactttgagtgaaacttgcttgcacaagacatgcaattcaaggcgtagtccattgttcaagttgtgagtaagtgtagcttggagttctaggtggatgttcaaccttgatcagtctccatcgaaccgttggtatataaaagtacattggaaaaggcaaatctcagtgggattttgagatttggtgggggattgttggaattgatagatgggctaaggcccattcgaagattaattctttggaaaatcacaaaagcgcacctcatgggatggcatgcatgtggagtttagtaccaccttgcttattctagaagagggggatctccttaaaagggaggatgccctcctagccacttgaagcatgtgtggtggagagaagagggggaacacactcgctcgcctggcctggcctggcctggcagggcagg

SEQ ID NO: 59340 - DNA, 14723 bp, Oryza sativa
agcttgcggaggtgggggaatggggggagaggaggcggcttggggtgggcggaaaagaggaagagggacttcatcatttggcgagaggaggaagagaggcgaggagaggggggtttggggcgatgagacgatgggagctcggcccgctcggggcctcggggtagagacggcgcaggtggccggccgagtagtcgatggagggggatatcttcctctgaatatcgattcccctggttttctttataataaacagttattaatccgtttagtatagttattactaatattttaaaaaaaaattgaggaaaaaaaagactctagccattacctgaaatattttttctagaaaacaaccattttgtagaaaaagatttaaatctcgaaaaaaatgccccacgttccaattgaagggtattcagtagtcactttgttattctgacaactttctaaaatccgaaaagggagttgtcagggttacgggtcaggcataccccctacccttcgatatacgttacgtgtcgacatggcatacccacgcgcacgcggatatttcctttatgatctaaggaaacctttcacgaaatcaatagacgggaaaagtccttctcggataagaaccgggttacctacgtatcgtgctaggtctggtatattcgagtcctactcgaagagcactagacctgcgatataaaagggaccccccgaggagggcataggggatcgaatctcagagccaacacaacccacacagcctacgaagccggagcctgtgaggagccaagtcgtcgagagctagtcgaatcaactcgactacaatctcgccggatctgacaagttccatcttttcctttgtaacctgtgttttccaccatataatcccatatcaactggattagggctattacctgtcaaggagcctgaaccagtataattcttatcttttgattgctcgatgtcgtactacgtagatccttgtaccagcgtaccccaataccctctatatccggtctgcgggtatcacccgtcgacagtggcgcgccaggtaagggcacttggtactcaaggttctactactatgccatcaagcttcgtcgacaacaacgtcaacaccagctccagccaagcactctcaacttcaacaatgctggtatggactcaagtcggcgaaatcgtcttcccggtttacaccacgatgccgatctcaatcggtccttcaatgactgaaaacgagaacgcagtggctacgaaccaagacggctctatgtcgaaaaatccacccgttgaaacggagaatggattaccgactacatccaaactcgggaaggattctgatgcggccaagtcttgtccctccgacataaatcacgggccgacaaagatgacttccgaagctatcaggtcttggtgtcctatccacaaaaccaagaaacatacccttcaagattgctgggtattcatcaacgtccgtgctgaacttcgcgcctgcaaagaacgtggaattcagcgtatttctccaactcgggatgtctattgtcctatccaaaagacaaagaatcacgatctctcgagctgcaaagttctcctcggcgccatgaaaaccccgtctcctaagtcatacgtccccgtcagggataacggcaaggaacagggagcgactccagcctcagatcgattcgttggggtaatcgatctcgatcctcacgaaccatcggtcttacatctcctcgaagactacgggtcatcgacaacaagtgcgccgcgggaggtactagttatcgatgacgttggcacgacagcgcaagccaacgcagaagcggcgaatcaatcgattactccagcccagcacatcagggctattcaagctatactgagggaaactccttacgatcccgttctgaacgacgacctcgagcgttggacagaacgattacgggagtcggtgaccaacctcagcaatgcattcgaagaggccgttaccggggcacaccaagatcagccaccaatcggcgaccccaatggtgaagatccggagcggagggaatcgcctcgacaggctacccctccacctcgtggcactggcgatcttcgagatcaaattaatggtcgccgagaagcacggcgcacacgggatgacgcaaatcgctctcggcgtcatgtttcttcacggcgccatgatcgaggagaccgcccaaacgaggaccgagaatgcaacgatcgcgaacggcgggggccagacaatactggtcatggccgtcgccgcaacgacgacgacgaaggagatcggcgtcgaaataacagcgagagacaacgacaagattcctgggatccaggtcgtcatcctcgtaatcgtacgccggagccaagcgacccatcgtcatcgtcatcatccgcgtcctcttcatcatcagacagacatccacgaaggtcacgcgaccgccggcaacccaccgcccccagtgctgggtgtagagcttttggtcgttccctacgtgatgtctgacggcctgagagattccgacccggggccattgaaaagtatgatgggagcaccgacccggaagaattccttcaagtctactcgacagtgctttatgctgccggagcagatgacaacgcgttggcgaactatttaccaactgcgttgaagggttctgcacgttcatggctaatgcatcttcctccctattcaatctcttcatgggcagacctgtggcaacagttcgtcgccaatttccaaggaacatacaagcgccacgcgatcgaatacgacttacacgcgctaacacagaactcaggggaatcattgagggaatacgttcggcgcttcaacgagtgcagaaacacaattcccgaaattaccgacgcttctgtaattcgcgccttcaagttcggtgtcagagatcgctacactacccaggagttggcgacaagacgcatcacaactactcgaagattattcgagatcgttgagcggtgcgcccatgtggatgacgcgctaagacgcaagaacgacaagccgaagactgggggagagaagaaaccaaccgcagacgcctctgagtcaaataagaagaaaaatcgcaaaaacgggaaaaggaaagctcaagcggaagtcctcgcagcagaatacgcgaaccctcccaagcgcccagacccacaagccagcgatacaaaaaaatcatggtgccccatacacaaaacggacagacattctctggaggattgccttgttttcaaaaagtcgctcgagaagcacatgacgtttgaaaaaggcaagcgagtacgcgttgtcgagaagaacgaggagacacctcctcacgaatcggattctgcgtacccagactccgacctccatgtctcacacatcttcggcggctccacaacgtactcctccaagcgggaatacaagaaagtggaacgtgaagtctattcgacatggcagggggctgcacccaagatgaagtggtctgaacagagaatagagttctcggaggaagaccaccccaagacctctgttagcccaagacgatatccgattgtggtcgaacccactattcggaacatcaaggtagcacgagttctcatcgacggtggcagctcgatcaatctcctcttcgccagcactctggatgcaatgggaattccacaaagtgagttgacaccaaccgatcaacccttccatggaattactccccaatcatcgtccagacctctgggcaagattacgttgcccgtgactttcggccaagccaacaacttccgaacagagcagatcactttcgatgtcgctgaattcgatacaacttacaacgccatcatcgggagaactgcacttgcgaggttcatggccacatcccactacgcatatcaagtgctcaagatgccgggaccgaagggaacaatcactattcaggggaacgcaaagctggcggtgcagtgcgacaggcagagcctcgacatggtcgagcaaacgcccaccccacccgccacgtttgagccacccaagaaagtgaacaagcaaaacaaggcgcccaagccggacggcacccatcaagatcgttccgctctccagtgctaaccctgacaagactgtcaaaatcggggctacactagacgagaaaataggaactcgcgctcatcaccttcctccgcgataatgccaacgtgtttgcttggcagccgtccgacatgccgggggtccccagggaggtgattgagcacaaacttatggtacgacccgatgccaagccagtaaagcagagactgtggagatttgcaccagaccgaaaacaagccatacgagaagagctcgacaaacttctcaaagctggcttcatcagagaattacttcatccagagtggctagccaacccagtcatggtgcggaaggccaacggaaaatggagaatgtgtgtcgacttcacacacctcaacaaggcgtgccccaaggatcactttcctctcccccgaatagatcagttggtggattcaacagccggttgcgagctattaagcttcctcgacgcttactctggctaccaccaaatcagcatggcaaaagaggatgaggagaagacagcgttcattacgccgttcggggtattttgctacgttaagatgcctttcggactgataaccgtcggaaatactttccagcgcacggtccagggcacacttagcaaccagcttggcaacaacgtcgagtcttacgttgacaacatcgttgtcaagaccaagacaagcgactcattgattgacgacctgcgggaaacgttcgacaacctccgacgatatcgcctcatgctcaacctagagaagtgcacattcggagtaccgtcgggcatgctactcggattccttgtttctggcagaggaatagaggcaaatcccgagaagatcaaagcaatcgagaacatgaagtcgcccacaagactcaaggaggtacaaaagctaaccagatgcatggcagcattaagcagattcatcgctaggatgagagaacgaggacagcctttcttcgctttgttgaagaaacaagacaaatttgtatggacacaggaagccgaagagtcatttattgcactcaagcgctacctatcaaacccacctgtactcgttgctccccaacctaatgaagaattatttctttatattgccgccacaccatattccattagcactgtcattgtagtcgagagagagaaagtacaacgaccagtttattacgtcagcgaaactctccatgacgcaaagacaagatacccacagattcaaaaactgctctacgcagtcatcatgacatcaaggaagctacgccactactttcaagcccacagagtcacagttgtctcctccttcccccttggcgaagttgtgagaaacaaagacattgtcggccgcatcgcaaaatgggtagtcgagctaagccaatttgatatccactttgtgccgcgaacagccatcaaatctcaggtactcgccgacttcgtggccgattggaccatgccagataacaagtcagacaaccaaggcgacaacgagacatggacaatggcgtttgatggcgcactcaacagccaaggagcagaggcaggatttatcttgacatctccctccggagatcaattcaagcacgcaatccacctcaacttcagtgcaaccaataatactgcagaatacgaaggactactcgccaggatacgagctgcagccgcacttggggccaagcgactaatcgtcaaaggggactctgagctagtcgcaaaccaggtgcacaaagactacaaatgctccaatcccgagttatccaagtatcttgcagaggtcaggaagctagagaagaggttcgacgggatcgaggtccgacacgtctatcgcaaggagaacgtcgagccagacgacctagcacgacgcgcatccagacgagaaccgctcgaccccggcacctttctcgacgtcctgacgaagccatcggtaaaagaaattaacggtaaatctggcccgagcacccccgacattagctcggaggtcaccgaggcagaacgtgccgttgctgacatcgaaataacagacgactggcgcaccccattaatcaaattcatcagcagcgaggaattgcccgaggatgatatagaggccgagaaaataacccgtaaagcaaagatctactgtatggtcggtaacgatttatacaaaaaagcaccaaacgagatacttttcaaatgcgtctccctcgacatacatgaaggcatatgcgggtcatacgccgccggttggacattagtcggcaaggcctttcgacaagggtttttctggccaaccgcccttaaagatgcatgcgacatggtccagcgatgtgaagcctgtcaattccatagcaagcacacaaagctacctgcacaagcgctccagacaatccctctgacttggccgttctcgtgctgggggctagatatatttgggccattcccacgaggacagggcggctatagattcctatttgtagcgatcgacaaattcaccaaatggatcgaagcactacccactggggaaatcaaggccgacaacgccattaagttcatcagagggatattctgcagatacggactaccgcactgcatcataaccgacaacggctctcaattcatcagcgccgacttccaggattactgcatcggtttgggagtcaaaatatgtttcgcctcggtctctcaccctcaaagcaatggacaaatcgaaagggcaaacgacatagtactacaagggataaaaacccacgtctacgacagactcatgtcacaggacaaaaaatgggttgaagaactcccatcagtactatgggccgtacgcaccacaccaacaacatccaacaagaaaacacccttcttccttgtgtacggctctgaagccatgctccctggcgagttacgacatcaaagtacacgagtacagaagcattccgacgagaaccaggaggaacagcgagacatcgatgtaaaccttctcgaggagcatcgtgagcgagttgccgttcgagcagctagctatcaacaagccctccgccgttatcatgagaagcgcatccgagcacgcatactttcgatcagtgactatgtcctccgacgagttcaaacccaagcagggtgaaacaaactctcaccaaaatgggaaggaccctacacgatcacacaagtcttgcggccaggcgcattcaaaatcgcagacggcgacggtcgcgaattagcaaattcgtggaacattgaccaactacgtaaattctatgtatgagtcaataacgccgtacctgtaagcacccttacagtatcaataaagcctatttctaggtttcataccacgaccaaagtgttttcacccgacgatcccttactctgataacacctagtgttgaaacctatccttatgaccctttacgccgtctcgacaaggcctccgaggaacctaagggatcttcggctggggacgcccagagccgataaggccttgtcagatccttcagagacaaaagaccatgtaagatttggtcgtgtaagagttctcgccgtacgtattaaccaagccgtgtactcggaaatcgagctttccaacttcacggctgggggctaggatcagagcttattcaaccaaggcagatcaagtgtccaagagccttatcatccgagaaaatttctccgacgacaaggctgggggctagggagagtgtatgactcaaacggccgaggtcgttaactgagaacacactctaacacataacatccagagtaagatgcgtttgtttaaggaatatttctttatacacataataattcttactgtttttgacataaatctcccactacattacactttttcctaagacatctgtaacaggccacgagtactaccaagagggccaatgccagtccatagactggaataccttctcggctaatggcgacatcgacctcgcaaggtggtctatctccgccggagtcctccgagaacgagcaaacccttcatggaggaattcaagatccaggcgcgggcggtgatctcgcaggcaagctagtacatgtcctccggcatatcggcttgctcgacgacactcttgcttcaaggcctcgtcaatacacttgtcgatgccatcgagttgggcacaggccccgttgagcaacgagatgtacctggccgccgattcctcaggatcgctgcggactactcgaagctccctgcatacccgggccattgaggtacagcaactctttaaatatgacgcaaaccacacctcgcggcctcggagcgtttccacggcttgctctttcttcatgactagcatggttctctcgagttccgccacttcaaatttcgtcttccaatattggatgcgacgatcttgggttgcaagggcatcctcgagacctgctaaacataacgaccactaagacaagctggaaaccactaacccaacacggagttaaataggctactcacttgaggtggttgtcgtcatctcgacctccacatcaagagtttggtcctcgacatcatgtgagacgtgtggttcaaattcgaataccggaattatcgccagtgactcaggctgcccgcgctgctggacatcctcgtcatcagcatctctacaatcgacaagaaaaacttccgagatcaatattgaacaaggatggtaatcatatgcacgaaggcaaccagagttcaagatttacaaatgacaaaaaaatacaagaagtcctactcttcaaaaagggggaggacagactcccccaggtcactgacttcttccatcacctccttacgtgtgtcgcttgccaccccctgatccaagatctcacacagatcgagttcagggcgcgacaactttacacatgcgaggacgtgacacgccccggtgtagataccgttggacgtctcctccgcgatcctggccatatgcttggaggggatttcccccatcgccgtcgccagctccgcaagagaagaagtcaacgagaactcatcggggttcaccgggatcgtagacttaacgccgcactccctggcgagctggtggaggccggtgtaggtgacctgcagcgaaccacggatctcggagagattgtctccaagttccgacatgcggtcctcgagccctttgcgatggcgctcgttcccggccaccagctccctcatcttggcgaggtcctcgcgggctttagccagttcccgcaccaaccgctcggcacgcgcgtttgccgccgccgtctccgccctcgcctctgagatctcgcggccgatgcctcgagcaccagcttcgagaaggcgccccatttcaacttggagctcctcccaggtgaggacggcctctggcagactacgacccccagcgggatcgctgacagggccgcttggcgtcgcctcccgactcccgaccacgggcacgacatctgtcgacaccgtggtaggggatgcgctggacgttcccccaaatttggcccaagcagccttcgcccgcgcctccctacaaacgaccacgaatcaaaactccatttgaacagaagacacgagaatccaaaaatctgtttactaacttctcgccgatcgtcacaatgcgctgacgtcgcggaggtggaggagacgcgtcggaagcctgcaagacaaccaatgtagagtgagaataaaccttccttgctacataacctagcgacaaggtgaaattaccgagggagttgctgccttgcggcgatgtccgagcacagacgagaatttcctcgccttggtcggagcttcgccaccactagtggtggcagcgtcagacgcctccttgacgaccttctccttcagaggtgccgccacctgatgatctgcgagcggtccgacgacgtcagtcaaaggaagggcctacgctaaatcatctcataagctgatttcgagcagagaaggcgggacgctatcgaatgaactcacattgatcgcttcatcgcgctccgtcgctcccttttcacaaaggggcgcggggatgtcgctcgccgtggtcgggccgctgatcatcacctgaccaacacgccgctccacggcttcgccgctcagacctgtcaaaaaggaatcaatttttgataagtcgaagaggaacgcgagtacaagcatgtctaaatgaatgcgagaaagataccccgaggagaaacccgggtcgcgtcgtctggcccataatagttataggtcggatgggcccgaccctagagcggctggattcgcctaccgacgaagtctgcgacgacttcatatcccgataagccccgttctcggagatcatcgatgatgtcgataaatgattggagagagggggtcaaggggggcttggcggtccagaccggaatcttgtccggttgttcctcgggaataacgaggaccggatttgaatccttgatctcaaggtaaaaccacctgttccgccatttgctgagagaagagggacactggaaggggacataacgcgacttcatgccatcacgaagtcggaacccgacgcaaccggataccctattggattccatccagcgcaactcgtaataaaagcggaacagatcaagaaagggctctaccccaatgtaggcctcacaaagatgcacaaagacgctaaggaaagcaatggaattggggttcaagtgtagaagagaaagcccatagaaattcaaaaccagtagaaggaattcggagggtggagggagaaacccgcagacaacataatcttcgatcgtaaccatacgacctaagatgggctgaggattagtacctcctgcttccctctctgccttttcacggccaggaagggcgccgtcctcttggagcttcttcagggtcgcgctggtggaagccgacttgccgagatccatcgctgctggaagatcgccggagatggacctagagctggtgaagctagggttctttacggcggcggagaaggcgaggagtgctaacaggcggtgtgtttgacggagttggcggacttacaaatgcgcacccaaaatccctttaaataggcgcacccccaacggtgcgaattccaaggaactgagagaaatccccgccggaaatttctaggtccgttacgcgcggcagtttttggacttcagttcaaaattcactcgtgaccgttgggcttcaaacggtatgctcgattacacatcatctccgcggttctcgcacccggaatgataacgttctcgacatccgaagtcgcgaatggccgcacgagtttatttttgagcagaagtcgggggctactgtcagggttacgggtcaggcataccccctacccttcgatatacgttacgtatcgacatggcatacccacgcgcacgcggatatttcctttatgatctaaggaaacctttcacaaaatcaatagacgggaaaagtccttctcggataagaactgggttacctacgtatcgtgctaggtctggtatattcgagtcctactcggagagcaccagacctgcgatataaaagggaccccccggggagggcataggggatcgaatctcagagccaacacaacccacacagcctacgaagccggagcctacgaggagccaagtcgtcgagagctagtcaaatcaactcgactacaatctcgccggatctgacaagtttcatcttttcctttgtaacctgtgttttccaccatataatcccatatcaactggattagggctattacctgtcaaggggcctgaaccagtataattcttgtcttttgattgctcgatgtcgtactacgtagatccttgtaccagcgtaccccaataccctctatatccggtctgcgggtatcacccgtcgacaggagtatctgaattctcattttcagagttttgcttgttctgtgaagaggtgatcgaaatgcatgtttgagagtaggggaggcttagagagagttagaaaaaaaaaatcttcctgacccctcttcccccaactctagcggctcaccatgggtgatggccggaagaggggtcgagcatctactctactagttctttagtatagattaggttagagttttctatagtcgggtgtcgcgcccagaaatttagcccaaatttccagactattttgtgtattaaatccctgtccaggaccagccaaggtacacaaaccgacaagtaatatacagttccaaacgtaaataaagcgtaaaatacttacagaagaggcacttactcctcacaccgaaacaaaagcagcagcagcggaaaaggcgatcctagcggggcttcagctccactccacaggcaaaactcaactggggtatgagccttggtcctctaactccatcttcagctcagaagcactacacttctgaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctgcactgatcaacgctataccacgttgaacaggcccaaccaacccacctgaactacagtgcattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaaactacgctacaagcccagccgttgcccacgctggcttgtggtaagtacgataagttcttccagggcatcccgcgaaccggtccttaattgccatgggtgcgactagcaaaaccatgcacccacagcccaccattcagtcgcattttagttggataattacgaccatgaagcatggccagatgtctcgagcacgcagctcgtcatgtcatgatactaggaggtctaatactgcaattatcccatcaactgagctagtggtaattaagcatggctaagcatatagttctagctaagtcacataagtaacatgagctagtcgattcattacccaaagttgacaaagaacagatatcaagtaaacatggcacaagcgagcagataggtaataccctgaccccgtgtaattagcaaaacatgcatatttatttgcaaacagtaaaacatttgtaaattaggatcaaaatgctcaaggggaatgtgtgacttgccttgcttcttcaaacaatcttccgaactcttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaacggctcaattcggagttcgaatgaattaggtatgaattttagaagttttgagccatttaaatgaatttctataattaaactcgatttatttcgcaattattatttatttttacaaaggaaatggacctcgctgacgtcatcaagggggaggggcggcgccggcaagcgggccccaccggtcagcggcacaagggcgccggtccaccgtggaccgggaccaccgaggcggtccaccgccggtccacgggaaccgacggcccggatcggcccaaagccgatcggacgggcacgaggcggcgcgactggggcacgggcacggcatgaagccggctcggccgagacatggcgcggcggcggcaagggggaggcggcaaccggctgcagcagccggcgacgtggaacggcggcgggcggccggaggacagcggcgcgcacggggacggcgacgcaccccaagaggcggcggtcggcaagaaagggggacgggaaaaaaaaaggaagggaggagagatcctcaccggaagcggcggccgacgcggaggaagaggacggcgacgacgattgcccaatggcggcttgcgaggacggagggcggacggggtcgcccttgaccttcagaaggagaggagggagttagggaggggaggaccgatgcggggtgactggaaacgaaggccgatggcgatgacaagaggtagagctcaccggcgaccgaggaaggaggagctccggcggatttccggcgaagaggggcggcggccgaggtcctcctcgtccttgcggagctgagggaggcaacggcgcgagtcgacgtcgaccgaagcggcggcgcgacgcggctggagtcggcggcggcggcggagagaggtggtgaagagggatgacgcacgtggcggcggcgtttcggagttggacagggcaaacggagtggaggccggggtagagctcggcaccgcaatgccgacgacacaaacggcgcggcgctgcggcccctagggcggcagtagcgggcggctggggcggcgaacggcggtggaagctcggcctcgcggtgggaatggtgctgcgggggtggaaagagaaaacggggtgga

SEQ ID NO: 59341 - DNA, 18819 bp, Oryza sativa
gggggggtgggggggggagaaggggagccaggccggcgaggaagggaaaaaagacttgggctggaaacggcccaaaggacatggacggaattttaatttggtttttaatttaaataattgattaaatgaactttgtattattgaaattaccactcgagcactgaaaattcacgagaaatttcaaagagtactttatggccaactatgatttttaaagaaaaatttatttcccacattaattttactttataaattgcttttaattttaacataaattatagaaatgatgtactatttgatttttaacctcgaaagaaaatcaaggcataacattcattttcagaattttatagctacatgttcctagaatttgagtgacaatctatattacctggggagctagagatctttggagaagctcccataaacataacctttgtaaaactgaacaactctcgaaaagcgctcttaagcggtacctctatttctctataaaaaaccaaataccactgatgaagtatatattgctctcgtcctaaaattaaaaaaacaaagctttgttttttctaaaaaaaaagttccattttccaacttatattctctcattttttatgtgcatatttcccgaactgctaaatgatgttttttctctctctctctctatatatatatatatatagcatgtcaaaatgaaaagctatccccagaaaacaaagaaaacgaacttaggcttgattggccgaagctccatgtcatgactgaataaagcaagggagtctctgtccgtttcattacgtctttctcttactgatctaggatcaaggtagcaattctactactacgaaacaaaaaagaacttgatttttcagggaaggacagctttctttttggcaggaatgcaagcaagctaggccagaacaaggagaaaggctaaaactgtctgagccaagaaccagacgcgctcatggcttcacactcccaccacactaacacaatatgccatttgtttggcttaataaatcatctgcatcatatcaacctttccgtcaatggtttagtttatgtttgactctaagccatggcaatggattaagtaaagcacatgcaaattcaaccactctctctcagccagccactcgctgtctcactagctttctttcttcgtcttcctcttaagaaatccaataatctttaaccgaacaccacttaacccccataatgctcgccatggcgaccatccagaaataggatgagacggcggcggccacgatgctaggcaggatcatcttctgcgtggtgatcgccgcggccgtcctcgccgtcgtcctcctcgccaccgtctccccgctgccggggcgccacaagggcggcggcggcggtcgagaccatccgtggactctcaccgtgtacatccatacgacgacggcggcggcggcagcggcagcggcagctggaaccgtgtcgccgccgcagcgacaacagcaggcgagcgcgttcgtgttccggcaccggatgacggcggggccggagagcgcgtcgaggacggtgggcgcggcgacggggttcgtgctccctgccgaggccgccggctcggcgatgtcggtgttcgacacggtgcacctggcgttcgacgtgtcggggatgtccgggagcgtctgcgtccaggcggcggcgggggacggcggcggcggcgagaaggcgccacggccgacgaggcggcgcggggagtgcggtgacccggaggtgctgcgggtggtgggcggcacgggcgacttcgcgttcgccgcgggcggggatggcgtgctccgcgcgctgtgcgcgccgcggctgttcggtggcgcggccgcggcgaaggtgttgcggcttgagctgagcgttgcgcacgccaagggctagtgcgcgtgcatgggcgaatattttgctccttcttttttaccttgtgcaaaattgttgggcttttttttttccgcgttacattctccggggaaaatacaactcggctttgatgctggcagaaatgcagaatacatctgaccagtgtgcatataagtgttgagaattgggtgatttgagtgatttgaggcccttcatttttcgtgtccaagcttgaaactgagcgtatgcttcattggttcgtgggacggtggaagcgtatactgcagtctgtttgattcagcatcgggcaacgagacatgatcctttgcagtactgtatttgcagaagccaggctgataggtggacctggtcccacatgtcagcggctgctacagcagctgcagtcctgtaaacaattcccattacggataacggggcaagctactttatcgtattctatggacacattttataagctgttaaatgatacgttttatgaaaaaactccaaaacaattttttttagtttataatagttaataacttatctagttttgcgtgaaacaacttagccaaatgaattcacccattcgaacgcacccaatgatgcatcattcgaatgctaattagcaacttcggtcattgtgtgcgcgcgtgtgctttttcttgggaggggaatgcatatcgttccgtttgtccattccgattcattttggaaaaaagtacgaattacctcccgaactatcgcatcgtccgaattacacccctgaaccataaaaccggatattctttaccccaaactatgcaaaccggacgaattacccccctcaatccaatccacggtagttttggtctacgtggtgtacgcgtggcagtccagtcagcattttagttattaaaaaaatgtgggacccacctgtcatacccctataacattattccccccctctctcctctctctctctcttcatctctctcctctcactctctaaacgcgcacggcgccacagcggcaggcggcggaggaggcgaggcagcagcgaggaagggcggcgcaggtggcgacacggagcggcggcggcggcaggggatgaggcgaggcggcagcgaggaagtaggggagcttcgccgtgtcggccgccatccctgtgcgccagcgcgtcgccgtctgcatctagcggcggcggtggctgcggctgcggcgaggcaagcgcgttgcgggtgccctaaggcctgtctacttaggccctgtttagctaatgggacagggaaatcatttcccaaccactaaaagacatctttaaatcctaaccattcattctcactctttcatttaatcctaacccttcattcatttccaaatctcaatcccacctcacatttcccattatccaaacacaccctcacattacatggcaaaactttgtcctgcaggaccacattttaacccaaacaatttgacgcacggtgcaccagaagatgaagtccgtcatgcgggtgacctgggaaacattgttgccaatgctgaaggtatagccttcatgtaatcactacgaatgcatttttgatgtttctctctaaaacaatcttcttggcatacttattttatggtgtgtctgtttaattgttgtcatacagatgtagtcggccgccacgatggaggggagcttcgccgtgtcggccgccacggcggcggtcgtggctatcgaggaaggtgccgccgagacggcctccgcgtcggcgtcgccgtcgtggccaaggaggacacccatgctccgcgcctccatccccgtgcgccagcgtgtcgccgtctgcatctggcggcggcggcggctacagcgaggcggcagcgaggaagggcggcgcagggggcgggagcgagcggcgactgggtggcgagcagcggtgggtgtccctcagatccgcccgcccgcagcgcccccgcctcgctcgtcgcacgcagtggggctcgcggggatggccgtggacggcggcacgagggggcgggcgcagctgggtaggcgaggctagagcggcgggcgagcgggaggcggcacggccccgcccaccacagtcgccctggtcaccgccctcgcccccgaggtcgccggcgtgcagctcatcctcgacggcgccgacctcgccaagaaatcagtagctagtcagcctccgccagcgccgctcgtccccgtgccgccggtcgccgcccgcccctgcacgccgccattcactgccctcgcgccgccgcccacctctcgcccttgcgatgcccgtggaagagagagagagaaagagtgaagatagagagaggaaggagaggtatgacactatgacaggagggtcccacaatttttttaagaaaaaaattgctgactggactgccacgtgtacgccacgtaaacaaaaaccaccgcggattcggtcgaggggggtaattcgtccgatttgcctagttgggggtgaagaatgtccggttttatggttcaagggggtaattcggacgatcgcggtagttcgggggtgtaattcgtactttttccattcattttgcacgatccatgcctaaaatccaatgtcaaccaaggccatagtccactgtactgtggcccagggaggcccagcccacttggtgttgtaatatctcagaaggaaaaagtacaccgaaggtccctcaacttgtcatcgagatacaaaatcgtcccccaaccacaaaacatgatatgtggtacccctcaacttacaaaactattcattctaggtccttcgttggttttaacctcggttttgtccgacatgacagctgagtcagcgcgggacctgcgtgggccccacatgtcagacaatccacatcagctttctctttccctcttctctcccttcctcgtctctctctctctctctcttctctcttggcatggcgggcgacgagtggggaggagattgcgccgctcgcccaagctggccgagtcccggtggcgccgctcgccctcgccggccaagtcccggcagcaccgctcgccctcgccggccacgtcccggccgtgccgctcgccctcgccagtcgtgcggaacctctccgccggggtcaacggcgacgatggcgccgccgcgcgttcgagctcgaccggtggcgattccgcctccctccatgcacgctccccgccatggccaccgccaactacaccgacggcgagctcattgtcaccgtccccaagggcgccgcccctgacgacgacgacgatggcgatggtgtgcgccgcagccgtgcttggaggctccggcgcgctcgacctgcgcgctcgtcgttggccgccgcccttcgacacgagcaccttcttcgcctcggccccgagcgtcgccattgccaccacccaccgcggccggcggcgacaacgggggattcatcttgcccttccccatttctcttccaagcttcttgtttctggtgggcggtcccctcccatgggccggtgccggcgagggtgagcggcacggcggggacacggccggcgagtgtgagcggcgcgatcgggactcggccggcgagggcgagcggcgcagctgggacttggccggcgtgggcgaacgcgcggtctcctccccacccgttgcacaccatgccaagagagaagagagagagacgaggaagggagagaagagggaaagagaaagcttacatggactgtctgatatgtgggtcccacgcgggtcccacgctgactcaaccgccacgtcgggtaaaaccgaggttaaaaccaccgaaggacctagagtgaacggttttgtaatttgagggatgccacgtaactggttttgtggttgggggacgattttgtatctcgatgtcaggttagggggtggctagcgtgcgcgtgcactccccccttccctttagtcttaactatatatgttaattaatatatttaacactaatgatagtagttaagaaagattttggagatttttttactaacagattaaaaaaatttaagttagatttgaaaactttcgatttaagatttaaattttaaagtcaaattttaaaaactttcaactcagatttgaaaactttcaacttgagatttgaaatctttcaactcagatttgaaactttcaactcgagaatcgagattcgaaaactttgaagtctagatttaaaaattttgaaaactttcgatttgagatttgaaaactttcaactcgagatttgaaaactttcaagttcagatttaaaaattttcaactctaaatttaaaaactttcaaactcaaaatatactaaagataaaaaaaatcagaaacaaagtgagaaaaaaaaggtaaaaaaaaaaggaaaaaaaatcgtagaggaggcgtgcgcgcgccggcgcagcggcgctgggcctgactagtttttccggacaagttgagggacctttggtgtacttttttcctatctcggaaaggaaagcccgcacgaaccccgcgcatagcgaggcccacaatcacggcgcttcggtgtcctaaccggcagcgcgcctccacccgcggatccggccgtccacgcgacggagccccgcgcgccgcgaagagccgcggtgtcacgcccacgcgaacggacgtggcctcccctcctgcagcggcttcaccggcgagagcgacgagaccacgtcgtccccgctcccgcctgagtccctccctgcgtccgctactatcatgtccacgtcgtccggttcttttttttttcctcccctgaacgcccagctacagatccatccgttttttttttctgaacgtcgcagctacagtctacagatatacagacgtgccgatgactcgtgacacacaccacgatctcgaaaatgtcgtgaaattcgtgcgttgcaaagatatccgaattggagatttctttcttcccccgagaggctttattgacactctgtacaaactacttcgtaccctctttacaagtgaagaaagagagaatactataaaaacacacactttgcaactcatttttttttgctattcctaatcttgatatgaaagaataaatgaattatgaatcggagctataaggcaattcctgtacgtgttcatgcgaaagctgtacgcttgcgtggttgtcgctgtgcctgtgcagccgtcgtcgacagcttcgacaggaggaagacgccggcggaggaggcgagcacggcgccggcgaagcaagccatgtcaatcccggtgaccagcggcacgctcttgaacttctcgaggacgcccgcctggagcagcaggagtatggcgtgcccgatcctcgtcttcgcctgcgtgatcgactggatcctggccccttctttcagcttctgcgatatggaaatttacggttctttatcagcattgatcaatagccagacatggttactggtgaacatctgtcaaaacaaaaatcgacagatttcagttacctttaggttgaaggatcccaggtgagaattatcgccttgcattcctgggttctgaatgctccgggagccgtagaacatgatgtacattcccatgccaaacgtgagaagagctgtgccgatcaggaacatgtctgcagaagaagaagcatagtttgatttgtcaagatttagtaggcataaattaaatcggtttaacatggaaatggttacttgtatgcagtttaaaagtgattataaggggcgtacctattgcctcgatcagcagctttatgatctctgcttgatcaattgtctgtgtcagggcacgaaactgtacgaagaatgatctcacaactgcaccacatccctgcataattcagcacgaaatctttcagcctcgaatgttctttcacttaatacgatctcgaatcttgattagtccatcatggtttcacttgcagcaggaaatgatcgtagaagctttacctcgagaaagcatggcactgatccgacgagtgatccggccacaccgatgagcgtgaacgactggcatctgacaacaccctgaaaattttacagttcatatgaactccatcagtaatttaaatccgcaaaacttcggctaattcggattccaaagaactcgcaaaatttgctgcattttgaggtgattagtttcagttaattacctggtggatggtggcctcggcgatcttggaccagcactgctgcgtcggccgcgtcgcgcccccgagctgcctcagcaccagcctcctcgcgacctcgtacgccagcggcagcagcaggtcggcgcccctcctcgcctcctccggcaacaacaccaccccgccgccgcgctccctctccagcgccgtcacgccggcggctcccagcgcgatcaacgccgccttccgctccgccgcgcggctgccgacaccgccgccctgcctcttcgactcccacagcgacgggaacttcagggacgggatgcggcacggcccagccacgccgccgccgccgcctgccgccaccgaagacgacgacgatggcatcatacgatgatggctgctgccgtctccatgaaaagccttcgcggttgctcctctcagcaacctgccgctaccaccaccaccaccaccaccaccagctgctgctgctgccattgctgaagctgctgaactccgtcactgtcagctaccgttgctctgaacagcaggaagaagaaggtgtccggagtcgaggccgtatttatagtcgctgataacgtacgatggagaggagagggatcatacgggacacgcgtggtaaattcgcgagtttgggaagtttcgacgaataataatcaaagcccacgaaaatgcagaacgagatggaaacggagaatattccgatggcatctctgatctctctttgtggtgagcttgtggttggcgtggattttgtcccggaaggacggaattctccgaccggtagaaaatcgccgtggtttctttgacgtggaactggtactgacagaactacttttcgtgttgaaaatatcaccgtgttgtaccagttgtaggtgtggttactgatgattatgaaaacggtgatggaaattctcgatcgatcgagcatcgttttaaaaaaaacaagggtaaaatttgttgtaagtatttgattaagaaaaaaattaaataacttataatatgaaatataacggagggagtactaggctgtgtttagttcagcgcaaagtttaaattttggttgaaattggagatgatgtgactgaaaagttgtgtgtgtatgacatgtgatgtgatggaaaagaattgaagtttggatctaaacacaactttagttgtaggttgtgattaaacaattattacactgacgtacagttccacgataatttagggcctattcagcaagcgccgcggctgtgcacagtgaatgtggcactgttcatgccggcagtcgcagcctgggcagcccaacaggcccttagttactaaatgaaattgtgtatattttgttgagataataatgagtgctatctgtaaacgaaatggcaaagaaaccggaaactgtacaagcaaaacggagtaactctggtaattcgctaagttacagcaggttattatcaatctcaatcaaatgataccaggtttatgatcacacgcatcagaagggaacaggagaaacgatcgaccgaggagactggagagtcgctgtaccgaaagaaaaagttgagtttgatctccagctctgcacgcgaacgggagagagagagagagagagagagagcagacagctccaaactcagttgacgaaagatctccaccgctgcgacagtggagagaaacagaagccgttccagaaacgccgacgaaaatgctcgggcgccgttcgttcgttcacttgttccgccctctgctcggaacgatcgaccgcacgcgtgggcgactgggcgtgcgtgaggctgacgaggatgtgtaaaatgccgcaggtgacaggaggcgacggacgaacgacgtgtgcgcgcggcgccagaaggttaatttcttggtcctcccgggcctccgctggcacgtgaggcaaacgccggccgctcgttattatgctggagtatgtcgtcgtctccggcactccgcgtgcgcttctcaacgagttctcaaccttctcttgcacgtgtacggtgctgtcggcgccgcgcaccctgaagtcctgcatcgatcacactgctgctccggccgatgcatttcatctgaaagaagtgtttcatcttaaaatataaatattttttaaaatagtgctaagtcaaatatttttaactttaactatcaatagaaaaaaaagataaatcatgcaagaacgatgttactagatttatcagtaacaaaattatcataatatataactctttttatttaaaacatctttttttaaatattattagtcaaaataacatctcaaagactatattgaagtctaaaaataattatattttgagatagataaagtaagtagtagtaacagatcaaaacagtaagcgtagtagtagtacagatcaatactgtcccagggcgggcagcggcgatactttcggtaccatacaagacgcggtttagaaaaccattctaaacgccgtttacaagacgctataaacgtgtggtgtgttgttgtttttttttttcatggctatatcctccaagggttgtagtgctgttctgataatacgaaacgcagtactatgttgtttattaaaaagaagcacatatctgattgtgaatgctcgctcgcacatttgtcatcgacttcggtattgtctgattgtctccgagcgactgggcgagagatgtagcggttggcgcaccaaccattgtccattgaacctgccaaccacgcctcggcgtcttctctcctcttctctcgccccgttaacttcagggagcgctacttgtacacggatgatcgacaagtcggaactactccttcacaagtcagaatttcgtactaccatttggcagcgattcgactactcctagttgcatacttgcaaccgagaggtacagtactcttctagctacagtatagcgagtgctactactccagactgcttctacttctctgtacttgcagggggtgcattgtggccgatacattcgtccaggttcagcgtgttgagcagatacgttcggtttagcattccagctgctagctccaagtcgccaacaccttgtcgtctcatcgtttgtcatctggtcaggtcgtcaagtcctgaactactgctgccgttggttttcgttcagacactgcatagctgcatactggcttgtcccaaaaagaatcaaaccttgtgtgtgacccagagtttgatttttttttatggaggggtacacaactgactatcgaccgagggtgtgtttagttcgtgaaaagaaaatttttaagtgtcacattagacgtttgatcagatatcagaaggggttttcggacacgaatgaaaaaactaatttcataacttgcttggaaaccgcgagacgaatttattaagcctaattaatctgtcattagtatatgtgggttaatatagcacttatgactaattatggactaattaggctcaaaaaattcgtctcgcgattttcatacaaactgtgcaattagttttttctttttatctatatttaatactttatacatgtgttcaaagatacgatgtgatatttttgaaaaaaaaatttggaaactaaacaaggccgccagctagaaacagcagcacgtacagcctcttttttgaaacgaaccacacccacgagacaatgtgagtttcattaattgatatagcacaagaataagtatatagtcctggaagactatagacagaaaagaaaaacaaccacaccgcgcgtctacaacagctcctgttgcgagagaaaaaatagaaacaagagatcttcagaacgacgcctccaaaaaaaacgacgccaagaacaccaccactacctgtcccggagagcaaggacatgattttcacttgaaaaaagtaactggagagacaagaatatgtaacaacgctccaagaggaaagcggcacccacatgcgttattgttgctaccccgaagatagagcattcgcccataattatttcatcattcccaagaaataagctcctgcacactccgctgccaccaccgtcgaaagccttcgacgcacagccaccgcatcggcgccacgttgccggccgaccgtcataaaggagctcgacccctgacacgctccagctccatccacgtagttgggttggatgaggagagggtgagagagaagaatggatctcctctctcccacactagcccgttcgacgtggtcatcttttgtcggcaaaaggcgccgttgccagaggacaaatatctagactggggcccgtcgtagaatcgcagctccccctgatggtgtaaccgccgactccgccatgatctagttgcccgcgtcacctcggggcaccataccgcgtctatgctgatgacaccatccgtcacagcgcttccgatgtcatgttaggccggaattaatctctatctcgaactccgtttcgattccttcttctctaaatttggtcattaacatttctttgacgtggaattggtactggcagtactacttttcatgttgaaaacatcgtagtgttgtatcagttgtaggtgtagttaaccgatgattatccaaacggtaatggaaattcccaaccgattgagcatagttttttttttaaaaaaaaagtggtgccgttttcaactgttttttttattctggccatgtgtaaaatttgttgcaaatatcacagtgatgtactagttgttcgttgttgtggttatgtgattattgcagtgacgccctgttccacgacaattagttattactggatgaaattgtatataatttttttgagataataatgaatgcaatctgtaaaatggcaaagaaatcggaaactttacaagcaaaggtgtactgaatatatgatatatgggagttacagattatactgcaggttatcaatctcgaccaaatgataccaatgtgcagctgaaggggacagaagaaacgatcaatcgaggagaccgtagagtagagtcgctgtatcgaaagaaaaagttgagtttgatctccagccccgcacgcgaacggaaaaaggagcagaaaaccccaaactgagatgacgaaagatctccccgccgctgcgtcgtccgtccgtccgtccatctgaacgtagctcacattgttgcgttagttccagctggttcacagccgctctcctccgttcaaacagctgttttttacaaaagttttatatacgaaagttatttaaatattatgtcatttttctaaaaaataatatacacttaattaatcacatgtgaatggatcatttcgtttttcccaatccaatccagggaaacgaacgcagctgctgggatcggaatgaacgcagccgctcggaatgatcggccgcacgcgtgggcgtgtgtgacttgacgaggatgtgtagtgtagcgtcgcaggtaacaggaggcggacgtgtgcggctcccggccggcttacgccgaggccggcacggcggcgcacgtgaggcaaacaccggccgctcgttgaaggcggtgcgtgctctatgacgtcgccgtctccgcgtgtgcctctgaagttctcaactctggcacgtgtacggtgcaccctgcgtcgatcacatggtccattggctccagccgacgatttccatcagaaaactgtttgtgttctacaacgtggtaacagatcagaaccgtaggagcacgtagaatttttctttttttagaaaaatacgagtgatattacagtttttaggaggtatcgaaagttgctatattttcgaatgtaaaatttgtataaaaaaaaggtgtagctatatttatggcgccatatttttcacctaaaaatagtcggcgtgtatttacattgtaagtctctaaattacatatgtaaatttagtgtatttataatgtaagttttaaaattacatatgtaagtctcaaaattacatagtaattatatgtgtaagtgggatgtaagcggggtataaattgtgttaaagaaaaggatgcatacatgtagcatgaaattaggtgacgtttcacttggatttgcatgactttagagattagctagcaatagcatatgctttcaggtctcttcgcgaggaaaaagtcagtatggaagcacggatcttaaacacagatccaacggccagataaccgactgtaatcaacgaaaaaaatctgtcgacataattatagcaaatccgaaaaaaatggtacgtcttagtatctctcgcgaactgtaaaatttctttaaaaatattccttttcaccggtttcataggaatacgcatgtttcaaagaaattgtcacagatatatcgttatcgtatagcgagaataagaactcacgacgagttcgcacagtgagtacacaaactcgcgatgtttgcgaggaatagcgggaacgatccgcgccaccacgaactcgagagcgagatcgctgagcgaactcgtgagtactcgtgcatgctagtctcttctggtttgctgctaccacaagttcacatttttagaccattcacggtgcgccacaagaatttagtgtgcgtcacatgccacctagacctaagaacacccaagaactagatggatacatactccacggtgcgtactacttgcatactactttataaagggtcccacagtgtttcccatctcctctgtccttcttatctcttctttctcccctctttgctcttatctcttttctctcacctctctacgtctcccacagacggtgaggaatggtggcgatggggtggctggtggtgccggagacgggttgagcggaggccacggcgccgggcaacggggcgacctaaacggccgccgccgccctgctcgagtggtggcgacggctccgagccccggggcggcctgagcggagggcggcgacgactgtgccgggaggcggcgccagagacgggtcgagctcgccggctctgaaccggcgtcgacatcaagctcctatgcctctctcttctccagccggccgtgtaacatcccagcctagggcttaatagcattaatacaatactcatatcaacaagttataacttctttttcggaagccgatcaactctagggttaagcgtgcttggtctggagcaattttggatgggtgaccgaccggaaaattcttcctgggtgtgcacgagtgaggacaaagtgtgcagaaaagacttgtgttggtctataagggcagcctatgacctatgaaagctgccaaatgtaagagggcctggcataggagaggcgggacgttacacggccgtccccttctcttctcctccgccggcttttactgggagttaaattttaactcatggtaacgtggacgaatatcggacatccatttctcgatccaacggtagttttcaagttaccactacatatgtggtttgtactacatattttcccgcgagacggggttgggagcagtaggacaacgcatcgcgaatgtgggccccctgtaaaactaacgaggaacgggtggctaaagttggctccacggtcttgagcaagccgcgcggattgccaacgtgccaccaatattcggtttttggggtgaggctgtatgccacatggaagcattgtgaatggccttactaaacgtttgtatccttgctccctgacgatggtatatttttaccaattctttctaaacatgtatatttttataaagccggtgaaaaaaatatattttcctatatttttcggagctactactgtgtagtgtggtacagtaatataccaccccttttttatttttacagcgaatctgtttgcgatcgactcagcgttgttgcagagcgagagaagtagcggttggcgcaccaaccattgaacctggcaaccacgtctcggcgttttctcttgccccgttaacttcagggaggctacttgtacacggatgaactgtacgtcgagctgctcctcctacttcacaagtcagcatttcgtactaccattggcagcgactactcctagttgaaaccgagtggtaacttctccctacagtagtgactgctactactcctgtgctgtgctcaacttctggacctgcaacgttaacggtgcagcttggcagatgcattcgtccaggttcagcgtgctgggcagattttttttttaagataatggaataaaatatcccggcctttgctcatcagagctatagccaattattacaaaagtaacatccaaacaccgagtgtagtttaaatgaattaaacacacccaataaaataaaagatcaaactaagataaggagagcatatttattcaagtttatttgtgaatctctatccatagtttgcaaggagttgcatgaccgttgtctcaagcctacgacatgcaaccttcaataagctcgcgatcatcttcacacatttgcaactgtgcctaaaatcggagccaatatgttgccctggaaattacctgcatatatgagatagatgttgatttgtcaaaaaccatatcattcctagtcaaccacagagcccaatatatggcagaagctcctacaagtatgagtttgctcttcttcttgtctacccccaagagccaaccatcaaatatattagatatggtagtatgaagttataaaccaagagagaactgtactgctctccaaacaaattttgcataatgacactctataaaaagatgttgaatagtctcatttttcattaaaaaacatcatcttaaactgccattccaatttcgtcttgccaaattatccttggttagcacaacccctttaagcaagtaccacataaaaatcttaatcttaagtggcatcttaagcttccaaataatcttgtttctctcaatataaccattattaattaaagttagatacatcgacctaacagaaaatattccattctgatgataattccatctaaagctatcagaggattgattcaattgaatatgtacaatagaagcacacaattcatgccaatttgcaagattctgaccaactaatgatctcctaaagaaaacattgagtggaacagatctcataacattagcaatagtagaacttttccttcggacaatagagtataaagatggatatttgtctttaaaagccaggtttcctagccatttatcttcccagaaccttatttgtttcccattatttacaatccaagaatccatatctaagaaaatatctttgaccttcatgagacctgaccaaaaatgagaatcaccctgtttcttattaacttgggttataaactgattgtagagatactctcttcaatagattttaccatacaccttcctcgttaatcaacttaaacaaccacttactcaagagacacttgttttgtatttccaagttatgaacccctaaacctccctgatccttaggttgacaaatgatatcccatctagtaagtctatacttttttttatggttatccccttgccaaaagaatagtgatctataataatcaattttttgaagaacccctttcagtatctaaaaaaagatatcataaacatagttaaacttgaaagtacagagttaatcaaaaccagtctacccccaacagataaatgttttcctttccaactaagttttttctcaattcttttctcaatcattttccaatctctattattcagttttctaacatgcattggtataccaagatatttaacagggagagagccaaacttacaaccaaagatgttagaatactcatcataatattcctttgcctgaccaaaacaaaataattcactcttatgaaaatttgttttcaagccagacaactcttcaaacacagataaaatcaatttaagattcttcgcttgttgtaagtcatgttccaaaaaaatgatggtatcatctgcatactgtaaaatagataaaccatcatccactaggtgagggactaccccattcaatgaaccaacatctttatccctcttaattaataaggtaagcatatctgttactatattaaaaagaattggagataaaggatctccttgccttagacctttgtaagtttgaaaattattaccggtctgatcatttactctaataccaacatgtcccccttgaataaaagaagttatccactcacaccatttaggagagaaacctttcattctgagcatctgttgtacaaaagaccatttaaccttgtcataggctttttcaaaatcgatcttaaaaatcacagcacttttatttttgcgatgtaattcatgcatagtttcatgcaaaataacaacacattccataatatttctcccaggtataaaagcagtttgagtagggctaatcaccttttgagcaacactcattattctattcgtagcaactttggtaaagatcttaaaactaacattaagtaagcagataggcctatattgttgaattctcatggcctcagcacacttaggcaaaagaataatagtaccaaagttaagggagaataaaggcaaaagtaccattatgaaaatctctgaaaagatccaacatatcatccttaatgacatcccaaaagacctgataaaactcagcaggaaatccatcaggacccggagctttattatgttctatttggaaaatagcctctttaatttccttttcagtgaattattgtattaaagcttcattctctaattgagatacttgtgggatgtccacaaaattattttcatcaaactggagatcagaatcatcaggaggaccaaagaggcctttataataagtagtaatatgcgattttagatttgcatcaccatttatcaattgatccccatcttgaagttgaaaaattctggtttttctatgtttgccgttagcaaccacatgacaaatactttgtatttgaatcaccctccaaaatatccttagttttagccctttgataccacttaattt

SEQ ID NO: 59342 - DNA, 26858 bp, Oryza sativa
atttttcaatggtacatgatttataaaagtgtatatatatatatatatatatatatatatatatatatatatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgataccatggtgcccccatatgagtgtcctatatatatatatatatatataagtaaaagtatatttagtcttgaggaagtttgtgccctctagaactggccctggacagatggacggcagtgatatggcgtggtgtgtggcgagggcttacagcgctgctgaggagaggatgagatcctatgttctatcgtctcttctggtgaggcttcgacgaggacctggccttcctgttgcaccccagcggcaccacggcttcccaaggtgaggcccgctgctgcgctactgagtcagctggtgcttgattattctagtattgctgctaatgacgatggtggactggtggtattcacgtagaattgattctcgtccaaggagggggcttcgtcggggaggagagagaggcagagaggaagaaggtaggggaggattatatatttttcttgtgactgacatatgggtctcaatatttctttttttaaattttttttccttgataataatgccacgcaagcgccgtataggattgaagaccaaatcaaattgccacataggaaaaaatcattattcaaaccgccgagagactcaactttcactggttttgattggtgagggatgcctatacccggtttcatggttgagggaataaagcttcgcctatagttcagggattaaaaatgaaccttttccattttcctttaaaaagatggaggtggatcggtgatttagcccaaattctcggcccatttataaggacgggacgaaattagggcccattatattcaagtctttgcgcacttatcccgaacacagaaaacgctcctgtctggtattgttcagaagtccaccgagaaaacgctttgttcgggaacacaaacgaaacttcacgctatgtctccaacctgctttgtttttggactgggcttctagcctcctactacgctgcttggtttgattcttgtagtggagtagtacttttttttttttgaccgtgatgattcttggagtagttattattaattactagctccctcggatgaagctactgaccagatctgatgtgcctgtttgacattgtttgattgcatggttatttgttagctacaccgaccgaccagagcaagtcctcttacctcgatgtcaaatgaaaattttatgagtcacgaccgaaccaaatagtcattgttttgtttgtaattcgcgtcaactctggtaacttggcatttaattagaacctatgaaatataccaagagtacttgctctggagggggttctaatctctcgaaaagggatgtcctatcattatttgtatgtcactccaatacttacgaaaatttttaaaaagatgtattaatacgtgatatatcactccacaaacatgcaacttaaaattcaacttctacatgtctcaaattgttttttttatcgttgtgataaaagttgacttttaagttgtatgtttgtaaagtgatatatcacatgttaatgcatattcttagttttttttcataaatatttgaatgacatgcaaacaactactccctccatcccatacaataaggattttgagttttttttcttctactgtttgaccactcatcttattcaaaaaatttgtgcaaatataaaaaacgaaaagttgtgattaaagtactttggataataaagtaaataaaagaataaataataattttaaatttttttaaataagacaagtggttaaacagtgcaagaaaaagtcaaaatcccttatattatgggacggagggagtagtaggagacatctcctcgagagtttaaaatccactctcttaataaggggcacactaatcatttctcctactactaatttatccgataattgctaaaattaaattctttataagatggagttagcaaaattaacatatactgcatttaacacagcccagaaaaccaaataccggtcttaattttggtacctccgtctcaaatagaaaaaaaaacatgaatatcagggaacgatctaatattaaataattaaaaggggtaaggctcgaattcagattgctagcccaccactttgtgaagctagccagaagatccctaaatgtttatccctccgtctgacatcgtcgttattttgttggagtacgtcttgtagatactggtcacagtttatcgtgtttaattcattaccaccgcatatgtagcatacacatatcgtagtaactattacaattaacaatcttgattattaaacttacagtacacactgtagtacgtatacactacagtacacatgtaaatcgacactgtatagtacgcaggtactgctgatcaatttacagagcgcgagatttatttagagatcatactaggcaaatcgtatgagttgagagacgtgatgagcgccattgcaaggtagcgacaagctacgtactaactaataatcggcggagacggcggccggaacaaacggggtggcgcagagcagcagcggcgagcggcggcgcacgccgaggcccggcgcctcctccatgtcaacctccttgacacccaccaggagcgaccaatcgaagtggtagagcatggcaacgagcacgagctccatactggcgaggccatagttgaagccagggcacatcctcctaccagaaccaaatgggatgaactcgtagctgccacccataaaatcgatagcatcgtcgtcgaactgctctggcttaaactcctcagcatcctcctagtactagtacttagggtctcgaccgatagcccacacgttaacgatgacacgtgatttggctgggatcgtgtacccatctagctcacacgtgtcgatgctctcccgcggcaccagcaacggtgccggtgggtgcagcctgagcgcctccttgatcactagcttcaggtacctcaggttgcttgcctgcaggtcggcctccgtcaccaccgccttcctgtggaacgcctctcggatctgcccctgcaacttcttcatcaccgccgggttccgcatcagctctgacatcgcccactccaacgccgacgccgacgtccccgtcccgccggcgaacatgtcctgcacgtcaagtgtacatatcatatgtgttacaatgacccatggagtagtaacacttttgccttcatgcacatgcaatcaatgtatagggttaccaaaatgatggccttgattttgttgtcgtcgaggtggaagccgaagccgcctttccaccgaagccgcccttctcctgcaaggcgatgagcacgtcgacgaggttctcgtcggcgttctgatcatcggcggcaccgccgttgttgatcttgtcgccgcggacgcaccgcctctcgtcgatgatctcctgcaggatggcgtcgaccgtcttgtggatgccgcggaggctgcgcttcatgccggtgaccgcggcgagcgcggtggtccacgtcgggaagaggtcggggattttgaagccgctcgacagcccgacgccggccttgatggcggccatgaactccggcgcgctcttccgcttcctcccgaacgccgcgcgcgccacgatgtcgttggtcgtgctgtggaacagcacgctcaggttcaccggcgtcgacggcgccgccgcggcgcggatctcctccacccgcgccgtcacctcgtcctccctgatgtggcggaaggagaggacgcgcttggggctgaggatctcggcggcgcagagctggcggagcttgcgccagtagtcgccggagggggagaagaggatgtcggcccagccgtagccgacgatctcgccggcgaggagcctgggcctggtggcgaagttggcgtcgtgggtcttgagcaccgcgcgcgccgcccccctcgacgacgccaccaccaccggcgtctcgccgagccgcagcatcatcagcgggccgtgcacgccggccaggtcacgcatcgcgcggtgcggcagcgcgttcacgaggtggtgcatgctgccgatcaccggcagcctccatggccccggcggcgtcctcggccgccgcctcatggtggcggccaccttcgccagctgcagcagcgccacggcggcgacgcagagcagcagcgactggaggaagaagtagtcgtccatggctagctaaagctaactaattaagctaattaattaactagctagttatagctgctaattaagctgattaatcttacagcagctagggctagctagcttttacactgcttttagtgcagtgctgatgagtgataagttaattgcagcatggcttggacagaataagggtttatataggcaaacaagctaattaaggagaggattgggccatgtaatcgcggatgctgagatataattttatgtattgtgggaactagcttcttggtttgtgaaaaacgtgtggccggttggctaagctaatcaagtatcgtttctccctctgtcaagatgggataaaatggctaattaattaattcccaccacaataatggtttaaatcctaattaaggacaagcttaacactttgagcatgcatggttcaaactcatactcagatagatatagtccatgttttcatttgatgacagctccacaaacatgtcatacaatggttgctgactctaatcaactctcatttttttcacccttctcttctcccgtgttagtttttttttctagcctatatctatctcacgacgcccgggggggggggggcgctccgcctataggcattcctcccacttctgcccttcctcctcccgttcttctcttcctattacagtacaccacaaaaaaaatttaaaaaaaacaaaaagttagaaaaatttatgtataaaaaatttgaattcaaattcaaatttgaatcgggtatgtaaacttttgacttataaactttggatctataaactttaggtgtataaactttagatgtatagaaatactatattaaaaaatatttgaattcaaattcaaatttgaatcggatatataaacttttggtctctaaactttagatgtgtaaacttgaggtgtataaactttaggtgcataaatttattaaaataggaaagtaatacggtgccaaaaaaggaaaccaggtggagggagggagggggagggggggaatcgatcgccctgagcgggcgagcgcgctcacccagtagcatttccgagttgactctcctctctcatccatatcaacactcacctatatttgacagggtcatgtgtagattcatttattgctaatgtaaatgtcttaagtgatgttcagtaccgctcatctgtctgtgctaatatacgggttttgtgttgtcggcaaatatatattgttttattttgttaaaccattactctatacacgtttatatattttgtaccattgctccctttaaacaattaaagtaaaataactttcagttctctagagggtgtgatatagataaaaagtatttccttcgttacataaaaaaccaacatagtataggatacgacacattctagttatatgtccagattcatagtattagaatatatcacacctggcctggtcttagatttgttttttacggggcggatggaatagatctaatacattcacatgtaaagaaatggatcggaacaaaggaaggcgtcacgaagaccttaattttctattgtccaatagctcaatttgtctatgtaatgaaattagcaagttggtgctctcttgagtttgtgcagctagatttggtttgtatattttaacatttttttagccattcgtgtgcttgtggagagcctctgtgatgtattagggaaaacaaatttaatttgcatatgcatgcgtttattaccatccctttcttatatatatatatatatatatatatatatatatatatatatatatatatatatatatatatatatatatatatatatgcgtgtggtgtgtagtgtgtatttcacataacagccatgacatatataccttgtatgtctgacccaaacttgtagtaaaatgaattccagtagcccagtaatttcagctttaatttaccatcacaacttctctagtttggttgtgatttcaatttgctacgtttaggagcatttattttcttttcaaattgttgcacacaagtacttaatacattttttaagttagaataagttacttttaaaaaactaaacatgtaagttgttgtattatatacgtggttgtcaatctagtggccaaaaagaaaaaaaaagaaagacttaatagacagggcaaaccaatcgatgccactatgaataataggcataaaaaggaaaacgaatccaagggatatatcttaggttagaaccctttgatgcccaaattatggggttcactagccttgtactattagtttggaaaataaagttgttgagtattgttcaagttgtcgaaaacaatggcctatatacgtgtatgtaggagtataaaatataagacaattggtcagctatgaatctgtaggacgtcctgacaaagaaaggaaatctaattggccactacattgtcaaccataatacatcacacatgcatgcaacagttcatatttttagctaattaacttgactttctctaaaatagtagtagtaagttagtaactagctagatactctgttcgatagtgctaaaaaaattgtcgccacaattttcgatcgatttcaatcggatcatcgaatcatttttgcccaaggaatttaacttatgtacatgcggggcagatctagttccttttgctgtattatcctactgaattcagtgaaattctattaaaaagttgctagttgctacaaatttataaagatgaacctataattcagtacagatgatttgaactttcgaagatatatttttttttattccttgagacatcgtcttgtcgtttctacatcactagaaatcatagaaaaaaaaagagttgtccctcttcggacgattttgtagccttttgatacctgtcacaggcgaagtcaagcttgtacttttactgttcaaaatagtgatatcctatccgtacacgtggcatatgttcgatggggtcccatataatttttttctcgattttctcgtgaaactaatggtgccggatcgccgtgcttgacaggatagttagccctatggctaattagggtcaccaaaatgattatcaggtgatcaattaggcaattagcgtgtcttaagcaggcatgttggacacgaagtgtgtgtacgtgtactactgtgctttgatatgaaaagattgaatctttttgggttggggtcagtgtttaatcaccaaccggtggttagatgggagctggctaataccattagtgtacctgcacttgtaggccagcttgagattgcagtaaacgaaactcaaggcaagcttgatgttttggaacttcagtgcatgaatgagttcatcttaactaaacgtggagcacatgttactacgtattcagacatgaacaattatcttctctaggaaaaggctactccctcatcccaaaataaattaacctaggccttgtttagatcccttgacaaaatttttcaccatgtcacatcgaatgtttggacacatgcatggagtattaaatataaacaaaaaaataattaattacacatattgcgtgtaaattgcgagacaaatcttttaagcctagctaattgctccatgatctgacaatgtggtgctacagtaaacatttgctaatgacagattaattaggcttaataaattcgtctcgcagtttacagccggattctgtaatttgtttttgttattagtctacgtttaatacttcaaatgtgtgtccgtatattcgatgtgacacgccaaaactttacaccgctggatctaaacacagccctactgccctagtatatgatgtgatattttctactaagtactgtgatctgtacagtgcatgattcgtagttttaaaaaagtcatatttcatactagctaggttaattatatttattttgggatggagggagtattaaagtgtaaaaaacaacatgaatttgcaataattctacagacgtacataactgagacatgtcaaattaagttcaagtggggggtcactattcctaagacgatgaacttcgaatgacttttaagaccatatgaaaaaaaagataggggggaaaggataaacacatgaaaaacaggtaactagaaaacatgaaaacacaaaaacaaatacgtactattcctagaaaaagcttgattctagtataaaatgatcagtatgaagaatttgaataagtaattacgaatattcatgccagaacatccattttctcatttaaaacaaaaggtagaaaaacacgtttattctgaataggatgataaatacgctgaaaaaccattgtttatcatgcccccgaatattaatgtggtaatcttcgttgattaaaaaacaattatttatggatattgtcagtaaaaagtttctccgtgtcctgcgaatcgacgagttgacacatgaaaaacagtaaattatttcactaataatcaaataatcaaaactacacaaagtgaaatcttctatttatggagtacttggggcagttgggccttgagtatctggcattagttcaagcttgcctagtgggctagtggctacaaggaaacaggcctttatcacagcccaacaagagaaatgcttagtgctggacatggtgcagttgcactgtaccatttcagacttgcacggtttggactttggacagagtagaacggatacgaatggttgcctgtcactgcgcttgtcagtctgattacagatttcagaagaatgggaatggagatattctctgtaatcgaatttcacattaataagagcacaaaaacagaacattttctaatgacctttttgttttctttgtgaccataatacagcacacattccgttgtcttttctgttataccagccaactgcacaacagtctacagcttggaggcaagcaaccaaacatttgcttcaaaaactgaaatctatcaaaccccattattgcttacagccttgccacattcaccctggaggccacttctacaaatgtgtcatataggcttaagccacatgtgtaaaaaaaacttatttttcttttagaatgtaggtgtttaagtggtattttcaatttttctactccttttttattagccccttatattttctattttaaccctcatatttttccaattaagaagccacaactggtctttttaaaaaaggaatttttaaccctacatggcaagagttcggagtccaaaaggaatttttttttaaaaaaaatcaccaaatcttggcatagaccgaagaaatcccgtgaacaccatgatctcagcaagacctccaaacagagagatcaactggccttctgaatcgctacatggacatgtcaaagaatcaagggacaagagaggcactaggtacaatggctgcatgcgttttcagatcgcccagaaactggcctctgaaatctgaatttcgcaggacaaaacacggtcagaattttaaagcctgacgatcccgtcgcaggatcacacttgtgctagcaaacacatcacaaacaacccgatgcttcccatcacaacaaagattgtactaccattccagactgaagatgagggtacattttgttcctaggtgttgccacttttacaggcactgtcctctccaatcctctaaacagtaaatcaccttcaccaccaccacacccccagacatataactgcagcagctgaatgtcacactgcaacacaagatagtttctaggaccaacatgaagagggcaaaataaaaaggagagaaaaggctacaaaattacgagtctccgatgagaaaatactccatctatgcggtaaattcctttcgccatggattcttctgcaagagctgtctctaccacccaacagttaggaacagagcagtatgtacaaactaggctcctcttgttctttttttttttactttttaatctcttgtctagaaagggatgctatcgaagtgatccggcgactgaaagcctgaaatgtcgatcaggctggctgggcagctaggacccggttgtgattgtgatcaccttcataggtaacaatcaacatcgaggggtcgtcgacgcacctctcaacatgcttcctggctgggcatcctcttacactgctacacttatagtaacccctgaaaaacgatgagcatacgtgaatattcttcagcaatctcttcgacaaaaagaatgagtaatttgtatagggaaaggctgttagctgtaatctttcttggattgcaacaggcatgttaccaaaattagagcttggcattcttgtaactacatgtgtgactgaaggtatcaccaaccacatgagttgcttaaaaccaaaactataactttctcgagatcccaatctccctttgctataaccagcctctaaacagatgtggaaagaaatctagcttgaaacttacagcacatagtatcatgagctacaatcatttattgctgtccaaattagaaaacctttctggtgaataattaatggcatatcatgcattctatgagatgtgcatatacttaaatctgctaagaacagagaagataaaaatttcatgaacagaaataatagctcaatgtaaccaggcaggaccgtttcctaacatactagtactgattactgaataatagtgacaagtcagcaaagcacaagtgtagatatcatgtgcagtatgaactagcaatggcacccaattgtaccagaaaaaacacctggcaacataatgactaaatgactacatgagattgagcatttagctatacctaggatgtggggatccttttattggcttctgtccatacttcctccatgagaactcatcagctggaatgtcagcaaccttattactgattgcagggactttgatagacctccttatcctcagcttcctgcaattacatacaaaagtgacttaagaaaaaacataaggtcaagatactcatatcaatttatcacaaaaagaaaaaaaaatccaaccttttcttcgcacagtgacatcggctcccagttgtgcatcgtccactaccatcctccctaccagtgcacctcctcctctgcatgaggcctaactctggagtgcttgacgtctgtgacccactaactagctggaatggacgactggagcggctaccgtccaaactcgcaatgctcccctccatactcagagacgacaagaatgaacgggaggatgatgccgtgcaattagaactgtcaaacttgagattaacacccttaccaccaccattgctaccaccctgttcaccaaggccactcctctttatcatctcactctgcatcttcatctgctgcatgagctgaaacctctggtagctctgatgctgctggatgaaatgaagatgcgccgaaggcaatgccgggtgaggcgttccagctgggggcgcaacagacaccggctggatgagctggagcggtggcccccgtgatggcccatccgaatcaaccgcagggttatctagaagcaaccttttggggaattgggcagggatcctaacaggatcctttgaagaagagccctccatctgatggtacctcggaaacagctggaggctagtgatcggactcgagttaggtgtcttggctgccatcgccacagccagtgcagggctctccaaaaagaggttgctatcaaagataggcaagggcttcttgatctttctaacccgggcatggccctggaggccattgccattgttcagcctggatgccacggagcagaactttgcaacagcctctcccgtagccgccgcgagatccttgttagggacaagctggctatgggggctggagaggagggtgagcaccctgtgacagctctgcactgcctccctgtttgcttcctccatcccctccatgaatcactcccctcccaccctacctgcacaaacaaatcaatcacctcttgactctgatcatacacacaaatctatcaagctcaccaccaaatgctctaacctagaaattcttgagccccaatatgcaactctaacacagggatcacatcacatcatgagcattttccatatataaataggaaacaagcaacacatgggtagatttgctgatagccctaatcattccattaccatatatatattaaaaaaaacagccacctcactggatgatttcaagaaacagcaccacctgggcgatgcagggggggagattctcacaatcatgcggcgcacacgggtgccatttccgacgagctgagctaaaattgggcacgcgggcacgcaacatggcattcccggtggcctaatcaatactaccaaaattaggcaacctgacacaatccaagaaccacctgagcctacaagaacagaaaaaaaaaaagggaaaaaaatcaccacaccccaccactccactccacaaccatggccatcacccctgcagctgctcccccctaaaaccaatccccaaaaaccaacagaaatttactcccccataaaccccaaacagctgcctctgctactactcgatccacggaaacaagaaacgcatacgcatgcatgatcctaccagcaaagggcaagaacagcagagtaaaaacctcacctcgctggagccagggctgagacctccaccggtggagacgacgacgacgaggaggagagggagtggctgcccctctctctctctctctctctctctccctcggctggtacaagcagggaagcgcagcagcagtagaagtagagtccagtactagtccaagcaagccactgagtgaacgaagaagaaaataaataaatgaataaataaacaaattggtggggaagagggtggggccagggcagtgctctcgcttttttgccccttcttttctttaattttcttttctccctttgtgctctctggtattcctcctcgggcggattaaaataataataaaataaaaaataaataccgcgggcggggccaccgaagtgggccccaggatgatctgcgccgtccatcgcgcccgtctccgtcctgcgccttggactttttccttgtccccgatttttttttcttgagtttttatattttttattttattttattttcctctggggtgtgggggtgtggtgggcccgggggctacgggctgccgtttcgtcaaaggtgtgagctgtgtcaggcgccacagtggtgggcgcgggccccacgcattctctgtttttcttttcttttcttttcttttttccttttttttcttctctccttgctgggctcctgctcctctcgtcgtgtgcgcgcgtttccaatgctgtggaggctgcgcgcgagtgtcaaaccaggggtgacgtacagcagcgacgattttttttccgatgctgctgtgatgggaggaaggaaatgaaccctcaagtctgaagtcaccttgttttgttcgtttgtcatttatagcataaatctttgctcggttatgatggtatctcttaagtcacagtgtttcgttcgtatgtagagtcctatttatagcatacatatttgcttagatatgatgatatcttttaagctatagtgttatgtttgtatgtaggcttcatttatagcataaatctttgctcagttatgatgatatctttttaagtcacaatgttttattcatatatatatagctcatctatggcataaatatttgctcagttatgaaatgatatctttcaagtcacattattttcttcgtatctatagctctgaaatcactttgttttgttcgtttatcatttatggcataaatctttgctcagttatggtgatatatttaatcatttatagcataaatctttgctcaattatggtgatatattcaagtcacagtgtttgattcatatatgcagctcatttaggccattctcaacccaatgactaggatggtgtccatagcattaaataagctgtcacctagaatgaaaaatgatgtggcaagtgaataaatgataaaagagtcttgcatgagacatgatttctacacaacatccaagacattatgtgaggtaagtagcatttaatttaagtatggaatagtggtgtttgcattgggagagtagtgtctaatactagtttcttaatgatgtggagtttatggaaactatgtctagtgtcttgggttgggaatggccttatagcatacatatttactcaattatgagatgatatatttcaagtcacactgttttgttcgtatctagagctaatttatatcataaatatttgctcagttatagtgatatatttaagtcacgatgttttctttgtatctatggttcatttatagcataaatttttgctcacgtatggtgatatatttaagtcataatgtttttttaagtatctatggctcatttaaagcataactttttgctcatttatggtgatatatttttattggtttttctacctagcgtattgcttatattgcttgagcagttttgtgccatattcatttatggcacacctgattacctgaaggatgtaaaacaggtttctcattaatgagatgatttttctagtcactaataaaggatctaaggagtgcacaaatgatttctcaataatagcatatacttgtatttagatttatcattcatacaatgtgtcatatttatgtatagtattcttatagcataaatttccattcgtagcacaatccaaacattttaattattgtactttaagaacggggtttttatccgtaacacagtttcatttttagcacacgtgaaagggttttacatatatagtcatttataatatctgaaagagtttgatgttgattagtcatctataaaatagtttcatgtcacatactcatatactggaaattagttatattatctaaaacatactcgtagtcatttacagcacacatctagatattacgagatatatctttgagattgttcattgttttttctcacgagaaccggcctccttaagtacatcgtcttagatagcagaagtaagtcatttcatgacatattcgcaggtgcaaaacatatttatcatagcaatattgtttctctagatcgatcacatgtggtaacttctttttggaacatcctatatatatgtcgtgcaaacatgttttttcactgatacaataatttcatatctaatcatttacaccacattcaaaacgtacaagtagacatcaagcaaacaatcaatcgaatgaacaaagccttgatgagactttaggatttgtgggtcatcctatatatatagtagatataattaatggagcagtaactattatttcttctcgtttttcttttgcattagtgaggcttgaatgaaatatatatccttacatggtcatcatatgccctttgcatttttcaacaggatttaccactctagcaaacatgtaattcttgttcgtatagtaggaacacatccttagagttgatgatctagatgatggacatacatgtcttactcttacatgatcgagctagttacttttgaaccatatcacatactagtgcgcagtacatcagaacaaagaaacttaaaataatatagaaaaaattggaaccgaatttgctggtgtttggaggaatacatcttttccttaagaaaaaagtatgttagtataaaataaagatgcatcattagaatgacctaatagaatctaatatcattgcaacatatacattgttagaaaaatcaaactttgccggactcaaaaaacaactttctcgtttttttaccatgtttctcgaactgctaaataatacatttggtgcaaatacttttatatataaaagttttttaaaaaaactatataaatctatttttcaaatttataataattaatacttaatcagtaattagctaaaaatggcgtacccgttttccgtaccactgactctaaaatagaactcctcacaaagccagcaatgttcctcacatcttccaactgcaagtctgcagcacacatgggccgcacgcggaggccgccgcacccgatccgggccttcctcccctgaagccgttggagcccagcgaaccaccccgcgacacgtcgcggcaacgaggagttcgagatcgagtctccccggtgcgggccgggcccacgcccgcttggtgggccccacctctcgttagccgaagcgaggcgcacgcgcgcgcactacgcagacccgaccgcgaccggcaccaccaggtcggtctcggcggcgagggcgggcgactcggccgccgggtctcgcgcgcggcgcgagcgagccatgacgcgaacacgtacggggttttgtggtgcgcgagtgccgcgtcgtcgcccactcgatcgatcgatcgtgcgcgtgctgcgtcgcgtcgtcgatgctgtcctccactgaggagtactccacacccacacacacacacactccactgctatttctgtgctcctccggtgcgctgctgtacgtgttcatgggtactggactactggctagcagggagtgatatctcctccacgtgttcatactgcttctggttattttccactctcttcgtcccagaatatagcaacctagaattggatgggatgtatcctagtactagtaacctgtacagatacgtcacatcctgtcctagcttactatattatgggacggagggagtactatgtattatctctgttttttaatatatgacgttgtttactttttataaaaacaaatagagtacttcctcctatttaggaaaaaaaacttctaataatgaagctgaacaaacatctgttgagattcatctttagaattgttgattttctttttattacgctttactcccttcgttccaaaataaacaaagctagtgcgaaatgtggcattttctaattttacgaatccgaatagatgtcctctcatactagctagttttgtttatttgagacaaagaaagtacaattttatcaaagcattctttctaacatataaagtctttttaggatggagaaaacaaatcattatacaatgagaatctgagatatagggtgctaaaacatataaggtccaaacaaagcaaagtaccacaggcctacaatcatactccggctaaaacagctatggatcagtcggcagctaggctctcgatcgttttgggcggccgtacgcgcgcacgtgtggacgtcgttatctttgggagaagaaatgcatggctagtaatgatggcgatgattcaattccagcacctctaattatggtctctacactgtttctagttaggatggtcatgaatgggcaatcatcatgttcctctcaacaccggaggatgcatgatggtgatcacatacttgtcctcatgatctgatatggtgcgatatatatggagtatccactgaatctaaacaagactgactaattgcaagcatgacagacgccagctgcttagtctaagctaaccaagagtgttccaaattaatcatgggttttcattcggaacttgacataaaactaaacccaaaactcatagtttgaactcaaaccgactgaaattcaaatttaatcttataaagtttgaaatcatagtcttttattcattacccccccccccaagttaggaaaaacatcattaggaaacggtggtaggatgacataggagcacgtgagtttcctagtttaaaattcgtgacaatcttaagtaaccagttcagttaacgtaacaattatagagaattaatcctatggcccaagtcaggccaaagagaaagaaaacaaagactgatactctctccgggttgataatacttgtcgttttagacaagggcacggtcttaaaaaaacaactttgtctattattttctatcataatatgtaaaaaaaatattaacaaatatatgatcttattaattttaagactaatctatacatatggtcaccatatttaaaagacaaatattttaaaaatgattcataatcaaagattctaaaatttgacctcacccttattcaaaacgacaagtattatcagcccggagggagtagctaattaacggtgggcaagtatttccattggaaataaagggttcaataactgatgtacagccccagtatttaaggttaatttatatttatacggagtcaattcaacgccgattttttctcttcaaaaaaaagaaaaaaaaaagaaaaacagcggagtgctaattaaagcaccctatcagtcaatgctgccaaaaaaaaaatccagtgctactatttaatttgctcatgcatactgttttccgttgctaccatggatccatacacatgaccatgcctatacggcatgcactacagcctctacaccaatcatacattcttcagcactagatagttctacgcaatacatactacctctcgttgtaatctctcatcgttgtgaataaatgaattagcaatggcacataataacagtacacatgtaattaattggagcaactttcggctgatcgatctgcggcaaagcacagtacatgcgtgtatactgtagagcgacgggtcaggtgaacaagggtgtgtttagttcacgctaaaattaaaattttggtcgaaattgaaacgatgtgacagaaaagttagaagtttgtgtgtagaaaagttttaatgtgatagaagagttagaagttttttttttaaaaaaagttagaaactaaaccaagcccaagtcgaacaattggtcggggtaataccaatactcctacgtgcaagctagctagcttgtcatttcactcatcgacgcaagcgtgttttttttttctgctggatggccaggtgtttttttttcctcggcttggctcgagatcgatcggtccgtgacgaacgacgtacgtactatacgccggcaaaacggtcgttgctgcggtggaagctttgacccgtcgcgatcgatggaggcggcagctagcgggtgtgtgtccaacagtgcacggcttggacctgcgcgcgtgtggcgcggcgggttgaaaggacatgcatgcggtgcctgcccgggcgagatcggttgatgaggatgcgcccatgcagatgtgcagaggctgagagggcagattcgattggcattggcttgcccatgcatccatgtatgcatgcgcgcgcatgcagatttgatttggggtggaggggttggccgttgtgttgagctgctattgtgtactgtttgtttcgaggtcagatttattatattgtttgttttcgcggaaatcatcgttgggaggtcaatcttcacttcttcagccctgtttagttggcgagcgaaaatatctgaagtgtcatatcggatataccgtcacccattcaaagtattaaacgtagagtaataacaaaataaattacagattccgcctgaaaactgcgagatgaatttattaagcataattaatatgtcattagcaaatgtttactgtagcacccattgtcaaatcatgacgtaattaggcttaaaagattcgtctcgcaatatacacgtaatccgtgtaattagtttttctgtctatatttaatactttatgcatatgtctaaacatttaatgtgacagcgtgaaaagttcttgtttgtgaactaaacaggcctcgtctcaaagaccataatccgtacttaccttgctcaccacgatctagattaacatctattaagatccatgatagtaccttatgtgagactgtatcctattttatactatccatattttaatgtatgacaccgttggctttttgtccaacgtttgaccattcgtcttatttaaaaaatgtatgtcattatcatttattttattgtgacttgattcatcatcaaatgttatttaagcatgacataaatatttttatatttacacaaaaattttgaataaaatgaatggtcaaatattgataaaaagtcagcagcgttatacattaaaatatggagggagtactgcttagtactctccatcatttcgtctactagcactagaaaaggtcaattaacggagttactatttttaaaatttataacaattaacacttaattaataatgtgttaatgattttgtcacgttttacgtgcggctgttgagaatgcaaccatagtaccgaccgtacttccataaacgtaacctcggattctttctttcttttttttttctttttggcaacgttatgagctttccagatttaccgatccctacacagatagtgccattttttttcacactgcctactgggcagctagcaagctacccagctatagccagccagccagcgaagacagcagaacacagcagaagtgtgatccaagcaatttcgcaacatccatatgcatccacccatcgatctcgatcacggcatcacgcgcaccgccgttatttttctcaccacactaacgtattcgtaccagtctaccaccacaacatcgaccacatatgcaccgtccatatccaagtactatctcctatctccaaccacgcgcgcgagacgcggcaaacgcttgacacagtacgtgcctagctagtgctgctttacctgaaaatttactgcttctttccagcaccaactcgctatcactgcattaccaccaccaccccaccacggcacacaagctcttgccattttcttgttagatcattgaacgatattattgaaatatttgttccatattttaaaaaaaatatattatcaaaaaatgagtatttgttagagtcgactgtaattattaagtttatttattaaaataccataacctgctcaataatactcacttcatttcatgttataagtcattttgattttttaagttaagtttcttaagagtttataactaagcttatagagaaacataacaatatttatagcaccaattagtttcaatgcatctaacattgaatatatgttgatagatttttgttttatgttgaaattattattatagttttctatgaaacttagttaaatctaaagaaaactgaattaaaacaaattaaaacgacttgttacgtgaatcagaggtagtataaaacaactagtcctgtcagcgtcattttggctctacaccccatgagtggttttcttgaccagtactttttactttacctctggttgaaacgttcctaacgacgccggccattttgaccagcactgacgagatgaaccaacttaaggcccgctttctttcaatttgagattattataatccagattattgagagtaagctgagaaaaacagacaacttattaaaatagcttattataatctggaatccagcttattataatctgataaactcatttaggtgagcttttttctaaattattgggtgaaaaattacccaccatgctaccccactctctctttagacttgcaaacccaataatctaggctctaataatctagaaaagaaacaactaaccgtttaatctactacagattataacaatctagtttatagtaatctgacttaataatctagattataataaacccaaactgaaagaaacatggccttattaattaacgcgtacagatttttgtttgaacgaaacaagagacctgaaaatggagctaactgctgttaacctacgtaagcctgttccaaattaaccatatggtactagcactaaattaataacctatcgacgtgttttcttttccctaaaagaaaaaagaaaagcaagctatcatcatcagtgatcgatggatgccacgccaatgcaagcatgcatgcgtgatcgatcgatcgatccgagatgcctatctgaattgaacccggggagagctttaaccaaatcctgtcgccttcaagctgctgcctaaagctaccgcacattcgatcgaatacggaatactaacccaagcgaaagaaggtgaagcccagggcgatcgatcgatcgatcaacgatctacctctcctttccggcctatccatcatgcctaccacttggacacaaggggaaaaaattccattgctttgctttaattgccttttcctcgtcttcttcttcgtcttggtcttctttttggtatctgatgaggttttcttccatggtgctcgagattatatatacatatatgtagtataaattaatgtaggatatatatatacttggacaaattaaagcagcatgcatgagtgagagcttagaattaatggcccaggtcacacggcacttgggaggcgagtgattgatcggtgcgatgcgtggtggatcgttggtgcgtgtgatctgatctgatctgaaacctggaggggattgattgggtgtagcgtgtagtgtaccgacatgatagtcactgtacgaggttgagtttgatcggttaattcgttgggattattgctagtgagtactcactccgtttcaaaatgtttgacaccgttgactttttagtatgtatttaaccatttgttttattaaaaaaaatttaagtaattatttattcttttcatacatttgatttattgttaaatatactttcatgtacacatgtagttttacatatttcataaattttttaataagatgaacggtcaaagatgtgctaaaaagtcaacggtgtcaaacattttaaaaaggatggaattaagttgttgagtactcgatctagtgcggtcctgggaggattgcttcaatattctttgtgatttctgtggggttttgcactgctcttttctgtaggttatcatcatgttcatgtggctaggccgtgatctcgccggcggcttgccggagctcggccggccggcgtcaccgacatgagccgctctgtgtagtgacgtttcagccggcggaggtggttttggtttggggcaaatgaaaactcatggtcggatggtccgattgggaaatttggcccgtctgggttctggatagttgggccaccctcaatccttcatgggccttatgactcctagggcagcatattgggccggaaaggcgtagtatctggaacatgggctatatcatccacagaactcgaccaccgaaacattgggcctgtatgggcgttagatctcaatccgtacactttacatttttgtcccataaattttgtactcccaccgtcccaaataaaaaactaaaaataacccagtaggatgtgacaccacctaaaacaacgaattttaacaaaagattcaataattttttaggaaaatcgtaaaaatcatccaataagacgctagaaatttgatattccaccgcataaatcattttattgcatatgcccaccacttacttaattttattgtaaaaaccaccccagtgcgcatgtgcttaattgaatcagcccattatcgttgatgtagagccaccacagactaagctaactgagtcaatcttattcaagtgcttatattagactcttttttttcatgtttcattgaattttctttcatatagcgaaactcagtgcgacaacgtttaagcttttatcaacaattctatttgtggtatctccaaaaaaaaaaagggtcaagattacactcttagaagtatttaattttggtaaataccacattaatagctcacaattttataaaaatatattgattcagctaagcacgcgcgtactagcgtggtttttacaacaaaactaagtaggtagatggacgtttgtaacaaaataacttatagagtgaaatgccaaactttaagtaacttctggtgtggtttttgtaattttacagtttttccaatgtttcataatataaagcgcgcatgcatacatgcaatttactagcactcccctcctctttaatttattttctttaatcctccatacacaatatctctaatttttttggtgtatttagggtgtgtttgaggagattgggaagatacgcaaaatgagatgagccattagctcatgattaattgagtattaactattttaaatttaaaaaatggattaatatgcttttttaaggcaactttcctatagaatttttttttgcaaaaaacgcaccgttgagtagtttgggaagcgtacgcgtggaaaacgatgtactttctccctcaatgtcacccgaacgaacgctgctagcagtagaaatcttcatactgaaaactaattgggttaatttacaattacaggttggacatattcgtcgtccattgcccgccaccatcaccgaggaccaaatccatctcttttaggcccatagtcaaggcccataaggtagaagcatgcctcatccacctctaccgaaccgtccccttcgtggccctcctcaatcgccgttgcttctccccttcgctgcagctgagcccccttcctaagctcagtgtgacggatccgcctcgcccaagctcggtcacaaccttcgtcatcgtcgaggttgctgtcacgtgcagtcacaatcgtcttcatcattgagatcgccgatcgcaaccatcatcaccaaccccgttttcgccgccaatgtccttccctctagccaaatctggtagggggaggggaggggagtggagtggaggagggagttgttgtcggccgctcctatcgagaaagtgagggaggtgagttgagagagcctgagagggaaggaaggggcaaatgtacttagggcctcttttggggagctcctgtcagttgcagcttctcctagaatttccaactgccaaaagctcccccaaacaattcagattttcacccatattttaaaaagctgtagttgtataatccagaaaataaactagaagccaaaagctgggtttactagcttctccatattctcacctgctgcttcttaaaatcttaagctccaccaacagggtcttatgctcggcgacttctcgctcttgctgtgctgatatttttgtagtgtttccatgttttcgctagtgggcctctttatgcctcgttggtaaaaatcaatttttactaaccgtgtctaaagagggaccatgtgtgaaaatgaggtattttttaaagctgtcctcttaagactctgttagtgaaattcaatttttactagcgggcctagggtgtgttcggtgctctcagtttccaactcatctccctcattttccgcgcgcatgcttttcaaactactaaacggtgcgtttttttaaaaaaagtttatatacgaaagttacttaaaaaatcaaattaattcatttttttaaaaaatagctaatacttaattaatcacgtgctaatggactgcttcattttctgtgtggagaagatgggttcccaaccccaagttacaaacacagccctcttgttatttttataagcgagaatttttagatccacctggaaaaaaaaccatagtgagtatgtggacggtgcagcatggccagagatcatagttgatagcagcaggcctgaagaatgtttctgaaattgctcatcaacaatatggactcaataattgattagaggtagaaacagtgtttcattgacataattctctcatttgtgactaaggcagtggtcgcaatgaaaacatggtaatgcatccagcggcgatggctgagggagaagggcagtgcaagggtggaagtgggaagggggtgagtttatgtgggatgtgaaattgatccctttgtgattggaacaggaagagactgagatatgacaaatctgattcccttttcttttttaactgataaacaagctgcttaaatcttttttgtactcttctctttcttttttccttgtagaaaagagaggaagctattatttgtatgattgtatctacatggacaaaaaaaaggtacattgacaaggagatatggagattttttttccacttgctccatcacaagcttttaaaaaaatgaacaaatgggggtcccagcaggatcatgtttcaaaaccgatcaaaacacattttgcacatgagatgtctgtgtccagcctttgcttccaggaaatggggcatcgctgtcaggctggttcctctctacttccttgagagcctcttccactgccttttccacttcacaagccgcaatctgtgaaaatgacacatgcgaaattaaacgtcgttagttagagtgtacaattggcttactattattaatcaactgctagtgttataattataataaactttttcagtttaatattggataggcatggactgtaattggccccgattgttgctctgtagtataaaatatggtatggctgtttggaatttggatgtttccttttgaaagatcatgtttggatgtttgtgaactacttgtaataatcttttgaggaaagattgatttggcagttggatgaccagtgctaactaacaacagttgctgattaattaaacctctaattacagctatttgtaattggggtcttggggttgaggatctgctaaatgatttatgcataaaccaaaagattcgacaagaactcttgacacggttgactaatgtcaaattggggggtttcgagtgga

SEQ ID NO: 59343 - DNA, 49809 bp, Oryza sativa
aatccgatggaaaaaaaaatcctatgaaggtctttgaaacaaaggattgaatcctatccaatcctttaaaattcctatggaatgggtaatcctatgtatattttggaggaaagttagcaagaggtctaacctcttggaaaatttcctctgagtctatctctctcatgttcagaatcctatgtttttcctattcctttgttttttcgttcctatgattcaaaggtagaacctcatggaaagaatactttgagtctttatctctcctcaaatttatgtgattttcctgcggcccaatcaaacattcattcctatatttttcttgtattttgcaatcctctgttttacactagaattcctgtcagaatcctatgttttttctattcttccatttttttcattcctgtgattcaaatgggccctaagtgtaaaacagatgattgcaaaatacaggaaaaaatacagaaataaccatttgattgaaccgtaataaaaacataggaattggatgagagagactcaaaggaaagttaccaagaggttcaggttgaacctcttgctaaatttcctccataatttctataggattgtcaatttcataggaatttcaaagcattagataggattcaatcatatgtttcaaagggcttcatacaaaattttcctataggattaaaatcctccaaaatttctatatttttttctccaaatcaaaggggccctaaacaaggccttaacgtggttaggatcaaagtccagacctactacctctttgttgggccagtttaaccaatgttagttaggaaaaatggattttaatatccccttgagatatattacttaaatagtacccctccatcctaaaatataagtattttttgatcctgatacagtctccgagatgctactttgacaaacaatatctataaaagtaagatgttttaaataaaaatagttgcatattatgttagtttgtttaatgataaatctagtaacatcaattttacatgattatattttttatttctttgctattaatagttaaagttaaaaatgtttgactcgttactatgctaaaaatgcttattttttaggacggagggagtaataaaaaaatttaaagagaaaaaagacgagatagattaatatgtgatatataactccagaaacatgcaaatttatatttgatagccgcaagttgtaacaaaagtaatagatttaactgtaacttgtacacatatgctcaaagtcatatttattttttttcaacttgtagaagttaatattaaactagaattttgtgaagtgatatattgtatactaatctatcttattattttattgttctttttaagaaaatcataactttgggacgatatgtaaagaatgaaacgagagctttgcctgttacttaccatctccacggcttcgtcatcgttgattttgtcacgaaccgtgtacaaggctacaaagtagccgtagcaggatttgccatttttgggtgtgtgagatctgactcatccaaagcaaagcatgcattactgtgatctgtcctccagggcttgcttcctgccatgatagctagggcaccatttgtcgccgtctccaacctaaaaccctcgctgctgagtaggaatagctattttttgaattgggaattacctcatccatagaaattttaccagtgggcgtgaagagacagactacgggaggaacaagaaaatcaagcttactagtattggagaggcttttgtgcgtgacagcgtgagagtagctccaatgttaggctaaaattgaaccgtgcgcacaaaaggatcggaccgagcaaactgagagtcgacttgtgtgttagagcaagtttaatagaatagctatctactaactctaaatcatctatagtcaatattataatagccaattaatacaatagttgcttactatactattaatacctgatctcacctgtcatacacatattacatcttggagtccatgctgcagctggctacagatctgtaacccgctgctcttctctctctttcttttatctctttaaaatatgtttatagctggtttatagctcgctattgtacctactcttagagcaaggctaataatgcaaccgacctattggctataatattctttgtagtcttctctcagtctacccgtataaatagttagctctttacaattaataaatggtccacttgtctctctcacagagtttcttagttcttgtgtacaagccggctataagtttacagtccgcttctcctctctcctctcttctctcctccacctcagtatttagctggctctcttagtgaaaaaagcgacttccaatgagcaaaaacatttcctatcatagggtcacacgagtgggtagggcggacgcaggtgagattgagattttcatcccacgaatcaattttcacagcgatcgaacagatattttgttcaattcgcttgcatggactgcactagtcaaaccaacagtagagcactactacaaaacatatagtgacggaagtgataaaaccaacaaatatagtgcctttcctacccacacgcccatcagcccaccaaaataccaagaaccggcatctttatctcctaataggtgccagtttttttaaaaaaccgacaccttttacccctgtcagaaatagatgccggttttaatttaaatctaacatcttttagttggcgctaggcccacccaagaaccatcatctttgtggcaaaaggaataagtgtcagcttttttaaaaaaatcaacacttataatatattatagatgccagtttttaaacaactgacaccccataaaactgagccgcacggggaagggaggcgtccgttcttatccatccatccttctcttacccacctctctctctctcttcttccttctcttccctcccctcggctctctcatgcacccaccccatcgagcggcggcggcggcgtcctggcggtggagatggccacggcgcctcccctctgccagatccgccggggaggggaggcgtcggcccaacacgaggtgccgcagcgggaggcaacagcgccctccgccagatcctaccgggagcggcggcccgacaggaggggggacggggacggcagaggcaggcggtggtgagagggaaggcggcggcggcagaggcaggcggttgcgagagtggaggagacggcggcggcagaagaatcggatttatgttcttgtttctcatgtgttcttgttgttgttcatgcaaaagaatcgagttgaaggaattgagattgtgttattgttcttgttcatgtgaatcgggtgtgttcttgattggtcggggtgaaagggatctactcggctcgatgcatcagccgagtcggcttttttttattcgtaaaaccttaaaggtgtcggttctaaaacgtaaaaaccgacatcttaccaatgtagatgccggttctataaccagcatctaagagggtttccaacaagcaccaaagtgctttaatttctgtagtaatggaggggccctgataggagtagcatttatcccggtggagtgtgcagtgttacgaggacatgctaccgctatagtgtgaggtacaacatccaagtcaacatgaaaaaatgagtaattttcgtaacaccgtataaactttgctaaactagcattcgatgttttctacaggagaaacacaaattttacactcaagttattgcataactatagttttagagctccaccttcacatgaaccgctacaagacaagtgagttatacatgtcaaacatgtagtttttctcgtcaaaacctatcattttcttcagactagcgagagtgcgagactctattcgtcggcgacatggcgttgcacgtactggtggagtctaaacttctagttttatgaacgacgacttagcttaaatttcatagttctatgagatataaaatcatgaatttgtagtagtgtgataatttagataaaacatatttgctccctccgaaaaaaaattctatgaccgaatctgaataagcatccatccattcattcttgaaaattagttttttcaaagacagagggtgtacttggtaaaaattaaagatgtcaagtgtgaaatggattctaatctcttaaggggatgcctcatcgtttttgcatgtcatttaaataattataaagaattaaaaaatagcaagataaaataatatgcaatatattacttcagaaatatgtaagtttaagttcaattttgatctccataggttataacaaatttaactctaaatagtatgcgtgtgcttatagttattttttttaacttgtagaagtcaaatttaaacgtgcatgtttgtgaaatagtatatcacatattaatttgggtattaatttatcttatagttttttaggatatatataatttttagacagacaagaaacaagaaactgataacatccgccgagagattaaaagaattcccctaaaagtatgtatgatttcgccaaatttactgatgttttttcattacaacagagattgcaaaaggctagcaccgagatacttcgcactatcacatacagaaatgcagaatttatacaaagtgagtataactcaactgatcaggtttcctgtggtggaacctgtccaccaggttcaaatcttaaatttaacatgggcttgtgtttgtatcatttatttaaaaagaaaacaaatgagctaccctggcaactgccggcattgctatatactagctagctagccaaggtgaaagctgttgcaggtcgtctgcagcaacgggaggtaggaggtgaaacccagccgtgacccctccaggtcgaactccagcaggttgtcctccatcatgtgtccgccgatcaccaccgacgtctccggggctacgcctccatccacaacgccgaagcagagcgcgccgtccttggtggccaccatagagttcgccccgaacaccacccacgacacggctttgctctgcagcaccagctcgacggtcggcacggccggccccgcgcgggtgctccccaccatggtcccgtcgtagcaaagcttgaacggcgccacggccggcacacggggaatcatagccgtctcggcggcgaacgcgtcggtgaccgccttgtagatggaggtctccagcacggtgtaaggggacaacatgctcagcttggtgccgcccactccgctcttggcgatggccagcagcgtcgcgttcaggggcacggcgcggccgttcaccttgatgcccgtcacaccgatgaagtactcggtcgacttgtcccctgccgtggacaccccccgttgtggtcaccggattgacgagtagcggggtgtagattagtgacttggagaggtccatgacgggctggaactcgtagggcgcgtcgccgaaaacgacgacgccagatgactcagccggcgcgaggcagagcgcgaacttgcgggagaagcggaagatggaggcgacttgcgtggggagcgcgaagcgggcgcggctaagggacatcatgcccgtggccgcggcgccgaggcctttggtcagggacgttgcaccgcaggtgaacagaaaccccggcgcggtggcgcgcggaaccggcatggggcggcaggtggtgtacagcgacagcttgtctgtgatgatgttgccgccggtgctgacgcgcgtgatagtgtactccgggaacccggtgcaggtgtcgttgaggcagcccggggacgccgcaccggagcagccggtggcacaggcggcgctcttcgcgaggcggcaaggcttggacccgcacggcacgcgcgcatacgacgacgactcgtacccggactcgcagtccacccagagcatggcgcccgcgaggtcaaccacggccttcacgggcacactcggcgtccgctgccagaacatcgtcacgtactgctgcgttgcgccgtccttgtccaccggcagcagcacggcgctcgggctactgcctgaagccgcgcggcacggcgagagcgggacgaagagcagtagcactagcactggcgcggtggaagcgagaacgagacgaggaggtaggcatgccatgctgggaaaaccaaggatgtgcagtgacggtagtgaaggatcgaatggtttttatggagcgcgcgcccacgcgcggccaggagggtaggtcgccgcgcagacgcaggcgcaggggcgagaccgcgccaggtcgcgaagtggacctccggaatataactcttctaccacttgctagtgctgctcctgtattttaaggtttgggcaagtgcgatctttgaacaaattaacatgttttttatgggtgagatgagatccaaagggaatggatcctatattactgtgctctttgtgatcctgtgatcatgtccctgtcctgagcccctgacgcggtgacgacttaccgtttgtcgctaatctgatataatggagtaaaactctggttagaatctcggagaaaacctatgacgcttgtgttgctgacaactcacaagtcattttatagagaatcaccctcatgcgaaaatatatatcgatctccgttcaagcccctatatttatagataggttgatttttataggtgggcttttaagatgttcgctttaaaaattataccacatgagaaaataacgatgaaatacaaaaggcattggccacaaaaggagcagctaagtctccttctcacttctccctcattcctgttgcctcctttccggtgaagagaaaataacaatcaaatataaaaggcattgtccacagaaaaggcggctaagtctttctctcacttctcccggcctctttcctgttgcctccctttcttcaggcgacctctccgtctttcctatgcccctctcccttcctagcgacggctgcttcaagcggttgaggcgaaggcgtcgggattcgattggttgatagaagcggccacaggagggcacaaaaagcaatggagacggccgccacgtgcacatctatctctctagatctaccgacgggaagggtcggggatgatggcggactgcaccaatggcagcggcttcgtcgacgaatttttattaatttgccgattttgtcggggagttaggtatcgacatgttatatacccgacaacggtactttatgaacgtagcgtacaactgataccaacatatgcaccagtatggaataaagagacaagtaacattgattttgatactaagttcgagccctcaagaagggtaataacactactttagtttcagtataaaggagaagcaaacaaattaatcatgagaaacaaggcagtgggttgtattatgtggctagctatctgtagggcttcctcgtggtgtaatctcagtgtggtttgtatctatgacttacaagttgtaattagatgtcctcccctctctgggggcttggtatctaaatatatgaaagcaacaagctttctaaaaggaggataagccacatcatctacaatgtattgaccgttggatgaactggtaaatgaaaatacaccgttggatcatcatgctcatctatgacagtggaaacacgttggaccaatccggatgcttctagactaaagacctcaaaaagcagagaactcatgtgcttagtctatttaacactaccgttaaaaaaagtctttttaacactatatatatgtttgcttaattaatctcctggctaaataaaggaaaaaaaatatgacgccttacccgtaaatttatattgaatttatatgcaaatttatatctataatgtatactacttttgattgcttggtattggagcaacacacagcaactaagtagtatccactgtgtaccaattttattttaaaacagtccctacaaacgcacacactacacttaggatcacttagtgttattgttgtctccgttctaaaatataggtgcttttaacattcaaaatttctcataaaatatagctatttctacacctactctctcatcttaaccaacatagtcatatcctatttaatttcttcatctactttataatgtcaatcaattacagcattcctccatttacatctcttgctactgcatcattcccaaaataagtattatggcaaattttatatagaaatataaagcatttctaggacactaatttcaatgcatatctaagtatttttagccaatcaggtgttcgaaagagccaatcggagtagttcaaaatttgatagtaagtgatcgaaagaaatcattcctccttaatcttactctttactaaacaaactagaaatacttatatataggaattaatggagtatatttgaaaacaaagaaattaaagtacttacaaaaccggtaccttcaattaatgttaggatcaatgtctcaagtctaattatataggtaggtacgctaacgctcaaagtcgcacaagtgcgactaagtggctagtttatattgaaaggctaccccttgtgcaagtaaaacttgggaaccctaagtaaggtatgggcagacaaatacctatctttctcgggttagactccataatccttccctaaacaagcagaattccttccttacatgtaattttgtcttagatatatccttcagtataacattaggtatacaatattttcgatggtgaccaatataggtatacaaggtacgccatatctataacattgatattatctttccggaaaacttttttttcaaaatttgtatttaactttttgccaaaaatctttttcagccgaacgtcttaatgcacatgcctgcgaaattacttttcacacgcagttgtggtgcccttttatgtcaaattcattttttcacatacgtgcaatttcaggcggacactccaccgcctgagaaaagggattttagccgtacgtgaaaatgagttttgtagtagcgccggttgtaatatcccgagcttcgaattagtatattttggaaaaaacaatcaacttttaaatcattgtccgaataggcgatcagaaaccgtggatgcgtggatacggcatctggcggttcatgagcaattctaacaacaaagtagaaagggaaaattagaaatgtaggtactagttgatagtattagctaccatgggtccatggctactacaggttgcccacagtattgctatctgctagccgaggcgaaagttgttgcaggtcgtctgccgcaacgggaggtaggagctgaaacccagccgcgacccctccaggtcaaactccagcaggttgtcctccatcatgtgcccgccgatcaccaccgatgacggatacagcgcggggccgccgtccaccacgccaaggcagagcgcgccgcccttggcgggcaccatcgagtttgccccgtacatgatccacgacacggcctccctctgcagcaccagctcaatcgtcggcaccgctggccccgcgcgggtgctccctactttgcgcccgtcgtagcacagctcgaacggtgccacggccggcacacgggggatcgtggccgtctcggccgcgaacgcgtcgatgaccgccttgtagatggaggtctccagcacggtgtaaggagacgccgtgctcagcgtggtgccgcctacgccattcttgtcgattgccaagagcgtcgcgttcagtggcacgtcgcgcccgttcaccttgatgcccgtcaagccgatgaggtactcgatcgacgtctcccccgttgtgtacttccccgccgttctcaccgcgttgacgagcagaggcgtgtagatgagcgacgacttggagaggtccacgccgggctggaacacgtaaggcgcgtcgccaaatacgacgacgccagctgcggaggccggcgggagacagagcgcgaacctgcgggagaagccgaaggttcgggcgagctgcgtggggaacgcgaagcgggcgcggctgagggacaccatgccggtggcgccgttagcgaggccctcggtcaagaacgtgtggccacaggtgaacaagaactccggcacggtggcgaacggccccggcgcggtgcggaaggtggtgggcagcgagagcacgtcggtgatgatgttgccgccagccgtgacgcgcgtgaccgtgttatccgggaacccgctgcaggtgccgttgaggcaggccggggatggcgcgccgaagcagctgttgaagcagccgccggtcttggtgaggcggcacggcttggacccgcacgggacacgcgcgtaggacgacgacacgtacccggtatcgcagtccacccagagcgtggcgcccgcgaggtccagcacggccttcacgggcacctgcggcgtccgctgccggaacaccgtcgcgtactgctgcgtcgcgtcgtccttgctcaccggcagcaccacggctctcggccggcctcctgccgccgagcggcacggcgagaccaagacgaagagcaggaggaggagagcgccggaagcgagaggaggaggaaagcgtgccattcttctgagaggaaggatgcgatattccgatggggtgtgaaccattgcagcggcgaggaaggatatttatagggcgcaccctcgcgcgcggtttggtatttcggctctcgcaccaatcaccatcccagaatacaacggcgatggatggcggtggtagcctggtagggcagactgtatagtcgcgggccgagcgagagtacgactgtacgagacgccgaagtggaaacggaactctgctgttatagcaaggaaaatgctggtagtatttgacggtctgggcatgtgcgaattgcgacctttgttctcgaccaattgcgggccaccatgcaggcaggcaaaccatctgcacagccttttgcaggggtggccattgttgtatgggtgatgagatgatggtatccaactcatccaactaatctaaactggaccagtgctgatcagctggagcgaggggagctgaaatgggagaagactgcacaagcagcgacggttgattacatttgctgacaaagtaaggtcaagtgcttgagattacctatacattttacgataaattttctcttaaaagtttgatagatataattataatacaattataatgtaattacactgtaacttacatacagcttgtatgtaactttcaaaagtctctccgtaacatgctatttccgtcaaacggaggtcgtggaacgaaccctcacacatatgtgcacacagcgactttttttcttcatttgaatagatctaacgatttaaaattatgtgaaagttacatgcttacattatagttgcatgcaagttacagtgtaattacattacaattatactgtaattatatatattaaatttttagaagaaaatttatcgataaatatatagcaaaattaaattacattacgattgtactataattacatcagtcaatattttagaagaaaatttatcgataatatatagcaaaattgattccaaattgttgtttcagtcaaacgccacctctcactatcaaggatatggtaaagaacaagtagatccaagtcaaatgcctacgctggttgactagttgtaatggatgaacaatttattccaacaacttcacacgattgcacaaagaaatgcaaagcatcttttttttttttgagatagtaagctaagctgcagtggcgactgccatgcgttgcacatctagccgaggcgaaagttgttgcaggtcgtttgccggaacaggagggaggagctgaaccccagccgcgatcccaccaggtcaaactccagcaggttgtcctccatcatgtgaccgccgatcaccaccgacgtttccgacgccacgccgccgtccaccacaccgaggcagagagcgccgcccttggtggccaccatcgagttcgccccgaacaccacccacgacgtggcctcgctctggaacaccagctcgaccgtcggcacggccggccccacgcgtgtgcccgccaccttgctcccgtcgtagcacagcttgaacggagccacggccggcactcgcgggatcatggacgtctcggccgcgaacgcgtcggtgaccgccttgtggatggaggtctccagcacggtgtagggggtcaccgtgctcagcttggtgccacccactcccttcttgttgatggcaagcagcgtcgtgttcagcggcacggcgcggccgttcaccttgatgcgcgtgaagccgacgaagtattcggttgatttgtctcccttggtggacacgccccccgtgctcaccgggttgacgaggagtggtgtgtagatgagcgacttggagaggtcaacaccaggctggaacacgtagggcgcgtcgccgaagatgacgacgccggccgcggcggccggcgggaggcagagcgcgaacttgcgggagaagcggaaggtggcggcgagctgcgtggggaaagcgaagcgggcgcggctgagagacaccatgccggtggcgccggcggcgaggccttcggtcaggaacgtggcgccgcatgtgaacaggaacgccggcgcggtggcgagcggccccggggccgggcggaaggtggtgggcagggacagcacgtcggtgatgacgttgccgctggtgctgacgtgcgtgaccgtgttctccgggaacccgccgcaggtgtcgttgaggcaggccggcgacggcgcgccgtcgcagctggtggcgcacgcgttggtcttggcgaggcggcactgcttggacccgcacggcacgcgcgcgtacgacgacgacacgtacccggcctcgcagtccacccacagcgtggcgccggcgaggtccagcacggccttcaagggcgcctgcggcgtccgctgccggaacatcgtcacgtactgctgcgtcgcgtcgtccttgctcaccggcagcagcacggcggacgggtcgccacctgacgccgcgcggcacggcgagaccgagacgaagaggaggagcaggagagccgtgcaagcgacagcgagaggaggaggcatgcgtgccatgctggaaaggcgaaggatgtgactgatcgatggtgatgtcaagaagctctgtggcatggaaggatttttatagcgcgcggcgcgacgggttggtcgctgccacgataccgcggcttgcgacggtgcgactcgtgcgaggcagcgagtgatgcgaagtggtgacgcgcagccgcgggcgggagccgggagacgccgaagttgaccggactatgactcttctactattatgactatccagtatatactcctctattttggcgcttccattaatttatgatttggtcatgtgcgaattgcgatctttcaactagtcgttggcgtgctaagcatggatgctgggtgttgccatttttgtatggatgggacgagatccaaaggcaaatggtttctgtgcgcacgtgatcttgtcccaatcccaggcttatcctgccataagcctctgacccggtgacgcggaaccatttgtcgttaatctcaactaaaaaactcatgttagcgaaaaacttttgcgtggccgacaactaacaagtcgtctccatggagaatataatcgacgcgggattttgtgggcgggcacaaccttgaggccatgggatggaaggaagtctattttgcgtggggcttttgttcagaggagtaaaaagttggccgctgatccggcacgcggggcgtgcgccggcagcttttcttctggtcgcgggtgcacgccgactcgccggcgcggccatggatctgcagggaacgaactggaccacactgtacagtgtccactgtccaccgtgcgaggcgataacgacggttcatctgctggcaaagttggtccaacttgggcgaggttgcaatgcaggaggaggtgggctctgcagcctgcagtccaaccatgccatgggatatgggccatggtccagccccgtgtcgtgatggactaaaagctaggatgggccgaactatcttgattgggctcaattggccagggccatattacaatgaatgagagctccatgttttacatttacatttaagacgccatacaatttgataatgtggtaccttttcagcatgtaaaatattttaagagacaaaatttaaaaatgaatatgcttagtgtaaattatttgaaaaagaggcagtacattaataggcaaaagagttaaaatatgatattggtttgatgccgaaattgtataaatacgagaaataaaaagataggtaatcagatttttctaatatatgtttttgttatggagatttgctctttactaggaacttgcgttaataaattttggtgcatagcaatataaggtttagggttcttttgaaccgtgggcttaaagaaacatatgaatagaggaaaaaaaggggcaattgcttatttgaccctgtttcataaactaagtaccgatttgaccctactttttcaaatcgaacataacgtttgaccctaattgctctacatggttaaagtttctttagaaaaaagaaaaaaataatttgttattcaaatagaccaaaataccctcacttctctctcatctctttctctctttcctggcctgactcactctctctaactctctcagcgcgagcagtggtagcggcagcaccggcgcgagggagggaagtgggcccggctggcgctgtagagaaaagccacgccgccggtgcgcggaggaaggaaggaggtagcgccggcactggcacaggcacgcggaaggagggaaaacggccgcatcggcgacaggcgcgcagaataagggaggcggcactggcgccggcgccggcacagccgcgcggaaggaggtaggaggtggcggcagccaacgcgtggagggaagaagaggcgccgccggtgtgcgaggggaaggaaggcggtgagcctgggatagagctgtgaaggctggatctggcgagggaggggtgacgacggctcggcggagatgaggattggaggcagtgctccacagctgtcggccggtgtcggctcgccctctcactgctcgccgccttctccctgctagtggagctatggaggagagaagaagagaaaagagaggaggagatgagaagagagaatgacgaacgggtcccacatgcaatagggtcaaatgagtaagggcagaagagatattttgtacttcagttaacaccgttagatgcctttaacagaatatggtcatacaatatcttcaattttgaaaagaatggtcaaataaacaaagttgataaaaggggtcaaattggtagttagctttcgaaagagggtcaaatgcgtaattccccaaagaaaaaaactggaatagagcatcatggcctcatggctagcctaatcccataggaaatagaaactctggaattctagtaaaagaagttgtttggctactgtatgtctgtatttgaaaaccacgggaattaaaaatgaaacacttcattacaataagtaaatagggaaaaaaataaagagacatttgccatagcacgtaaaaaaaatgaaaaacactagggctgagttcgacaaaaagaaaaagagtagggagctcatcccataagcacttaaaatgaagtgacttattagtgcatgattaattaagtattagttaattttttttttcaaaaatgggttaatatgatttttaaacaacttaactatagaaattattttgaaaaaaacacaacgtttagcaatttgaaaagcgtatgcgtggaaacgatggagatgagttaggaaagatggttgccgaacatagccttaggttgagttcgtttctaattttcccaactcacctctctcttttttcatgcgcacacttttcaaactactaaacggtgtgtttttttaaaaaaattatgtacgaaagttgatttaaaaaatcatattaatttatttttaaaaatgattaatacttaattaatcatgtgctagtgagttgctccgttttgcatgcgcgagggattagttcccatcccaagtgccgaatacagccttagggtagggcaatgttgtcttcaatctgcattgtgatgcctaagcatgtgcactaaccacttttatcgggtgcccttaggtaagattaaattgtagccagttgagactactctagctctcaatggtgagaatatagaaatacagactcaagttggggagtcgaaccttgagtacctcattggggtttccttgtttttctagagttgaattcatgaatgcgcttcaactagccaagaacaaccagggtttcccctgctggcagttaccgcaaggtagccacattagccgagctttactacagggtacaatagggttgaattcatgaatgtgcttcaactagccaagaacaaccaggggtttcccctgttggcctgttggcagttaccgcaaggtagccacattagccgagctttactatagggtacaataggggtaaccgctggtaggatttggggaattctgtttgaatttaaatttgaataaaaaatcatacaataattcaaaataaattcctacaagtagtacctattttctattgcaatatggtgaacaatatttgtgaaaatgatgaagtttacttcattttggagctccattggaacaaaaaaaaatgaaaaaaagcaatagatgggttgggatataatacctactttgtttaaatataaaaaatatatatagcaaatgttatgccaaaaaaattatgcaatattacattatttttctagagacaaccatgttttttcatgaattgtccatgagtttttctttagaaaatttactacattttacattttttccgcaattgtttcttttcagcttcaacgcgcactgcatggtaattgtgtattaccgcatggagtttcaaattttgaattcgaagtttggaatatgaatttatagtggttaccatgattactgtgctaccactggtcgctaaatagtctgctggcaatagggtaagccctaggaacaattaataagtttacagcattgtgcgtgttcaatgggctatgtgttttccatatatcggataactagactacccaacataatgcacgtgcgcaaagtaaatatacacacatgtatagtgtgagctgctaagcatgtagactgtagagtgggtgtgtttaatgtgctgcaccttctggttgtttttttcccttgctatagtttggtcaaaaatcatatgccattatactctcttaatagtaagtacatatatgccattatatatgtacttataggcaatctctagattcatatattaaatttattcatcatgccatattagagcgccgtcttcgtctgagtggtaaaattacgtcttatgtggaacaaacgcacaataacatggtcttaatttgtattaaaaaaatcattgcaatgaacccacgcctatctttttcaaattagactccaaattctcattcaatgagttttccccattcaatgaaaagacaagtataaacgtgtttcatggatatagacaagatctcgatggcgcttccaagcgtgtcatgcttaatattggacaaaacttgtttttcagaatccgaagttcatggttttagttgtacaatatcgaaattgtacggttcactttaagaacatcaaaaaatacctcagctactcatttctaacatttggtcaaaactaccatgaaatttacttaccatatcgttacgccgtcttcttcacctgaagcatctaggcccccggtgttaattttggtaattaatgacaagcattaattgtggactaaccgttgtgtttgagcttatttatttgagttaggttcacttatttgtgtgcacatggatgatcattgatggattaaaattgacggtgcaaagcaaaaggaagagaagacggtaaactagtgttttctttttaaattgatcgaggcgttgggcgatcaaaattgtgctagtttatttatagttttgccgtactactaagagggggaatgacctagcaaagagatgattttaattgtcacattaggtcattgcattttcacttgtactcacattttcacaacacacttgttatatttttgtcactgctctggactgccagggtcggtttgaccgccggacagatgccggtttgaccggcctgtgtcaccggtctgaccgccatgtcaggaccggtctaaccgccgcaccaaagacggtctgaccggccggctatatggctgggatggcatgctctgggatggccgatcccgagccgccggagccgtattcggtcagaccgagctggtggcggtctgaccgagccgaggccagtctgaccggccaccccatgtcggtctgaccggccgggggcagtggggcccaatgacagccctacaacgggctagaaaactagccgttgtagagtagcacggtctgaccggccacatacctccggtcagaccggtagagcactgagttaggggatttcgcccccaacggctagttttggttggtgggagtataaatactccccctccagcagcaaggggactctcttaacacccaattcaattgcatacatcccttgcacctctctcacacacctttgagcttagtgttcatccattgtagtggttgaggttgttctagccaagagtcaagtgcatttgcttccattgtagagctagtgtggcacttgattgatcatctccatgccgggtcattgcttgttactcttggaggttgccgcctcctagacggcttgtggaggagttgcccggtgacctctccgagaagattgtggaggaggcctggtgccgatttttgagtggtttggagttcaccacctttggagtgaaggaagaactaccctagtgatcgaggcttgggtagtcctctccgtgggccggctcccgccttgtccaccccttgacgaagggggtgtgcggtggcttcgtggttgagcggtggagttgggctcgcctcaatggggagtaggaaaccagcgagtttccgaacctcggtgaaaaatctcttgtctccttgtctcatttgattgtggcatttacatttgtgcaatttatatttctagagacatacttgagatcatatcaccctaggattgctaaacattgacataggagtgtgatttattttcctagagatataattgagccactatcaccctaggcttgcaaaacataacttagttgcttagttagagttgaccctcaccaagcctagcaacttaggttagttttgattacgtgtcatttagttttaaatcgcctattcaccccctctagtcgacatctcgatcctacatcacccctcctttgcaacaacactcaccaactaccgcaacaaagtatgctagatagaacaatgataagcgagctggagggtggcagtacatccaaacaaggttgatggacgatggtgagtgaagtggagggtggcgcatttggcgggctcgagggtggtgcaacatactagctcgaggacaacaatatcggggcaagctcgagagcgccaacataggggcatttagggtctaggtgagctcaagggtagctgcagctagtaagcttgacgtcaattgctattggcaaactcaatagtagcggtggccgacgagctcaagcatggctgcgaagcgtgatcaatgatatggtagggaggacgacatcaacggcaaagcacattcgatgatagcgaggaggatgatattcaatcttggtgagagaggattggaggtaggacaaccgcagaagtgcacgaagggtaacgatatgaatagctagcattttgcacaacaccaccattgttcaacacaatacatgttgtttggctcgtacttgtaacaataacgattactagaatacatggtacaatttaatttgtattggctacaggctcacacgctaaccatgaaaattagatagactcagagccccacgagagactttgatgctatagaactttctgagctgttaaagtgaaccatagaattttgatgttcgatgtgaatgaacaagctttgtattaataagattaaaagagcacatatgcacaaaatatcaattggccataatcattgtaagcactatacagtactccagtatttttttcatgggaaaacaagcgtctcctagactccatcttcttcacgatcttgtccagtactccgtattatggttgttaatctcgacaaatactttagctttacacgcctttataaaatcgaaaagaacgtgaattgaagataaaagaaaaagttactgggattcagatcgccgtcacgttccgcaccgtaacgaaacgtaaataacggccgccgaggaagaagaggacggacgagcagcgaagcagccgcggcggaagaagaaaaaaggagacgacccgtcgcgccgcggccgccgtccggcaaacgcggccgatccgactccgccgacccgagccgagccagtaaaaccccacccaaatcccaacacctgcaactgcaagtgcaaccccccttcctagcagattcgcatcgaatcccgatctgagctctcccctcccccgacgaccacctcgcagctctcccgccccgatctgcgggcgccggcatggcgcggttcgaggtgggcggcaagtcggtggagggcgtggacctgctccggcggcggcactgggcgtcgcgcctcgacttctggcccttcctcgcgctctacgcgctctggctggtggtcgtggtcccggcgctcgacttcaccgacgcactcgtcgtcctcggcgcgctctccgcctcccacgtctcgctttcctcttcaccgcgtggtccgtcgacttccgggcgttcgtcgggtactccaaggcgagacacctctcaactccccaatccccccaatctagccaccgctacgtttggcgcgctttagtgtctagggctaaacagctcccgcttggtgacggtgcaggtgaaggatatccgtgcggccaactcgtgcaaggtaacgccagcgaagttctcgggatcgaaggagatcgtgcccctgcatatacagaaaactgtgagtatggcgtcgttttactgtggagtgttggtgttttccattttttttggtcactgagtgttggtttgggtggctgctcaggtggcctcgtcatcggcagcaggtgagacggaggagatctactttgatttccgtaagcagaggttcatctactcctcgcaggaggacaactttttcaagctccggtacccaacaaaggaaccatttgagcattatatcaagggcactgggtatggaacagaggctaagattaacacagctgtggataagtgggggagaaacatgtaagctgcaacttagctccctactatttgtttatggcattcagtaatgagtaaattgatcgcttgtatggctgtgaatgatattatctataacaatataattcaacttaacaagtacaatctccgcaaaaaaaaaaaaactcaagcactattgtcatttttttttcaatggatgattgtcctggaaactagctaatcacccatgttttttccgtggataaaaatgaatcgcataggctcttatacgtttcaaaacagtatatgtgatgtttcatcaaatatgtctttcacatatttttgttacaaggagtatctgactgtgttgaaacaatcttattctaaagttaactcatacactacatatttgaattacatttaagtttccctaataagaagaaaagaagatgtaaaatatctgttctgtaatattgattaaatttagggtgtaattcataaaatgcagtgtcgatatggtgtgggggagattcactaccacaaccaccgtgccttctttttaaaggagtatagatttttgtgcaattgaagattaacttgtagtcacgtcttgaatggaactcctaacttcatgtaaaagacatgcctgaggagaagaggaacacaataaaagtagactcttgcgttttgcagcatatagggtgatgatgaagtagagtccaaagagcagatgaaagcatttagggcatacttaaatatgtttacacttgggactatctaaaaaactttcacaagtttttttggtcaaaaactttcaaatgtaactgtagtataattagagtgtaattacattgtaactacactatagttacaatataactcatatttaactggtatgttactagaaaaaaaaaaccatgtgagatgagttggctagctacagcacgtgctcgttcaacacatcacactccaccttcctacgtatggctgtgattttttcccaatgttgcacgaatctttaggcgaaacaatggttagaaatttgagagttttgattggaaaaaaactgttgcatgttctgtagcaaatccgttacactttgcactagaaattcaattactatctctttataaattgcgctatcttaagaccactttgataggcaatttgtatctttttttatctgattataaatactaattgggatgtaaagcaacaactgtctgtggtactttttttttggtgcagtaaaatgctgcaaaaaacacaggctaggtgtataaaatctgtatatctgcattactcaaatcaataatgtgaaaaaaaaaagagatttgtatcaaaactgaaacttccatcatatatacatatgtttagctattgtggattagtgtctgatgatcaaattgtttccttctctagatttgagtatccacagcctacattccagaaattaatgaaggagcagtgcatggaaccattttttgttttccaggttagcctatctcatcattgacttggtattttaatggttcatctgcctttgctaattgtgatcctttttttactcttcaggttttctgtgttggtctttggtgtctagatgaatattggtactacagtctgtttacacttttcatgctcttcctgtttgagtctactatggcaaagaatagactgaagacattgactgagctaaggcgtgtgaaagttgataatcagattgttgcaacttatcgctgtggaaagtatgcctgcttcatttgattgattgcttatactgtttttagcatgttattcatcctacttatgtttttttttattatacaaatattcagatgggttagaatacctgggacagaactactacctggagacattgtgtcaataggccgctcagtaagtggagaagacaggtctgtgccagcagatatgttattgctggctggatctgcaatagtaaatgaagctattctcacaggagaatctactccacagtggaaggtccctcctctcctttactcattaattctaatatattcttttttgtgtggtgaaacaaccaagggttacaagcaaacttattgattctgttattttttcttcatttgaatttaccaccaaatttgactaccagaattaaaaagatctaagaaatgttaaatccataataaactcccatgtcaaacatgcacatatacaattggaaaaacccattgtctcttaaaatgtggaacagatgtctccagagaatttacttacatcacaggtgtaggaactaggaatgatgaatttggcaatcagatatttgcatatactttaagcgtgtgagctaggtagttacttttttggcatggaggttaggtaataaaacaatatctggttagtttcccagcccaccattggaggagacactacggcttgtagcatatttacttgaaaggttggggatttgggggtttctctacaatgattgcattgagctggtatttctgctgttgtatttctctaattaaatggtccagtggaacaccccagttcttcttatcagaaacaaatagaattaaagaaaaatgcttcaaagacgcattgaattgtgttaaccaactgtggcatccaacttttgttttgtcctgctttcaaatgtgctatccctagtatttttgttcaaaattttcagttctggacttctggttctgactaatcttctattcttataggtctcagttgctggtcgtggtcctgaggaaacactatctgtaaagcgagataagaatcatatcctatttggtggcactaagatattgcaacatactccagataaggtatacacatctattatacctactgctccctctgttcacttttaggtagtgttttggcatgttgatttagtcattttagattttctacgtaaagttttcccttataacccctatcaaagcttaggaatctcaaaggttttctggttgagataacttcggctatgtcacagctccatgtggcagtgctgctggttgtatcaactgatgccactatgctttgcctaatgggtagatgggcttggaactaatgaacgatattaaactaatgaaggttaaactggctatctagcattaaagaggtgcatcgttctgtggagtatgttagaatgtcaagttttgctgattggagggaggagatgtactgggaatcttgctgacatgtcttacttctgtgcagtctataaatctccgagcacctgatggtggttgcatagcttttgtattgaggactggatttgagactagccagggaaagttgatgagaactatcttattttcaactgagagggtaactttttcatgcattagagttaataatgctgttaagatgtgcaaacataacactctgattctaacaatataacaggttactgcaaacagcaaggagagtggcctgtttatcctatttttgctattcttcgcagtaattgcatccggttatgtgcttgtcaaggtaatgccagatggaattatcaagaaaatccatatgtttaattgtatgctatatagcacacttcaatattatttgaactttggtctgtccgtatgtagggactggaggacccaacaaggagtagatataagcttttcttaagttgttcattgattcttacttctgtgataccccctgaattgccaatggagctctccatagcagtcaatacatctttaattgcattagcccgccgtggtattttctgcacagagccattcaggataccatttgctgggaaggttaataaaaaaaactttgttgtgcttatgtttaatccttcttgcaaaagcttttaaaagctctttattttttttatcaggttgacatatgctgttttgataaaactgggacattgacatcggatgacatggtaaatgatttacccatgtgttgtattttcaattcaagtggaattttgtcaaccgaggtgacatgcatttcaggaattccaaggtgttgttagtttggaagatgatgaagaattaataacagatgcaaataaattgccactccgcacacaagaagtattgtccagttgccatgcattagtattcgtagataacaaactggtatgtaatggactatatgtcagaaataactagctatgtgaagcatagccaacggaagtttagataccttcttttgttgatggtatgtttcatcttatcaaaggttggtgacccccttgaaaaagctgctataaagggcatagactggatctacacatctgatgagaaggccatatctaaaaagtaagttgttgcctgaaataacagatgtaaatatgtgttcattgtagaactgttcatgtgatgacctaaacctgatcagacaataatgtctatgtcatagttaattaagtgttatcaagtagatttgtaaaactgaacattagctgtgtgtctagtcaagcgaaataaactttcatattggttttaacactagtgttatttcaccttgtcagttatgtggcatgctgccaactttgtcccttctctgaagtcaagctagttgtattaggagtaattttttatctttattcatatatccaagattatagtggactacttctctctggacaatttctcttctctcttctgtttgttatatgcacaactgtggctctgtttatagcattggaaagtcctgtacacagatgatagactagatgttttttctatcaaaagcaggatttcgatgtttgattgacttgcatgtattacatccaaatatatctgaaatgtcaataccagtacagttattagttattgattccaaagtaaaaagatattctattatttattttacttgatgtcatcttcattgcaggtctggtggtcaacctgtaaagattgtacacagataccattttgcttcacacttgaagagaatgtctgttgttgtcagtatacatgagaaatattatgctttcataaaggtaggaattccgagagactacataaatgttttacacttttttcttttgttagtaagattgctgcttaggatggttcagaaacaatttcttttggttttggcccagtgtgcccatgcatttggcatgatttcttgttcttagatattttaagtcaaccaaaacaaatgtgattttcataaggtttgaatttctacatgtttatgaatatttattattggtttgaaccaaatgaatagtgagaagaattcaccttgttatcctacatatgttttagatggatattaactagggtacactaaattttgagcggctatccaaagagacctattcgaggcttggctcttttctctttgtttgaaatcataagaaaattagaagtcagcaaaggaataatttaccatttgtcatgttagaacttatcttcattcaaacaaaattaaatatagagtaaaatacacggccggttcttaaagttgagcgcgggtgccacttaggtccataatcttgtaaattgcacatctagatctaccatcttgtttaagtgactcattgaggtccaaaggatctctgaccgggttgactggcttacgtggcggtccagtgtggcaacatatttgcattttgcccccccttttgctttcccgtgtccgatccaatcccttcttcgcgtggcgcacgcaggaacgcgccgacggcgacgtgtgtcagcacgcgcagctgcggcacccacccgtctccaccacgccgcgcctcgtacccctccggcaactgctcaccggcgttgcacagcgcccagaggaaccgcacaccgtcgttgacgggaaggagaaggaggagtggaagggaaaggcccctgctctggctggccgctggcgcgcgcggcaagcggctgtggcagttgctcaagtcgagctcgccctgccgccgttgccgccgttgaggtcgcacccaccccgctcgccgacgcctcccccacacgcacggccacggtcggcgacccctccccccgggagcggccggcgacacctccccccgccgcgcgccgagctcgccgacgcctctggcgccaacaaccagcgggaaggggaccggtggatctggctgtcagttaggcgcgagcgccaccggcgcgctagctatgaagacggtgacggagctccgagctcgcccaccatggtcatggcgacggcgctccgcaagctctcctccggctccctccgccgcccgccaactgctgccgcattcgcccgccgccgctccgcccgcagcccaccgctgcgcttgcccaccgccgtttcgcccgtcgctcgttcttcaagaaggatttaagggtgacgcggtggggcggcacgacgcccgccgtcgagaaggtgatgctcgtctccagcaccggcaccacggccgacgtgctgtggcagggcggtgtgccgtccttggagttggtgccgttcgacatcctcaacgaccacgagttcttcctggggcagcacgtcgacgtcgacaccatggcggcggcaacaacaacgatggcgaggcgcgtcagcttcgttgaggtccacgacggcgtggcgtcctgatcttcgagctcgtccgccacttgcttcatcccctctaatactgcgtcgttggcaatcatgcgccgctttgtcgaggtccacgacaacgtcgacggaggacgctgatgttggcgaggcgaggcgaggccggagaacgtgatgagcaaggcggcacagccgtggtgcgcgacgaggcgccgcatcagctcggccatcggtatgacgtggccggcgaaggtgctggcgatgaggacgacttgcggcggcggtgggcgaggtgacgatggaggtggccgagggatttggggattttttttgtgcctagggctctactgtagcgcgaaggggctatttgcaaattagctgtctacgtggaatgcaacgtagatggtcagcttcggtcaaacgaggtttggacctcaatgagtcacttaaacaagatggtggacctagatgtgcaatttacaagatcatggacctaagtgatatccgcgctcaactttaaggaccggccgtatattttactcttaaatatataaggtctcctttgaattcgttcaattccttcaggaaccaggagaaatccccatgttccaaaggaggcctaactatgatacacattaaactaattaacagttcataaaaaatattgtgtatcaggcaagcaccctgcaatagatatgtttgcttgaacaacagtcttctggatgcattagtgaccatttaatagggaaatctattagcgaaaaaaaatcttgatactagttatttcggagctagctcggtgcattactctgtactttctttattttagatcttgtgatattttaaacattttttgctcaacgtttctgtctaggccttctgcaagaaacctttaatgaagtatcctcttattttgtggttcagggtgcaccagagaccattcaggagaggttagttgatttacccgctggatatgtggagacatacaaaaaatacactcgacaggggtcccgagtcctggcccttgcatacaaattgcttccggatatgcctgtaagttagcatttaacatttctcggttcattaacagcgcattttggcatatcattttttttcttagtactagcaaaatatttgtgccttgcaacagatttcaaaaaatatatcttaagtttcttaacttagaaattatatctttgtttgaaattcgaaaagacacataacttgcaagcaaaacataaaaaaagacatataacttagaaactatccatccttggaagatcccagccactaagtaatggcagattcaccactaccactaggttcttttatactctctgttagcagtcttccagaaagttcctgatctgcaacatagcaaggacattttaactaaagagtaaaccttttcttttaacctgatgtataagagctgataaattccagctatacatagaattctagtttagtaaaagatagtctgactatattctacagcttgtctttgtatccttgtattagcaaaggtcactggagtcctatgaatcttatgtttgctcgaattggtactgataggttctttacctgacatgttttagcacctttacaaggaatgtttgctgaaatgaagaattccctaaggcctaagggcattcgggctgcatgcattaccaatgagttgggtctaaaagcaaagtaatatcactacacatgcatataactactacatgtcatctaatgacatctttcagagggaggtttgatgatggaaacttgagttagaacggtgacgggtgaaggagggcactgagttggggaacaaatctagaattgctggtccatgatcgcaactgaagtttagggactagggacttgtttattatctttggttcattcaagaagatagtgcagtccccttctatatggatgactctacttgaccccccctaagaaataatctgtgtcctagaaacagatcgtcctaagataagtatccaaattcccatcaaaccaacctaatactacatatctaacaatccctctccaatagacctgacccgtttgccagacagaccctctctccatattttgtggttcttattcaaaagttttgtatctgcaccaacttatagttatctaaaactaccattccttacccttccttaactcttctcaacctttgttaaggtgtaggaatttatgtcaggtctcttacttttgtctagtattcatccaggactctcgatcttgtaggcctagagccctcatgttgaatgcatccactattcattacaacattcatcctaggtggatttgcttggatatgtccatgaaaatgctcttacaatggtgcaaaataccatgtagcattttacaggggaatttggtggaaaatactgccttgaaacatctagatggcagtgttgcaaaagacagaatatgggtgtcggaccgacaaggtgccgccaagttattagtgggaatacagatgattaagcggaattgtacagatttttgtcgttcacactagcatatacattaggtgttaatgacaatagtagagaggacatatagaaccttaatcaaatatctgtacatttttctgaatgtatcatgaaaacatcattatttgctgaaagaataccaatgttaatgcattaataccaccaggcttgtccatgaaacgagtgcaattgtgcaactggactgcaagtctacattagtttaatagaaaagctatagctcctgattagactgaaaatgaccaattaataatgccattggctgcataattgctctgaaacattactggcacaccggttcaatgatacgatacagtttggctaacgtttccatttagacagctgactaaacagtcatggtgactgacttccacaacactgctaaatggcaaatgtttgcaaaccaaaacctgcttgctaaaagcatcatctatttgtactggaggaaatacattttttaggaagacaaataatggattgtcagggcaatgtgggatatgctagaggcaaagaacatagtgttctgatttggagaatcctaggttcagaagaaacatctagacatttataatgatatttgtctatgatccacaacttctgcatccagaaaatagtcattatttattcactgcttacacttcaggagatattgcaaaatttgaactgtcctcaatctcatcattagtcgttccacactatttttaataaattacccaagtctcttcaaatgtatgtgatattcatcacttaatgtatacccttgaactttacaaagtagttgcagtttatttgtttattttgtatttttcagaagcaaccctatatctagtttgaattgtttggtctcttggtatttgaatgacaggtaaatgaagctagaagtttggaaagggatcaagtagagagtgacctaacttttgcaggttttgcggtaaaccaccctcccccactcccatccataaattttataatttctcaagtttgttgatgtgctcttttatggtaatggggttttgtgggcttaggttttcaactgtcctataaggagtgactccggtgctgtcttacaagaactggagcaatcttcccatgacttggtatgtactcttattcatcttgtgtccattcatcaaattacaagggtgcgatatagtgacatctccatgcattgtgcaatattaccttgttgaaggatttttgtggaccagtttctatatgatctttattatacactatgcatcggccaatgcactggaaaatttccatttgtgattaaagttcttaccacctccctgatgtattcttaggttatgatcactggggaccaagctttgactgcttgccatgttgctggccaagtgcatatttgttccaaacctgttttaattttgacacgtacaaagactggtggttttgagtgggtttcccctgatgaaaccgacagagctccatacaggtaagatatgcaagggtctgctctatactactaagcatttttagcaaacatttcatactttttagttaatacatactccattttttaaaactccgtagatgacgccattgacttttgtatgacgtttgaccattcgtcttattcaaaaaaattatataaatgttatttattttgttgtgacttgttttgttattgaagaaactttaaatacgagttattcaaaatttagtgcaaacgttattctaaaagtcaatggtgtcatctattaaaaaacagagggagtactttccaaagattcttttgtacaactgttgtttcttttcagtgaaaaaatgagtcttcctatttgtgctggtgaatattatttttttcctagaatacgcatgagagctgcgtatcattgcattaatagaagaaaacgaggcgtccaagatgctgttacaactgctgaaaagaaacaagctgacgaatattcacatttcttcttcttttatctatggcacaaacactgttgttaggaaagaaattcctagaatttggaaaatgataagcagtgaatatggtttcttttcctgattagtgattaatatataatttaattgttattccaaattcactttcattacacagacatagagcaactacatccattattttacatctctgccatcatgatgactgtgtggaacgtgtatcttctttaatactatgcctaatgtgctgcattaatattttgtagcgctgaggaggttgccgcggtgtctggatcgcatgatctctgcatcagtggagactgctttgaaatgctacaaagaactgatgctgttatccaagtcattccatatgtgaaggtatctgagaacagattacatctttttggtgcttttacggtatcttctactaccggcgttagtatgctagtagggtctaaatctatcagttgattttcatgtgtacttagaacatttcagtagaggtttagcaaggtaattttgaccattcacctgtcgtcgcatcacatgccatttgacatctgaatctatctatcaaccaacatgcacttttattccaattttggggatggaaccaaaatatctgctgtccatactaccaggttcagtaccatagaatcttatccattaggtcaaatgcaatggatggaccaaggtttatcctagggtactataaaaaacagttaaaagtatattgaatccttattcccattgtttattttgtatgtgttgtattttcaggtttttgcacgtgttgctccagaacagaaagaacttgttctgactacattcaaaactgttgggagggttacactgatgtgtggggatggaaccaatgatgttggtgcactaaaacaggtcagttcccactttttttttctcaagttcactatagatttactcaaatatgtgtgcccacaatacatttgttaatcacgtagatgaaactttatctgaactactctggtgttattgatcttgtagagatatttcttactgcatcttttcctttttgtgtgtattatttgtacgtgtcatttggccctcagatataattgtaaccactatatctttactatgcgttatggctatgagttgatggttgctgaaggccccaccctggtcttggcgtttggctatctgtggtacaaatgatatagatgactggataacgtttatgcttacatgctaaaccagccgcacatctgttctagttctagcatcagctgaggtggaaaatttacttttcgctttctttttcatgaagtattaaaaaacaaatccagagactttggatgaagttcttttcccaaaattggtaattggcatgccgagaaatcttagctgggtgaatttttaacctattcaacacaagaatcaagaatcaagcagagcttgcatttggctttaggattagctgtcctggatcattcaattaaataaaacctgaacacctttgtttgtttaaatgggatgggatggtatatagaacctacttttactaacaccatctttagctgatggcttgggaaatacatgtccatgtaataggtgttaggcatgttgacctgtattagcttggtattttcttccattctatcagtggtctgttctgcaagcttaactgtaactgaaaggttacttctaaattgataggcctgaggcatttctatctagtactttcttgtcaggtattattgcttctattgatgctttaaatctatatgaaagagatggggtgcataattacaacaatatttgatgggaacagtttttttgtgatctccaaattttcaggctcatgttggcatagctcttttgaatgctgaacctgtccagaaatcagatacaaaatcccaggcatcaaaatctgaaaataaacaagggaagttgaaaaaaccgaaaccttctcaggaaggatcatcatcacaattgacccaaccagctaacagctccgctagagcatccagtagccgccctttaactgcagctgagaggcagagagaaagactgcagaagatgatggatgaaatgaatgaggaaagtgatggccgttcagctcctattgtgaagcttggggatgcttccatggcttcacctttcacagcaaagcatgcctctgttgcccctacacttgacatcatccgccaggggagaagcaccctagtcactacccttcaaatgttcaagattcttgggctcaactgccttgccactgcatacgttctgagtgtcatgtacttggatggtgtcaagctgggtgatgttcaggctactatcagcggggtcttcactgcagctttcttcctcttcatttcccatgctcgtccccttcaaacactgtctgcagagcggcctcatccaaacatattctgtgcatacgtcttcctttccattcttggtcagtttgccatgcacttgttcttcctgatctcagccgtcaatgaagcaaccaagtatatgccagaggagtgcattgagcctgattcagagttccacccaaaccttgtgaacacagtttcatacatggtgaacatgatgatccaggttgcaacctttgcagtaaactacatggggcacccatttaaccagagtataacagagaacaagcccttcaagtatgctctatatgcagcagttgctttcttcacagtgatcacatcagatatgttcagggatctaaatgactacatgaagcttgaacccctgcctgaaggaatgaggggcaaactgatgctttgggctatccttatgttttgtggctgctatggatgggagcggattttgcgatgggcgttcccaggcaagatgccagcatgggagaagcgtcagaaacaggcaattgcaaatcgggagaaaaaacacgaataggatcttgtttttttttccttcacttcaattttttgctccactggcatagtttcaatctaaataggccttaccaaattttgtcagtgccaaattttgataagttttggcatgactaattttggtaaggcaaagttgtgtttggattgaagccaaaataacctaagttcactattgaaatggtctattttcttagatatgccaaaatttggcttcaaaccaaatagatactaaatactattgaaattgcaaaatattggtaagcctaatttaggcctcaaaccaaaccagcccgtagtttaggagaattttgtcggactgtaggccccattactaggagatacatggtcaatatccattctgcttacatgttggatgaagattttaaaattttccatatcttatgctaatgttatagcattgatggttgtacaatgaagctgaattgctacagcagttctctcacggcagaagttatccgaatttactttacattttatcgatttatggattttccacgcctgtggcattttgttttggtggacttaggtagggtggtgaatctgccttgaagcatagcttcgattgagctgataaggtccagcgatttccaaggtgatcgcaaaattggggtaacgtctactagaccaaattgctatttacactaaatctgccgagtagcggtttaaggccttatttagttgggaaaaaaattgttttggggtgtcgccttgtttagttggcaaaaaaaaaaaaaatttaagatgtcacatcggatatatagatatacatttatatcagattacaactacgagataaatttattaagtctaattaatccatcatgttttgtctcacaatttacacgtaatgtgtcaaatattcgatgggatagggtgaaaatttttgttttggaaactaaacagagcctaattccatccagcaaaatcatccatcacacagagaactgataaaaacgatatttcaatccaggcaattgatatttggtaatgtgttacacaaaaaggttccagaattattacgacaagacattttagataaccatagattgccctctagatatcaaaaccacattaagcaacagccgcagaatgttccaatggtagccagcacctcccaaggcaaatcagtacttgtagtccttgacgtgaaggctctcggaggcgccctcgccgaggacagcgtcacccttgtatgtaccgagggtagcctcggagttggccttgcacctggtaaggaaggccgccctggccttctcaatgttctccgccttgccggaccaggccttgagcgtgctctgctggagggcacggccgaaggagaaggacagcgaccacggcttcttggtgctgagcttgttcatggcgttgaggttcagggtcgcctcctcctcgctctgcccaccggacaggaagacgatggcgggcacggcagcggggacggtcctctggagggtgcggacggtgtactcagcgatgacctcgggagacaccttcttggcgtcagagcctggggtgaccatgttgggcttgaggagggtaccctcgaggaggacatggtgctcgttgagggccttgtagcacgcagcgaggaccacctccgagacgtaggcgcagcggtcgatgtcgtgagggccatcaacaaggatctcgggctcgacgatcggcaccagcccgttctcctggcagatgatggcgtagcgagcgaggccctgcgcattcagatcaatggcgagctgcgacggctcgttggggccgatcttgaggacggcgcgccacttggcgaagcgggcaccagcctcgtagtacttggcgcatctcttgccaaggtcatcatggccctgggtggtggtctccttctcggtgccggcaacctcgattgtgcccttgtccaccttgatgcccgggaggacaccaccctccttgaggacatcgacgaagggcttgccatccttggtcttctggtacagggtctcctcgaagaggatcacgccgctgaggtactggagggcgccaggggtgcagaagaggagctcgcggagggagcggcggttctcctcaacgttctcgacgttgatgctggcgaagcgcttgccaatggtgccagtggactcatccgcagcaaggatacccttgccaggagtgccaatgtaggcagcgttcttgatgagctcgtctgcaagatggcaaacactatattattaacaaaaaaaaagcagcatctctgtatggcctaaataatagatctatccaaattgccaggcataaactatgtccaatgctcaactagaccaccgaaaggctgtcacttgaacagatcaatattagatataaaatttctgctaacagaacatgcatgtctagatcaacccaacttatttctgtcccaaataatacacgacttataactaaagaaacactatgcataatttaaatcacttgaacagatcaatatagatagaaaatttctgctaacagaacatgcacgtcatctagatcaaccaacttatttctgtcacagatactacacgacttataagttataactaaagaaacactatgcataaactaaatcaatatggcagaaaatatgttttataatcaatcttttaacacacaagaacaagatctgctccacttatcactaaagaacccttatgtataaactaagccaatatggcatacagtaagtcaactagtaaccaatctttaacctatagacacaacaaaagatttcacgattacgatcacataaataaacgccactccatcgatttactgttcccgaacagatctactaacaaactcaccccgaaaacccaacacaagaactagatctaaacagcacgcaactgaaagcacgaacagatggagagaggagaacgacatggagaagaatgctgatggatggatggatccatacccttgtacttgccgcagtaggccgacatggttgcgggcggagcgaacgagggaggaggctacgacgaatagggagatcgaggagaggaaggaggcggcggctgtggggaatgaggcgagaagggagggggaggggggtggccttttgaaggggggcgatgatgagttgatgacccgatccgatctgtgggcgtccggccgccttgtaggaggggtaagaaaccaacaaatcgggtgccagtgtgcgccgcgagtctgcgacccgtccgatccgtgggaagccgaggaggcggctgcggcgcgcggcggcggccgccacctgtggcgtgggccggggtcctgtcctggtaggtgaggtgcccgcaattttgggccgagatagatttgacgagaatttttttcggttttagattattttttttaatatttacagaaataatatatcgaccaaaaaattgcagaaatagcccctaccgcccacctctagggcgacaagctgacgtggcaaacgggggaggaacgggcggtgacagagggagggtttttttttaggaaaacccggcggcaaggggcccgaatgcaaaaaaagccagtcggggccggctattttgcaggcggccccttgccgccctctggccgggcggcaggcctcgttgcctataaaaggcctgctgcccatcccccagccgtcattcttctctcctcaattccagtgaaaaaaaaagaagagaggggaggagaagagaagaaggggcgaagccctgccggattcagacaccgatttcaggtaatattcatagatcctatatgtgactattgagttaaatagtgtgtattctttaaaaatttgtttgaataaatgcattatatttttagggttttagttgtactaatctagaagtgtgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgttcgttacgggccaactggggtagatctgtcagattttattgtatcagaaaggggaattgatagaccggctgagaggagtgtaccttctataaaaggatggttaatgaggggcttcagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccaaaggatccaggtgtgcagacgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggacgattctgacaacgagcgtgtagaggaaggtgattcgtcagatgatgagacggatattaatccagcagaatgggctagtgaggatttttctgggttgatcgtctctgaagaggatagtgtgagatgggagtacaaagaaaatgaggttattcagggagcgatttatagtagagcagaagatatgaaataggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatacatgttttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctgacaagagtgtgctgcaaagggcgttcttagctctacatgcatgcaagatggcattcgtgaactgttgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctggcattctgtgagcgataggagagttgcagtttgggagtatggaatgaggataccccggtatttgggaagatgtatagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatggaacatgcaggtattttagggatcggttccaggaagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagcaagtaatatatcatacatggagcggcgagatttatgggttcggcatagctggggagttcacagagactaacaatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactattaggatcagcagcagatggagctcgccctacgggtgaaggcactacctccactcgaccacgtcctaggcgtcgtcgtgccacgtctggctacgtggtgtagtttttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcatgtcatcgttatgtaccattagtaacgtttgctatatttaaatagcctgtactcttgttgtacataattaatctcatgattttattactatttcataattttgcaagttatcttttgttttacagtactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaatagtgttttactataagttagttgcactataatattttttataatgacatattaatttgttattgcaggctacgtgaggccggcctcctaccgatgtgtcggctggtggaggctgcggccggtgacgcggacccggccagacgatggactgtggacaggtccctcctagcagctttggtcgatcgatggaggccagagacgcacacttttcacttgccgtgcggtgaggtagcccctaccatacaggacgtatcgtacttattggggctaccgctcgcgggagacgctgttgggccagtgaccacggctgtggactggcaggatgatctgacggcacgtttcgcactagtacagcgcgcaccgcacctcccattcgagccgttggcacaccaccgcaacaccggacctacgaaaaggtggctgcttcagttcaccgtgagtgtttttgtaccgaaatgacaatcgtattacatatttagtccgcagttaaggtgcctaacattttatcgacggcttgcaggttgagcagctacaggcggaggccgacgagtactcctacagccgatgtttggaggcggacttgctctggctttttggctgggtgatgttctgtggcggtcacgggcacgcggtcgacaagggacttgtgcactacgccaggagcatcgctgacgtcgcggtaggcgaggtgtctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactttgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgccacggctacccaggctcgtgcgccgttgggtctgtccacactctgcaccagggaccaggcgtactggatgactacggttccgatggtcttcgacatctgcgttgagcctcacgcccctttccgcgtgatgcggcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccaaccacgcacccgtactagggtcaccttcgctcccttggagcagcagccccacgttgcgagcactagagacctctatgccaggcaccgcgaccaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcatatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaagccgcccacttctcccaggctgcagggtcagcgtctcaggcagctgtgtcgacctcgcactcagcgcagttctggcagtacaccgggacttcgtcacaggcagccggcacgtcgagtcagggtccaccactggaccatgctgggacctcgtcggaccacttgttgccttccaccttcctcttcgacatcactgacttcgacttcacttcaggctcgacagaggacgtcatcggcccctcacagctgggaggcgcaccgccggtgcagacgcaagactaggcgcaggccactcctccgcgggacactcgtgctacccgtgctgtgccaccggatcgtttcacctactcccaggaccacgtgcgagcacaggcccggaggaccaagcatggtcgcggcgcggggcagggccagtagagcagtcttctctttgtttacttgcttcactttccagtactgtatgcttgtgtaatgactacattgttgttatatgtgcacgatacctttcggcgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccactgtcacaccctgaagtttccccctctccttgctttaaaaattggctaaataaatcgtccgaagaaattatcttatttaacctagagctaattccctaattaataaatgcaattaataattgaattcggcgtggtggaatttttcttgagttccccatgctccaatgcattaacaagatttttagtggaattttcagagccttggaaataattttaaccaattaaaaatcaccaaagtgcaattttaatcccaggaaaatccttcccctctttttcttttcttttccttcctttttctctagatgggccgtcggcccatctctctccccgcgctcggcgcccctttcctggggccggcccgttccttctcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgcccctcttcgcgccccactccgcgcccgcgtcgccgcccaccttccccacatctcccagcccgtgcgcgcgctcgagagggcgggattcgatttcgaatcccacccctctctctctctccccccacctttccacgtcgccggcgcaatagggtgggttcccggccacgtccgcctccccctccgcctataaatcgttccccgcgtccttctctcgttttttcctcttttcaccgcactctcccgtgccgtctaccgccctcgcgccgcgcacccgagctccgccgcccgccgcccatctccggccgcgcgccgccgccgctagagccaccgccgcgccgcgtagtcgccaccgtcacgctcaccgagcccgcttgcacctcggccaccattcggttgccgccaatcgtcgccggagcgccgtttctctcgcacgccggtgagctctccatttccacctaactccggccggccgctctagccgccgtggtcgctctccctacccctaaccccctctctgttttctcctagcgtgccgccgccgcccgtccgcacctcagcatcgccgggtcaccgccgcctttcatcctccgctttggtcgccgtgctcgccggtgaggctcccctccgctcccttttttttttccctctctcccgtgtgcgccgccgtccttcgcgcgtgcgccgtcgccttcagccgctgccgtcgcttttcgccccgtcctccgtcgcttcccacgccgccgattgccgtcgccggcgaccgtgcgcgtcgccgccggttgccatggccggccggccggttttgaagccgagccgagccgtgcctagccgccgccgtgccgtccgatcggcccctcggccgatccggaccatcggtcccgtggaccggcggtggaccacccgcgtggtcctggtccacggtagaccggccgctttgagccgctgacccgtgggccccgcctgtcggcgccgccccctcccctcgctgacgtcagccctgggacttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgaagtttctcgaagacgttgctgaggtcccatcagttcgagagcaaggcaagtcatgcaatacgtttgatcatattgtacccaatttacaagtatcccgcatttctattaaatgttgcattcttttacaatgtaatgtgggatgggtcctattcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctctttttccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacacccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccgaggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgttggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttacttactttgcttgctttacacctattctttcctcccatgaaccaccaaggagatgtcaatacagagaatggatagacaccagaagggtcctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgtaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttt

SEQ ID NO: 59344 - DNA, 10927 bp, Oryza sativa
aagcttcatcatctttttttttccatattgtgtaaaagagttaatgaatcttttttatccatttaaacaattggctgcttatgtatattaagatatctgagattgtggacaaaatgataaattaagtaccggtgtcacattgtttttcacatagcactcttcagtcttgcaccaggataatgcttagcttttgcaatttgtaggatggcaagctggtgcaggaagtgtatatatttgaagcctaaactagagaatttggcagcagaatgctatccaaggttagggattattttccagtaaagtaggcaccgctggagctcgccaaattgatgatctctgtcagtacttgtgttatgcagaattcggttctactgtgtcgatgtcaatgctgttcctcaaaagcttgtcaatcgtgcaggagtaacagtaagtctagccatgcttaatcattggtcattcaatgtttgttttatccttagtaaacaatgaacagaaatcattcttcctctcaccgtaattgtgcttcatagttcttaaaggtattctaaggcacttttagacatttcatttaaaaagaagtgctatttgtagaagtttttagagatcctttattgtgcttctttccctgttttagaggaaatagcttcctcttgagcccctggaaactttgttgctagttgccggctttctgcaatttgtatctaagtttttgttagctctatcctttagctttggtaacagagtaccatatcaatgatggacccttcatttatttggcctcgttgctatcttgtcgtgcaacaatattcattaggcaacttgttggaccccaagtatatattaatctacacatctaatgccttcttttgtccaatatatgtgatctgttacgcggaactcgtgcagaagatgccttcaatacaggtacaagcttttgtttgtttctctatgtattgacattgtatatccttaagatggtttttttttgggtcatgtacagctgtggagtgactctcaaaaacaggctgaggtgattggtggacacaaatcctggctagtaattgacgatgttcggaggatgatcgatcaggaggaatgatccattatgtcctttagtgcaaatgatgatgtgatgatgtccaacaggaagaatctttcagtatagcaaatggagaaatcagaaatcaaaagccagtatgaactcctttcaagagatcgagccatatatttaagtatcgaatcgacgaaattactacctctacagtcaaataggcactactacacaaggcagcatttcaatcgtgttctctccaaatttggggtcgacagaatttcacaacctgtggctgcattcctgtggtgtccttgatgtatccatgtgtcttgtttggaaatctatgcaattaaaggcaaagacttcttgctcatgtactgtcacagtacgggcaagcatttaaattagtcattagatgacaataatatttagtcaatgagccttcagagggcatgttgaaagtgttatggttccaaatccatatgctgcacaactgtgattgacttgaactactagtactacaaaagatagctacagtgtcagccttttgcaaagcaggtgttgctagttttgttcagaatagaaaaacaagcatgtatgtatatgttcctgctgaacaaagtatagttatccttaaagttaattgggattagtggaagcaagttccctcttataagctcaactagttgcccacatgcttcagcattgggtactgggggactaatactactttttttcaaccacaaacaacatgaaatgcttttgttttcgtatattaaaacgatttcttaatttgatcgcaacctcagcactttcttgtgtctggcactttaaaaaacacggcaaaagcactatctttacaccttctgcttctgcagtttagagaaagaaaacacacaaatcccagactgaaggacttgttaatctctctttttttttctccacttaatctgctggtttgactagacaatcaatagtagtcaatgaaaacaaactctttgtgattggatagtggccagggcatatagaatagagggcccacatgtcagtcaccgcaagagagagtgaggatgatcaccacagtttcgtgaaagaagatcagaatcagatcagccatggtggtataaccgtccttcctgaaaccatgcaacgcatgagaccggagaaaaataacaaacttgagagatgtcaggttgttagggttgggaattcaggtcagatattcagaattcagcaactgcatttgtcagtcaaacactgaggcatatgaacctgatctcgaaaagaggaaggaaaaaaaggcttctctttttttttttcaagttgaggtcctgttatcctccaataagtgtaacaacagataaatgcatatgtttttaatttagtttccaactttataatattcaaatcgctcatttttaccctaaaatagttattgccacaaaccatctaccaattcaggcacaaaagaggaaggaaggaagaaaaaaggaaaaaaaaaagatctcctcctgagctgttcgttgtcgccgccggtgtgaaccgaccttgtgtttgtttgtgcatgctaaagctaggtcatataatcttatcatgccactcctacacacggtgcattgagattcgtgcgggggtgggatcggacggtggggagtggtccaagaggagagaaaagaagaagcaaacgcgtcgctttcagctgtgggggcgtcgtcttctcccttctctcgcgtctcgcgtctcgacctcctttcccattcgctaatccttcctcctcctcctcctccgcagtagcagcagccgcctccagaaattccccaatccccaaaccctaaataaatcacccccacccccacctcctcccccgtacacgaatccaacccaatccgatacgatacgattcaatccctcccaggagacgctgctctttctggatgtcgattccgtaggggggagtctctctggtgttcctcctcatcaaggtgaggtttgtttttttgttattattattgctgttcgatcgaatcgttggtagatgaggagggaggcggaggggattctggcgatggtttgtttgttgttttgtgtgatgattcctttagtctggggcataggaaaatgttttggttgttttccttccaccccgtggggattgggtgcgattctttcccggtgtttcaatctgagttgtgactggattcgtctcaaagtttgggtttttcttttttgtttgcctgttttcttcgtgctcccgcaacttgatgctggagtctccttaaaggtgggactttggggggttttttttccgactctgctgagggagaagaattcgtaggaagaaactggtggaatttgtttctttgttctttattactaggttgcagttctgtgaaaggaaggtgtctctgatcgttctttttatgtactagttatctaaacaaaaacttcagatttctccctagattaccatacatatttagtatcaatcagtatatatatatgaatatatgagtcatatattggtgttggtttaggttttgcgaggagaagaaggcgagaaagaaagaagtaggttgtgacgaaggaaaccgcagaagccgcagccatggcgccatctcctgcggcagcggctggccccactttcgaggaccttgagcgcgacctgcaggcagtattgatggaccagaaccactcggcaaccgccgatgagctcagcatgttccgcagtggcagtgctcctcccactgttcagggtgctcgcactgccgttggttccctcttctctgctgcgcctgttcacgtcgacagctttgttgatcccagcaatggtggtgttggtgatgtgctctctgacgaggagataaggtctcacccagcctacctgtcgtactactattccaatgagcacctcaatccaaggttgccaccaccaatggtgtcgaaggaggattggcgtgtcgctcagcgagtacaggctgtttcaggaggggtaggggataggaggaggaggccctcggatgtggggggtggaagctcgctgttttcggtgcagccgggggcacggcatggtaatggagaggatttactggtgaatgataggatgggcggaggagaaagaaacgggctcacgcgtcagcaatcatcagagtggcttgggagtggtgcagatgggctcattgggctatcggattccagtggtcttgggtcccgtcgcaagagctttgctgatgccttgcaggtcaggaaaatctcctcgaattgattttttatcttttcttaaatcaccgtatatttaaacctcgactagaacatatgctctattctatttttcatgaatctccatgagtacaaacagacagctattgctaaattgatttatggtatacctatcatgttgtgttctttagatcactcagacagctctcatttatgtttggtaaccttgggaatgagaaccaccatagatatgcctatacctgaattgcattcatgacatgttgattgtatttttcactcgataattcagtgtggaacttctttcagagatactgttatgccactactacagtgcatcaccattctcctattgcagcatagttttctgtcacattgtttttcttatcatttggaatgttttttcatgacaggaaaatattagtcgtcctgcttctgcggccagtcatctttcacggtctaatagccggaatgctttcgacagcccaaatccaattagacctgattcatcaagagcgcaactgcagagcagatcagaatccatgaatggcttgcgatctggatccacttcacccagtcttgtcagggtccaaagtttaggttcttcaatctctcataactttgcttctgcagtaggctcctctatctcaagaagcaccacccctgacccccagttgattcggaggactccaagtccttgccttcctccagttggagttaggatgggaagtactgataagaaggttgatggctcggctgttgcttcacataatcatgatactgctgacattgcggcggctctatcttctatgaacctttctggtagcaagatggccagtttagaagctgaagttcaaaatcgtgcataccagaactttggtgatcaaacagatgtactctttagcgttccaaaggagcgcagacaattatctcagcagaagttagctcaaaatgctgatgaagaatcgataaatgccttggaatatgcagcttttccaaatggtagcggtaacttcaataattcaaatatgagcaagctgtcagttgatagcaggagcaagtttcctatacaatcaccgcatggtaatgccaataataaaggatctcttgtgagccccactggatctgtgtctctctaccagaaccttaatggtgataactccaacattgatgtatctgtacggaataataagatccgttcaagtagctttggttcatccatgctgaacaatcaactgagtgctggtacctctctcttttctttttctccaatctatcccctcctattattgtttgagttttgacccttttttttcctgtgcagatggtgaatatgttaatcttctttcgaatcaagggggatctggttttcagggccaaccaatggagtcaatgtatgctccatacttgcaggcaaactctgactctccccttggtgcagccacaaatttgaatccattccaaggaagcagcttttctggttcagtgcccctagatagccctggataccaaaaagcttatattgcctcattactcgctcagcagaagctacagtatggcgtgccatacctgggcaagtctggtagtcttagcccgaatatttatggcagtgaccctgcatttggcattgggggaatggcatatttatcgagtccaacatctaccccttttatctcatctcctcagggccatgttaggcaaggagataggctagctcgtatctcatctgtgggtaagaccactactggagggcctatgggatcttggaattcagataatggtctaattgataatggttatggatcttctctgctggaggaatttaagaccaacaaaaccagatcttttgagctgttagatattgtaggtcatgtggtcgagttcaggtaattttctcatagtatatccatcagagtaaagttgctgttttcagatatgatgcttgatacacccaaacctcctgttgcagctcggaccagtatggaagtcgctttatacaacagaaactagaaacggcttctgctgaagagaaggacaccatttttccagagattcttcctcaagcacgaactctgatgactgatgtttttggaaactatgttatacagaaagtgagcagccctactattccatcagtattcggaaaaaaatgatgtttttttagtgatatgtaaaaatgttatcatttactggttctctctaattacttgtgcttggcagttctttgaatatgggactgaaccacagaagaaacaactggctagcttactcaagggctatgtattgcagctgtctcttcaaatgtatggttgccgggtgattcagaaggtatgtgtattgtcccctcatattatcactagaaatgagttgaaagaccgactctgttcagttagcaacaccttttatctctgaagagactcagatgcacactattctgctgtaggctttagaaatggttgaggtggaacaacaaacccaaatggctttggagcttgatggaaatattatgaaatgtgtccgtgatcagaatggcaaccatgtaatccagaaatgcatagaatgcatccctcaagaaaggatacggttcattatatctgccttttatggacacgtggttgagctttccactcatccatatggttgccgtgttattcaggtgctatgctaatgtatatctagttttgcttgaaatattacttttgcaacttgctaaatgtacttgcctgtaatttgataccaccagcgtgtcttggagcactgtaacgatgaaaatacgcagagcaccatgatggaagagatcatgcagtctgtggttctgttgacactagaccagtatggcaattatgttatccaggtaactgcctattgattttatgttatctgtcgaaacttcaatttcacctgtacttgtttaagcattgggacgtatttcctatgttaagacttctcatctgccaaattgggcagatacgctccatgtgatgtactttctcttgttttcgtttataccattggagttactttacttttgtgtcccatttattcaaagagcttccttgtttatatttgtagcatgtcttgcaacacgggaaaccagatgaacgttctgctattattaagcaactggctgggcagattgtgaagatgagccaacagaaatttgcttccaatgttgttgagaagtgcctttccttcggtagtcctgaggagcgccagattctaattaatgaaatgcttggcacaactgacgagaatgagccattacaggtatgttttgatccagttacgtaagtgtatcgtttccgttcgtagaattttcatgagttttaggctttgctgtgataatatattaatatggttagtgtttcttgaaacatactgcttggaataagatattgcttttctaaaatgataccggtgctgtggtggatatcatggctcacattcctctaaaatgattaaagcaaatgtttcttctccaggcaatgatgaaagaccagtttgctaactacgtggtgcagaaggttttggagacttgtgatgaccagaaccgtgaattgatcctttcacgtatcaaagtacatttgaatgcactaaagagatacacctatgggaaacatattgttgcacgggttgagaagcttattgctgcaggaggtgaatttcgcagtccatgttcatgcatagtacagttcatccactctcttttacatgtttcctggttattactgactcgtttgtttgttgcttctgtaaatatatttcagaaaggcgcagtggagtgtcttcgtcatcttcgtgagattgcaatggttagtttgacagaataacacctgtacagacaaatagcgaggctagccttacctgtagtcttgttgggttaaatcggaaaagctaagctttgaaagcctttgatgtaaataaaggagggcctctggaaataaaaaggagagagtgtgcttgttcttaagaaagaagctgtatatttgtacgtttttcccctcttcgagtaagataaaaagaaggaagaaaggcaaagcatggaagaaattagtgcaaagatttaggatagatgatgggaagcaaggacacctgtagatccttttgccttgaatttcatcagtgtataaggtttcatgaggtttcatctctgtaaaggttttctacttaactcacattttgcagaaatcaaatgcatgtctctgtttatcagaattgtcttcagctctaaaagtatgaatatttgtgttcactgcgttccccttctcatttctcttcttataaaattcgtggatataaaattcatggtcccaccgattggcacgcctggtgggaccacgaattttatatccacatgtctgaagaagtcaatgccaagatcattcaatcttggctcggggggcaagcacatcagtatcagctcatgaaagctgattacaagatcagacagaagagaattttggagcatgagtcctcatactccaaaactgggggggcatgtgttaacagtgaaatttggtaatttagtaatcggcaaagacgtcatcggcttagaatcattatcggctgcagcatctcggaatcagccgatgggagttattaagtcgccaattagtcggattcctgctatattcggttaatgaaatcaatctactaaagaaaacttatccctaagtgaccgagtttaaagaggatgcggcatggcagtttatctattaattagaaatagtttgttagtttccttttatctttaggaaagtgtgtttagtgtccgataaggactttatatttttccttttatctttaggttagtttctttcttgtccaataaggacttgtatcaacccatgggtataaatatgtacacccggggtctatgtaatctatcttcacgatcaatacaattcggcgcatcgccaccctttttacttctacttttgtttttacgttccggtgagacttggcacccgacgcggggctgcatcgtcttcgatctccggcgaagggataagtccaatgttccgccggtccaggcaattgtatcgtctacatcggcgtcgttcaggctgcatcagtacattcgacctcttggattgctctggtttggatgatatatttgcctacctatttatgatatgtttatgttaatctagtcttagcatgtcaatttagctctatcggctgcttctcgttttagggtttctgccggtatcggctaaatcacgttgctagattagattagcttagacatctaccaccctgaaaactcagtcaacggcttgattgtctaggtattatgtttcttttcatacttagtgttgcatcagttaagtttgatctactaagtcatgcttagaaccataatctctagcctgcttcttgattgccaataagggtttcatcggggtttcagccggtgagttatctggatgttgcatcggctcataatgattgcatatacatataagttggatttagccgatgacaataaaggtttcattgtttaatctaatcttgtggatttcatgatatcggacctccagctgatgtgtgctttaaccctcggatcggtgcttatttatcatatcattgctagccgattggtttatacaggactatattgttattttattatatcatcatcagccgattgcctttatatcattatctacattggatatatagccgattgcttaaaccctatcgctatcggcatcggctgttatcggctatcggctggaactactccatcggcttgttagccgatcggctgttttgatctgctatttgcatatcttgtcagttgcaagatcaaactgactggcacgcccgtatctcatcaatctttggatctgcacaggagctaagcagatctcccaggccggtgtgttcgatttttttcgtcaacagatatatatttttatttactgagaaatacgtaatatatagttcacaagttattaaaccatatggatttttacaaattaataataaaaaatagcacacttagaataaactaatttaaaacggaggggagggagcattatcttttgtatgatgatggttgctgaattgttgggtttttagcacgatagatttgaaagcatatataatgtccacatttatttacactaccatttttttcccttcttgagaagatgttctatttctataccactgtggtttagtgacttgtgatgtgaataaggtggtggcaccaccatacccacgaagatgtacagacaaaactagcgaaaaccttaaaagagtttctcccggatgcaatctccaactttgtatcaaactatttattcaccctttattatttcatcttttcaagagttattggattacacggattctaagtgatctgtattgcttagacaagcagcagatcctctcttacagttacagtcatggaggtaagctcatcaggatacataacaaccgagttcagagcacatctggaccaacaacagttgctttgacaccggaggcactatgcacacggcagttctgtggcggctactttcttggacatcttcaggaagaaggccagattgtggtgaaacctgtcattgcaactgccttcatcatcaacaacatcaccatcagctgctccatggatgttcttctcct

SEQ ID NO: 59345 - DNA, 5945 bp, Oryza sativa
ccgccgccgccgttcgacggagctcaggcgaagcagttccggggaggccatggaccacgaaaggcaagcaaaccttctccgcgttggaacctcttcctcctcccccaagtccccatccccctcctttcagtttcaatatctagtttggttttagtggcaagagatttgggcaaacggattattgattagtgattacatggcgatgctggcctaacatatgttcttctttcatgtatggtgattttcctgattgaaggttgaactccccgagcacgtccgcgatttcgctggagttgctgggccatcggctgcacatttctcaggtaagagaagcaaacacttcatcttgttctgtaatgctatgtgggaaggagtggtgatgctgaatgctagcctgatttttctttttgcttctattgctgcatattatttgtaggatcctaactcgaagcacctcggaaccacggtctgggatgcatccatggtgttcgtcaagttcttggtaatctcttctctttggactactgagctatcctgtacaagttgaagcagataaatgtgataatcatgcaaattgctggaactattcggtgatgctccctcaaatccaacatatatagaatctcgcagttcctacactttggaagctttatttcctagcattggtgtgattttcagattttgatttcagtaactttacttgtttgggactttgagtcctatactcctattactgtcagtacacttgacatttaaggttttactcccatcctgtccaggaaaagaatagcagaaaaggtagattttctccatctaaactgaaaggaaaaagggtgattgagctaggagctggttgtggtctagctgggcttggtaagatgggtcgaattaccttcagagatactatctgaatcttgatggtgctcgcccaataacaaaattgcgcttctccccaggaatggctttgctgggttgtgacgtggttacaacagaccaagttgaggtgctcccgctgcttttgaggaatgttgaacgcaacaaatcttggatttcacagtcaaactctgactcaggtctgttatctaagtacaaaaatgaatgtccactcattaccattgtctttatacatgaaacatgccatagccatagtttgaaagagttaagaacttaagatgtggtcatcgcaatggtcattgcaaatgcatagatcttatgcgacaataagtggtgcctagtggttagttaagtttgtggaagtttctcataacaattggacgttgctagttctcctaacaattgattttacgtggcaaacaggctccatcggctctgtcaccgttgcagaattggactggggtaacaaagatcatataagagctgttgatcctccattcgattacatcattggaactgatgttgtaagttttctgcgctggcagcttgagtttggtgcctcaaatagcttatcctacttactgatatgctaaatttcatgcgtcatgatatttcagttgttctttaagaacagagtctggagagactttagtgtagctagcaatcgacattgcacatggtcacttgctgtaataataagttgccaatttttacatgaggaatctctcagatattaacctaaatgaagttttcctcaaagtcactaaacttttcttcttggttatgttacaaacgtgcgggagcacttgcttctctagattttgtaagttataggcatgccttacggattgaaatttaagtgcagaggatagccttttagcagaaatgcagaatagccaaaaataattgataacagcactggtagtccagagacaatgcaatggcttactgctcttttgtctgtgtgtttttgaaggtttattcagaacatctgttgcaacctctaatggagacaatcattgcattatctggtcctaaaacaaaaataatggtaattgctttcaccaccattcaaacagttctgtttttgttattgacaatatatgaggtaaatattgttgctttctacccagctaggatacgagatccgttctaccactgtccatgaacagatgatgcaaatgtggaaaagcaattttaatgtgaaaaccgtctcgaaatcgaaggtacacacacttcagagttcatcttatcagaactcccttcccttgtcatttatctgtttctgcatcagtgcaaaaggtattctctaccatcacgctgttcttgaattctaacacagatggatgtgaaataccaacatcctagtattcatctttacataatggaccccaaagcgacattgatccctgaggtcagcgataacggcaacaacgaggaggaggaggttgtctccaatccaggagatgatgaagatcctggagctgagagtggtggaccttgtactggctcagtggattcagcagaagccaaaactgcaggctacttggacgacgactgggaaatcagaagatgcggggctatggctgcaagacttcttaaggatgtcaaacttgcatgaaatttgatccatactagtattgcccagttgatgttgtactccaccttttcttcttatgagtagtattccctccacattcatccttagaattggacttttttgggacagggggagtactgtacaagctaatttgtactatgcttcactgtcattgttcatgtgaaggtgaagatatacacagagtgctagtacattttttgagatgttgagtgcatatgatcgccggcggcttgcaagaggagtgagccgccgccgtgccatcaccggggagctcattgacttctcgtcggtggattgtaggactattttactctggaaaatctgctcgatcggcaacaatggtagtgaccatagtctcaacctggaggggctcgccatcccctctgctccgcttccgtcgtccccgtcgtccccgtcgtcccctacgcctcgttcgcgcatttcgtcgaacaccgtgacggcgccgaattcgcactgtccgcacatctcctcctcctcccccgtcctctccaaaccccaaaccctatctcccgtcctctccaaaccccaaaccctatctccacccccgaggcaggcgcccccatgcacttgtaagtcgattggatgtcctgtcccagaagacatatcgagcgaggaggcggaggaggacgaagggaagcggatcctagggcttcaaccatggatcggcatcccccatttcaaggtactatactactccattatagtagtagtgcttttgcatcttagaaaaaaaaatctgttcattagccattgagagcttctgaacttgttgattccgttccaactccaactgtgagtttctgttcaggtcatcccctgattttcactatgccaattctctgaaacaactttaccactgtcaaatgaacacactgaaacagtttgcaattattggccattactagttatgcaaggtagaagtgttctgaggtactgtatcatttttatgtactaattaattaagtttaataaaaactttcattatctaaaaataaatgactattactagctcagtattcccttcattttatattataagacgttttgatttttttcacatacaactttatttaagtttgattatacttattaaaaaattagcaaacatatataattttcatatatatattttttacactaatagtgcaaagtgagcacgtttaaatgcattgtacttcataaaaaaacatctaacttttacagacgaatctggataaatgcatatctaaattcatcctcaataattgattcttttgggaggagtgagtacaatgggttggtgcgctttgtccttggaccctacaataatgatgattgtttctttaacacatgggctatgtttatcccttcctgagcactgactaccgaggcaccgagtgtgagaggcaacggcggtcagggagcaggcgtggttcgtcggcgagcagctgcgggcaacggtgccttggcgtcacgcatccgccgtcactcacctcaagcttgcgggctctgcgaccaccctctcatagtcataggccacagaaggtgtagtagtacttcatacatttcgagcagtttctttcagattgtttgtttttgagcttctaattttgggatgcattagatagtgatgaaagcctaagagtcggtaatatgacttattggaattttagtgttggtactcacagtcagaacatactcctattttgcatcacatttgccttgtgcgtgctgctggtctgttccactcgtgaacatcagacgcgaagattatagatccacccctgatttgaaggtgttcacagattcaggtactgccaattgcctggatgaacaccagcccatttgctccttttccccttgcgttattttccctgtattttactagctgccgtagctggaacacaattccctttcaagatgtcatatttatggaatataattcatttttaagatgccgaaatggaagacatgtgagactcaaaatctcgtgctaaaagagcatggaggttcgagttctctctagagcataatatggagaatgtgtatccaatgagcattcattcttatcatacgctagaaaggtaaaaaacaagaagacaaaattttccttcttttgtcatttagcacccgtatgatatgaaagtcacatgcatggttttgcatgagagaaagaaacgatggaatcttttttttttgtacgcgcaaaaacattgcatgtcattctatttgaagaagcaaagaggcatggggcacggcaaggccaccgcacgaactccagataggaggggtgaggggaggaagagggggaagaagcgaggagggatggagaaggggagagtccgaccctggaggccaggctctcctccctatagcggtggtgcgcggcaaggagcgggccatgatgatgggccagagagacatttgtgtgggaataagtccactttccctccctcaactcatggctgtgtgtgaatagcatccctcaaccgcaaaatcgggtataacccatcccccaacttcgaaaaccgttgcaaatcaactccccgggcggttttggaggtggttttgtcctacgtggcatctttgatcctgttgacttcctgagtcagcaggtgggacccacctgttagtgacaatgataaaagaaaaacggtggggcccactgtcaaccacacttctcttcttctctcgctcctccggccgatcccggcggtgacgtgccgcctcaccccgccgccagccgtcgaggccgcgcccccgctcttgctcgcccgcccctcggtgccacgctccgctccagcttgcatgcctgccggtccactctccaccctacccccttcaccgctgccgccatccccctcctcagatccggagcagaggagggcaaacgagatgagggagctggccggcaaccctgggacgtggaacggcctctcctgcaggtgggccagcccgtcttctccgccgcgtccatgtgcgcgacggccttcccccttggcttcgccgcctacactggtgcgtgccatatgggtttgcaaatcgattggggattctctggtgacagtgttttgcgtgcttgggcagagtgattgagtgctgatcataggcatcatagtatcatacacgcttgaaaaatcacaatacagtcgaccaaattgctgatcgatagcttagtaaatttggtcagcatggtatgccacccggcaattttctgattgatactattgttggggtacctggctatctgcagctttgttgctggataatcattgatctcgcattgttttatatctgactgcttgcttcctggagccgtttgtagatgtaactggagatggaatttttgcagcaattggtcttgccaccgccgtcgcacgcgctgcccccaccaagtctcccccgaggccggccgcacgaatcacgctat

SEQ ID NO: 59346 - DNA, 6980 bp, Oryza sativa
gcggcggcggcggcacagcatcgacgtccccaccggaagccacccggcaattggccgcccaggtcttgacgaagtgcatgaagctggaatcgtcgcaggccacatggtggatggacacgccgacggcgagccccttcccggggaaaaccgtcacctgcaccgccgcgagctcggagctcccctcctccgggcgcgggagccgcggcaccagagagtacagcctcccaacatccatcgggccgccgccggcgagctcctcgaagtcgtcgccgctctcggcgacggtgagctcgacgcggtcggcatccccacccgtggagcagaactcgtaccctccgcctccgccgccgctagaacacggccggacgcggccaagaagcgggtagaagcggtgcagcgcggcggagagcgaggaggcgagggaggggaggaggtgggcggcgaggtgttcgacggcgtgcgggtaggtgtagaggaagacgcgctccaccgggccggtgaagatccacggcacgtcgaagaaggtcagcgggagcacgccgccgtccgccggaggggaggccgccaccgtcagcttgtcgacaaccttggtcgccatgacaatttgccgctgcttcttcttcccctgcagagaattcttggtagaagagatcaagaggagaggtgggcgaagatgagaattcgtgagatttggggaggaatcaggattttttttttcagatccaccaaacgcatggcactggtggttgcaagtgtggcagaaaaatgctctctttgtcactctctattctttattgccatcatgttagatccttttcctttcctactgctttctgatcgaagttggaggaggttcctactactatccaatagcacaagaaaacattgtcagtgaatactgcagaaacagttaaagaagcattatttatcagtaaaaagcattatttgatccagtgaagaaaaagtgatggcaatctggagcctgtgtacactggaaatgagctcatcagatgaaatcaatgacaaaatgttaatctttatactctgactttgcagttgtaacttgcaagtcttttttttttcaaggttccacttaatcacatcggtagtataactgattatccggactgggatccacacaaaagcaggaaaattaggaagagttaggtatgcgattaaaaaaaagttggcaaattagtgtcggcgcatctgcctaccaagtattatcaagggatgatatctttggcattggaagtcacctctttgattctctaatctggaccgcgcacaaaagtttcaagaaaaacaagtatctcaaacttgtctgctgatcacataatattgaagaagtaagacggatggaaatactagctcttaaccttgactgcacactgaaaacctgtaagaaaatactaccagatgggcgtatatgatagcaaccaactgattcagtcaatggccatcagttcctcggagtgaaaaaatgcaatgtttagtcaactgcctaatggaaattcaggcaataaccatgttcataaacagtatgatcagacaactagccaaacagcaacaacaggtataataataagcttataacatcaaaacgcaatttttaccttctgctttccttgataacagatgcagcaataaagatgatttaagctgacataagaacttatttttccgccttaaagtgggcttgcacgttttaggcctaatccgattacatttgggccttaatggtctttcacttcttggaccaaagcctattacatttttgcttacaccacggcaaggcattctcttttttagggcttaaacgttttatacaacacttcagtaaagtactccgtactccaatattatttgcagtcaataaaactattattccaattaacaacatagcaagctcttcaagtggagttaaattaatttttaaaaaagattgaactgaaatgatggagaggcgccacaagcacaatttccaaggcatctgcttgatcagattccatttcattcctctcttttacaactttttttttgtgtgtccaagcacaacagacattggcttgggagatgatggatagggccaaagtttagcatattttgactcctccaattgctacatcttcatgccaaagaccatcctaatcctcttttcatccaagactgcaagtctgcaacaaagcaactcaacacacaatgcaagcactagttttcccttttcattttggtttctttatggttagggattagtgctaaagcagctgcttgattagtggggtctaatctaattactctcaagtgccataattggcatgctttagttttatgcacaactttgtttgaccaatgaccagcttcttgaccagttcaatcaaacaaacacaacaatgcttatggagtacatatatatatgtgatggaaagactacaaaaaacacaaaggaccaaggcaaagaaaaataatgaaatttccttcaactttaacagacaacccttgcatatttaaatgtctgtttctcgggccattgaccaataaaccaggcaattaaatatggcaaacattttgttttctctggtttgcaaagaacacaaagaaacaagaactgaacttgtgaggtgaagctagtgattccaaggcactgataagaacaaaacttgagctagtgctagggccatctaatcgctgattactgaccagtacttagtatcctaggctacctaaccatgtgtgtgtagatcatcttatacattacccacattaatcacgcgttaaatctacggctttgctccaatcgataaagacgagtgatcacaaaagtcactggcctataccaattattaattcaactgcgtttgcttgcatttgtgttcagtcagatgcattcttcttcaggttgtagcagcgccctaaattaactaaacaatgagcttctatatgtgcagggttttgtttgcttgcagcagtatttgatgaccttttcttagataattttaagtgtttgatgacctgacaggttagctgctcattggctagatattgctattagcttctagtatcttctgaccttaactttttagccttttgtaatggattcagtgaacatgtctgaattaaattgcagagtcccaagatgctagtacttctacaaacctactagtagtactgttcttatctgatcactaaattaaacaaacatgtactattaatatactagtgtatttctgtctcaattattgcaatgggattgccatcccacaggattactggtactatactggaattaacatttcttcagttctttcaaaatggcagtgtgattagtgctaagttctatttgatttaacctatctagcatagcaacatggatgtattatagcaggattaactagttgcatgcagtagttaactttggtcaaccatcaaagcacactcaattttgcaaagtaattaatcaaccattgggatcaggacctttcaccgtgtatctgttcatgtgcatgcgtgctaaggtcaacatttaagtagaacatactccagtaattaaaattggaacggaaagtaaacggtggtagctgcggctgatgagttcatacttgcccttaatcaaggggacaatccttatgcatggcatgaaaaaaaactaggattatcagcagcagtctaggacatatatatatatatatacaaaatgattttagggtctctagagaagaaaaacttggtggcaactcaaagttatgtgataaatgtttcttcaactttcggcactctcaagttatattactaacttctagtagcatagtttctcataaaaaaaaaacaaaatttataattattttcagtttacttcgaccgttacaatagtaatatttctccttaaaagaaggcgattgttgatgggagtgtttctgcaacaagggacatgaacacctttttgcacatcaaccatggctgagaaacattttaaatcttatcaagaacatgttggacaggacatgaagtagtgagaatctgcttccataacaagaacaatataggacttgagaagtttctggctcatgcagtagtaacaataatgtctcttaaaaaaagacacttgctgatgctggctgcacatatatgtttctgcagcaagacacatgatcgccttttatactgaaatcaggagaatgtctctaaatcttatatgaaacaagttgaactggaaattattataaaaactagggatagatcagaaaatttttaatgcagttttacactagttcatcgcctgagacacatatgaaatgacacacatagatactgaattcagaaccttgtttcatctgtctcgatttaacctagctaaacactcaaacaaattttggaaataagaagattgcaccaactaggtcagcaagattatacttggacatgcatgcatggccagggtccagtgatgtgtgatgtcattaccaagaccttgttgcaagaagctattagtgttatttagtagtactacgtactaatcatcatcatgaagcagactaattgcttcactatgacgttgcactgataaaaaagttcagtagtacacaggctaaatttttgcttgtccactctctaactcctgcatgcaaagcgttgcattgtttgatttttctttctactgagagtagttggaggttgatctcatcatcgcctgggccagatactggagctcgccggcgtccaccgccttggagcaatgctgctgcatctgcacggcggcgacgtcgtccttgaagccggccgccatgagctccggcagcagcgcgccgccgccgccgaagcagtcgtcgagggcgccgccgggcggccttctcgccatgtcctgccggagtagcgcgctgatgctgccgctgtccggccagctcaccggagagtgcgagctgctctggatgccgcacgccagctgcgccctcgcctgcatcagctgcgcttgcaggatcgcgacctgtatgtagcatcgatcgaatcagtcacaaatccgagaggcgatcgatcgatcgatcgagcagcgacgagatcatctcattctcatccatgaaatgaaatagtacctgctgctggagggcgaagatttgggcgacgcagccatagacggggtcgcggagcctggcctgggcctcgtaggtgatggtgacgacggcctcgcagcggtcggcgacggggaggtgggagaggagcttggaggcgttgctggcgccgaacaccttgtggatcgccgcgaacctcgccgccccttgctccgagctgaagtagggcgcgaacacgcactccggcacgcaccgccgccgcaagaacttgcacgcgccgcacggcgacccggctcccgtccccgccgcggcagcggcagcgccggcagccgtagcaccagccataccgatcaagatcgagcaagaaaatgaatcgatcactctagctacgtgtgcttctctccaagtgtagtgtgtggtgtagtgtagtgtaggtaggttagctgctagtagcggtgcaacttgagatggaggaggtggatttataagaggaggaaggagaggagaggaggaagaagagaggaggacaggtagggtagggtgtctggttcgaggggagcaaacgtgttaatgctgcgttgaataagaaggccaacgtcctctgccttactacgactcacttgctaattaacctgcagcttaaactaatcaattctactactgtatatatatcaccttcagaaaaaagaaagaaatattagtgtacaacatggccatgtgatttgtatagtcttccttaattgatcagttgtcatggagcagataatgactatatatataaataatattggtacgtatgtactagtaatataatctgatcttcattgaaaatatgcagaaacggtccagtttaatttctacactttgcttaccaccaacatcttcatgaacattgaagtttaatttgcaggtgaaagataatcactagaatgaacatatcctatatatgccctcagaaaggatactagctagctagattaattgccgtggaatacttatactgaaccttgataatttttcagtagtactgttggatttgtccagtacaagaatgagaaggaaataaaaaacttactccctttgttctgttataattgtagagcctgttcactttgatgtcaaaaaaaaaccttatcaaatttttgcattaccaaaattttggcatagcaggatttcttatatagttaccaaaatttgacagcaaactaaatgtagccactttttttgcgactttacctaaatttgataagattgaaaatggcatcaaagtgaacaggcccgtagtttagttgtgggtttctatgttatacgtttgactattcgttttatttaatttattttatgaatagtattttattgttattagataaaaaatgaatagtactttatgcgtaatttatatttttaatttttttaaataagatggacggttaaatgttatataccgaaacccacagggagcctgagagggagcaatacattttggatttggttcaggtgcagtccctagtgtgactgcaacttaattagtcacactaggaccatccaagttgcatctaagggctgagatccttagagcactgttcacgcgtaaaaaatatttcacagctactgtagcgatggtactatagcagttgatctacacccttgatctaaaaaatgaatggatgagataatgtgccgtcactgacttgcagttctagcagtgactgcatttgatctcaatccgtacattttgtttgcagagaaactacattttcagtagaggagatccagtcaagagtgaggcatgaaccaatcaatcaatgcagctaaattaaaattatactatcaattgaagtgagttgagtgtgcacgtacgtaggcgggctgcataaagaaaccatttcgcgccgaacagccgcaccttgcacggtc

SEQ ID NO: 59347 - DNA, 7998 bp, Oryza sativa
  unsure (1)..(7998): unsure at all n locations
cttgtgaacaacatggaagcctgaaaggaagaagactggactttagactgatgacctgatgagtgatgacgagcaaagcagaaaattaaactcgattgtttctaaatacagttttttatttttagtatatttctctgttttccaagcattagtttaaattgatcacaattctgtttattttagaattagaaaaacaataactagctttttcgtcggttggtgaggattaggaaagcaaagaagttgcctggctcaccaaacaactaccccaactataataactgcgttttggtgtgcccctttgtccaaaaactcactggagtatacataccgctttaaggttgatatgactagcttcattttttttctcaaaaaaagtgcgcatggtatggcccctatggttctgcttattcgtggaataaaccaaacgatatatctacaaacaaaaaataatttgtgaataaaacttatatatatatatattcttagcgatttaaaagtaaaaactgaaaataaactttgatgaaaaaaaccccaaaatcaacttcaaatataacgttgaaaatttaaattttggctgataagcataagcatgtctcctggcttagaaaaaaaagagaacatgtaaatttcatgatattttcatagaaggaaatttagttcctgtataaacgagcaaactgcatttcaaagagtgctcagtagtaaaaattacagatatttgctactgataaaagaaaaaaagacactcgtgtggatataagaaaaagggaaagcaaaaggggtagagaagaatttaatgggagggagttacgtggcaggtcaggtggttaagaccaatgatgtgttatgcaagagctcacaggcttaacacactttatgttagtatcgtcattttgtagtcacatgcaagataagaccagtatgatgatttcctagataactcttgaacgaacttaatctcctggatcagtgagcatgtgagtgtgacagtgagcatttaactaacctgacactgcatttgcatccatcataggcggttattgtatacttttccgttaaagctgtgtttagttcacgttaaaattagaagtttaattaaaattggaacgatgtgatagaagagttgaaagtttgtgtgtgtagaaaagttttgacgtgatagaaaagttaaaagtttgaagaaaaagttggtaactaaatcaggcctaagaaaaaaacaagaagaaacgaatgacgaggagtaaaatattactggctgtgttgatccgagacattaattcaagagatcaagatgatcaaagcatccatgtgttggtgaagagatgataattgtatatgatcttgttgaatcatgacagatgttggagacttggagtgtaccccactatccgtaatctctgcagtaccttcgcatcatgctgtttctgtaattctgttagcactaattaaactagagattcagagcgcagttgcttatgattgatttaggtcatgttctttttatattatctatcaaattattgtcgtagattatttgttaattccatgcttttaaaaatatatcttcttgaaaaatatttttttatttgtttggtttattatgcataacattgaaccgattcctataatcaactagatcatcgaacactaactaccttaatcttggagggatcgagttgtatagggtatgaagataaccagcatgtggcaaacaagactgtcagattgtgcaattacattgatgatgaaacgtgggtgctaggtacgacccatgcacggtctagttgttaaaatcaaagaaaaatagtaatgatccaacctggctgcccaccgaccatcgtataatcgtagcaacttgcctagcatgttattacgtcgtacgtagtacggactacggagtactacatttgttatattaattccatgaagaaaatgatttcgtagagtacaatgaacagttaactcttaactgtaactgtaactgatgccgttctcttttgtagaaatcagtaatcactcatgatactgaaatggcaagtattcccctcattttttaatatataccatcaacaacattttaacgaaagtttaatcatccgttttattcactcttttttacaaatataaaaaagtttgtcatacttaaataacacttatcacttatcgataaatcaaatcacaataaaataagtaataattatataatattttaataaaataaatggtcaaatatttatcgaaaggtaaatgatagtcgtatattgaaaaacgccgtatattgaaagcgaaggtgttgataacgtagatggtatggaattgagagttgccccttggtggacggcatgcagcttgcaataatcaggtggagatgcatttgaaatgtacagtactccatctattcctaaatataaggtttttttttattggatataacacctgtttgttttagtttaagattattgcaatctaaattattgaggcagaatatcatgagctggattataataaaccaacatagaataagcagtcagctgttgtttctctggattattaattgtttgttagatgttaatcacccaattatcttaaaaagtacatttagagtggattaccagattatagtaatgctatctgtttgttttaacttacttctaataatttagattataataatcctaacctgaattaaaccgggtcttagtataacgaagtaccgtctaaattccgttgtattagaatgtgtcacgtttgggcaaaatcttttatattttaggacgaatagagtataataaataatagtcgtacatgcccctgttttgtgtcaccatctggctgcagttgcagatgatgatccatcatcgtcatccatcagttttgatggcagtgtggaagcggaccatgattaatttgatttattgatcaccaattcgccgtagtgagacggatggcttgactttgacttggactttgacctcatcctcgaagtcggcaagcccatatatgggcccactccatattggtcaatgtctcaatgggccgggcagtctctccacagagccgaagaatccatccaaccatccacgtgtcccttcaaaacatcaggaccgtctacgttgttcactgtgagatttgcagctcttcctttccagtagcaaacttctcgtactttcaggtcaaattgcaggtaacacgactacatagtacagtatgtatacagatgagaaacattcccataataactactccatctgtcccaaaatataagcatttttagacttaaacacggtctccgagatgctactttgaccaacaatatctataaaagtaatatgttttaaataaaaagacttacatattatgataatttgtttaatgataagtctagtaacatcaattttacatgattgatctttttttattaatagttaaagttgaaaatgtttaacttatcactatgctaaaaatgcttatattttgggacagagggagtagtagtttggtcaagagcatcacagaacatgaaactatgacacaaaacctagtacagaatcaggttgtccaccacaatataaaactactagcgtgatatgtggacttagcctcaatgtagtgactttcttgtttcaaagaaaaaagttgtgactttcagcaaggccagtacactgcaatcgcatcataagttcataatcataactaacaagtgtaaaaagttggactacaccttgacaagcgatgacattgagcaaatcgcatcataagttcataatcataactaacaagtgtaaaaagttggactactccaccttgacaagcgatgacattgagcaaaaaacttgtgaacttctgtgagatggaatgtacaatagagcctcttccgttatgccacaggtaatgtacttgagagcagattctttaatatcatatcaagcaactgataatacatatagaggcaccatcagtttcagactagctgataatacataccaaaagaaacatctcgagtttcacttgttgcctcagcgtgaggttgtaaaaagtgaatatcagattacttgttggttcttccctgtgagatttgcatctctttccagtaaacatttcatactttgaaatcaaatggtacttcctccagtaaacatttcccgtaagactttctagcattgtccatattcatttagatgttaataaatctaaacacatatatatgtctagattcattaacagctatatgtatgtgggcaatgctagaaagtcttacattgtgaaacggagggagtagctaacatgacaatatagtgattcaaagggaaacatttccataattagttttgttacttttgtcaagaacatcacaaaactatgacacacagcctagtacataatcgggtcgtgtccactacaataaatttaccaaagccacacggtggacttagccacaaggttgagaattgacaattacactgcaataacatcagaactaacaagtgcaaaaagttggactactccaccttgagaagtcatgatatcgagtaaaaaacttgtggatttccttaggagttaaccttttttaagttgtcttgacccaaagccatactgaagagaaatctattttttatcagaagggcccttatcattagcctgagacccaaccaagtcctcaagagtgaagttaagagtatctgttgagcctttcttcacctcctctccttgttcggctagaaagtcttcgatgcttcctggctccccaaaccagccaagcctatccgcgatcaggtggaaattattgcagccgccgcaacgagcgaccaccactcctttctcatatgattccttgctcgccatcttcatagacctggtctcgcaaaccttgcacgtaaagatcatggcgaggtcgtgtcnnnnnnnnnnnnnnnnnnnnnatgtatctctaactttgaagccggaatccgatgaagggaccgtagctggcacggtgtcggttttggaatcctctatgtcctggttacggtcatctgaagcattattgcttgcttccatgatagtttgcagagatcttatgccagcagtcacaggtgcaggaaacaagaatcctgcaataacagattttcattagttgactgtttaattaattcctattgcaaagatgtaagtaaattcttgtcatacgtaatgatttgaatggtaaatgctttagatatttgccaatctggcaggaactgacaactagcaacaaacagacacaattgactctataatcttatctttattattactactatagttgccaccaagttttttcttcagttcttcaaccatatcaccttaattttaccaaaatcaatcccaaaacaagggaatccccttgtttccatatttcaatcttctcatacccccaaacacaagggaaaagggcgcagacgcagtgtaaacaaaatttgactgtagtggcagcagcaaccccggattcgagcctccaaccaccggcctctccaagtaaaacacacatccgcgagagtcatcaccaatatcgactagatttatccatgccgaaccaaaagagggagctaaagcaaaaaaaagtttgggggaatcacctcgggtggacgcgggcgcgggcgattgattcaggacgccggcaaggccgcggcgcaccagaggcagaaaccgagtggccatggcggcgaactgtcgaagcaggagaaggggaagggctggtcgccgccgccgccgcagccgcggggagccttcttcttcttgtcggcgaagaaacggtcgaagagaagaataagagagagaggcaacaagacaaggggagcgtgtgggccttgcttttataattgggccctagttttactttagttgagatgaggcccaatacagcccatccagatttggatctaccaattgttcctcaaactgggccgagcacaaggcagttgtgggccgaccggactatgggcctaggccggattcatagcccaagaggttcttgtcataattgggcctaatgtaacttgaatggaaatttagcccaatatctgatggcgaaccaattcggcccaaactaggatcgctaccattggttactgggcctaggcggtgactggatgactcgctcgttttgcggctcaaattgggccgtaagatctgtaaatggctgcgatcgatagccgtccgttagagagcgaacggcccagatttgtgacatattttgctctcccttcgctgccggagacgtcgtcttctccggcgacagcctccgccgccggccgacatcatcggcaaagaaaacgaggcagaggacgtcgagaaaaaaactttggtagaagcaacggaaaccgatccagcacacgccgaatcgatcgcttcttgcttgatttcatcctgatttgcttctgcgttttccttcatccgtgtgagaactgagaagtcatgcatggaatctgagactggacagcatcaactgcatcacgccattatttgatgcatcttcattaatcgaggaacataaagcaaacagatgctggacatgcagatcttgagcaaagctggaacagctagatcaagaaccaagctgcacatgcatggatcgcatccaaaattcatccatccattcaggccatgccaatcatactgaaccttctagtagtactgcattaatctttttgctagtatttgggtttaatgcagtactactagtactatgcaaattcattttcttttccttcggaatcagttaatatgtttattctatagaaatgaaataagattcagacattcagaatatcaggcaaagcactttgccaccagaaattaacccaaatgctagcaaaaagattattacaagtctttgtagcaaactctgaatgaacttttgtgtagtgatgaagcaagagagaatgagcctggcaagttccttaatttgtacaagtttctctgccacattttttgactgttcacttcagacagtatattggtccttgtaggcgtcctgctgttagtcctccatactaaaccatttgagttgtgtttttgtgcacgtttttgtttgtggattgttgttgactgagatgtattgtagacatttcactctcaattttttttgatcgagcagcacgagacagtgttcactctcagattcgatagtattctagtattatactatgaatagatgacatcttttcagtttcagataacaaattgttcattttctgatgaaatgactgtgaacaatcttagtagaattgtgcaaaattaagagccaggtcctaattaactagctgactccgagaggcggctaagatgaggttgagcaaagcagcacgcaatgttttagagagagtaatcttgcactaccagttcaacataaaaacctgcctctgatgcgtcattgcgtctgtattattttgacctgtgaattactcctaccagctagagtagcatgcttttgttggtgcatccttcggacgaattggccaacatttacatacgaaatggaggatcaaaattaacataattacagagacatcttaatcggatgatcatcactacacggtccaagtgtgaatgctgatgctgtaggagtatcattcacattatgcagaggctggacacagcagagcatgacgaaagaggcgtcgctgtcatatggtggcttaagctgccttctttcctttgtttccatcctgtgacgaggcgaattaaggaggcagaatcatctactctcggagacaaaatcaaagcagaaaagaattgttaattcttctccgctgttctgcttggagtcgtctagtagtagctaattacgcagcacgcatcatcatttgtttgtttaatcaatcgatcttggctcgtggacgatactacatgcagtcacgtcgctgtacaccatgcctgttgtctatagctcgcatgctgtttaattgcatttaccagcacaattaattatcccgatggagtcaaccgatcgatcctttcttaattttctctctattt

SEQ ID NO: 59348 - DNA, 12575 bp, Oryza sativa
gccagggagcgcgcgcacctgctgttctcggtggaatgccgccgccgcctgaccccgccggtgccgcaggagtacctcggcaactgcctccgcccttgcttcgtggaggtcgacacggccggcctgctcggcagcggcgccgacggcgtggtgacggcggcggtggccatcggcgcggccatcagggggctcgacgacggcgtgctggacggcgccgacgggtggttccagaagatcgtgtcgctgatgccgcaccggccgatgtccatcggcggctcgccgcggtacggcgtgtacgacaccgacttcgggctgggccggccggcgaaggtggagctcctgtccatcgacaagacgcccggcacggtgtccatggcggaggcgcgcgacggccacggcggcatcgagattggcgtggcgctgccggaggccgacatggcgcggttcagctcatgcttcgccgacggactgaagcagctgtgagtgacgaacagcttgttgcatttcttgctttcttgctgctacgaattgttgcagagttcagaatttgttcagtttggatgtgattctgtaatgctagctgttggattgcaatcgttgatcgatcacataagcgattgtgaatttgcaattgtcaatctatgaaataatcagataagctgtaatctattctacatttttttcagagatggagcaggataaggcctgcttcgatcaacttctgttataaaaaagacactgaatattcggctgtatactgcatctgaatctcctttttgcttttaagcattaatagtgagcttgtgctgaatttaccgacggcgatggagacacgagagaaacgatggtttggtgaggaatgtgtattgtttaaccgagtaaatctggtgctgaaatgaaaattctcagaatgttcttcggtattgagtattgacctttgatcgattcggcagagtttgctttgtccacttcatcggttagttcaaccatccatttcctgatactaatgttcacaactcacaaccatatatcagtttgttcaggttaaatttcagcagcgtgtaaaatggcatccagcccattatcattggatgtaaaatgacattatcttttttgcttaatattgctactccaatttagcaactagttgcagtggccagtgagccatggacagatggtcgttgttgtcaatagagcacgtcatgttcaggttaggcaaccacaattggctggaaaggttgtgtttttgtcaaagttcgttcgcttcagccttcacgtacgcatcatcatgcatgacttcgagctttcagtggtgctgcccagctaagagatgccaatatcatcacatctcattttctccttccatcgcagatatttttaataacatagaagtacaagttaccatctatagaaaaacagcatagaaaaatagaaaataataaaacaagagtagagaaaaaaaatatttttttgaaaaatgaaaggagagaagtactctcacagtctcactggtctcctggctagcagagtgggtaagcccagcccaacaagcatcccactagatcatcacggcctctttcggttgggcctagatttaggccaatccacgcctccgaacaagtagcccaaaaacccccactagatcatcaaggcctcatatagttgggccggaatttaggcccatataactaaacctaaggcccatcaaatctccaacccttcacactctcctctcatccacgtaaaccaccctctccctccctcgccgccggtagccgccaccaccgccgccgccgcgaacttccaatagatcgccggctcgccatggctctacgccgagccgcctccctcctcctccggccacggctccgagctcccgttccgatccccacacccaaaaccccaaaccctctcctcctcccgccccgccgccacttctcccagctcccgccgcctccagtccccgcctccgcggccgccgccgccgcggccgttgcggaggaggcggaggaggccttcgaggcggcgaaggggaccaaggacctgctcgccgccttctcccgcctcgaggccgtcatgccgccctccgacaagcgcctcgccctcgcctgcatcaagctcggccagcacctcgaggcctccggcgctgccgacccctcccgcgtcctcgccctcgccctccgatccctcggcatcctcgaggccacccctaactccgccacctcgacgacggcctcccactccgatgccgtctcgctcgccatggccctccacctcgccggctccgcctccttcgacctctcccgcttccacgacgcactctccttcctcacccgctccctccgcctcgtctccccactcctcccctcctcctcctccgccgccgccgcctctggtgacgacgacgctcaagggttcgacgtgaggcccgtggcgcacgcggtgcgcctgcagctggccaacgtgaagacggcgctggggcggcgggaggaggccctagctgacatgcgtgcgtgccttgacctcaaggagtccatcctgccgccgggtagccgggagctcggcgccgcgtaccgggaccttgcggaggcgtactccaccgtgctagatttcaaagaggcgctcccattgtgcgagaaggcgctcgaactgcatcagtcgacgctaggcaaaaattcggtggaggttgcgcatgataggcggctgcttggggtgatatacaccggcctggagcagcatgagcaggccctgcagcagaatgagatgtcacagaaggtgatgaagagctggggcgtggctggcgacgagctcctgcacgcggagattgatgcggcgaacatcaagatcgctttgggcaagtgcgacgaggccgttactgtgttgaggaatgtctctaagcaggtggagaaggatagcgagatacgagctctagtgtttatatctatggcaaaggctcttgctaaccaggagaaggccggtgatacaaagaggtgcttggagattgcttgtgacatactggagaagaaggaattggctgcaccagacaaggtggccgaagcatatgtggaggtatcctcactgtatgagatggtgaatgagtttgacaaagcgatatcattgctgaagaggagcttggggatgcttgagaggatacctcaggcacaacacatggaagggaatgttgcggctcggattgggtggctattgcttctgacagggaaggtgtcggaggctgtcccatacttggaggatgcagtggagaggatgaaggacagctttggaccaaagcattacggggtagggtatgtgtataacaatttgggggctgcatatatggagatcggccgaccacagtctgctgcgcagatgtttgcgcttgcaaaggaagtcatggatgtttccttggggccgcaccattcagataccatagaggcctgccagagccttgccaatgcatacaacgcaatgggaaggtatgatttcacaacttcattccattcattcaaagacacataaaaaatgttacaaaaaaaatactgaacagacaaattttggatgaaacaattctgatatttgctagtatcatgtctaatataaccaggcagaagattaaatgagctacaataatctgcatgttacctatcaagctagtttgtttttgcaatgcttgttctttagctagttttcaggatgaccatatgttgcatttttgcaattattgcaagaaatgctttttatacatggtatgctactgcgtttgaaattacagagtatgtaattgtgctccctgcatactgttgcatactcgcattacatcattagagggaaagggaaattactgattgctttgtttcatatgcattaagtacgcacgcaacataatggctggctgatattgtaagcacactattcagatctgcttctccaaaatagactagattgatattttttgaatgggaaaaattaaggaaactaagaaagctctttccacatgctgtattaatgtatgaagtactatgcgcttctctctaatgaaaaaaaaatcattttgcctcaaatgcagctatgctctggctatggagttccaaaagcgagtggtggattcttggcgaaaccatggtcccagtgctagggacgagctcaaggaagctattcgtctctatgagcagataaagataaaggctctttcatgcctatcgcctgaaaattcagcaattgcattgcctgaacctctggaaaaggaggttgattctgattctaccagagttgctcaacaataatttcaaagtattgtacgcatcagtttttctatcaatatatgattatgatatgttgtttagtagtacaagaaattttggctgtgaaactacctattgtatgatccttattgacttgttacgcactgacatccttttgtgccacttagaagacctaacagtatatcaaaagtaatcagaaacacaccttttcagcatgacaggaaccttttagagatatataatatgaccttttcaatggttggtgaactgacattttcctgcgacaaggaaaatctgatttgtcaagctatgatgtcatctaagacacagatttcaatgttagattattataagaaggttttggtgagacattggattacagagttttgaaaggtgtctacctttccccattcagttcatgtttttattttcttttgttttgcctgactgcctgaagttacaccttctaggattggtaacacatttatcctgtcatcagctgattcgctttcttctgagtactttcactagttatttaacaattcaaaacttgatttatttatttatatatttatttggcatattctcgctccttccctttctcattgttgaatttgactcaccatatcgtatatgatcatttggggatcacatgcatgtatcagtgcctgaagaggaagcttgggcagattcagaggagctggaaaatacagtagcagtaggagcaacttacattgttttgcacgaatgtttcacagaaagaacttgccattctactgtctgaagtctggaatttcggacacacacaaaccatgttataggtgtccattagagaaaaattgacatgtaatattgcattttgcagaaaaagaaaagaaaaattggtgaacaagaccaccaaaagaattcgcatagaacatggccatagaatgtgcaggcatagtaatccctacaatgttccagtgctgctgctgctgctgtcactgatatccctgtggaagtgggtgctcctctgcagaatattctgaatctgcaaatgcacctctccagcaccacccagtgagtccatggagaaggacctcctcaatggaagaacatttctgtccctcctcactgcaatgcactcatctcccttactgatgctgacatgccatgcattctggttcttcgtcttcttactactgacctgttgatttgtactagtagcatctactgcaggatcagaagctgccgtattggcctcctgctgtggtgcttgtgcaccttcttcttccgcgccagtgatcacctgaatgactaccacctcaggtctcacgaactgatccaatggaagctggctgtcgttggtggctatggctgccctgcagagtggacagttggcgttgccctggagccaagtgtcgatgcagtcaacatggaagacatggaggcagctgggcaggagcctgaccctctcctcttcttggaactcactgatacacactgcacactcgctggaatcagcagtagtgtccttgatggccttcctgtacctgaacgccggcaatgattggatggccgcctcctccagcccacgcggctcggccactgccgggaggctgctggaggcggcaccgcgtcgacggcgggagatgaggccagccgtccgcgtgtcggaggagctgctgctgttccagttgaggcagcagcggatgacaaagatgtagtaggtgagcaggaggacggaggtggtgaggatgcccaggacggtgagcaccagtattgggaagctcgtgatggatggatggtgaggcacaaaagaagaagatgctgaagaagtggagtcgagtgccaatggccgtggcggcggtggcgggaacagcagtgatggcatctgttgcaccgggaagatggggtccctgtctgcatccatggtttgctgcaaacacgagcttaagcacacaagcaggtgagctactgagctagatagaccaggtttgatgatgctgctgatgcaacatatatactggttttcaggtatgaatggtgagaccaaatggtgatgctcaatgtagtggccaacgaggtaggagggaagaatgaaaaggcagcacccgatcaggttggaaaatgcagtggagttgtgaaagaaattgaggaaggaaagaaacccaacctgcagagcaagagcaagagcaggacagcagcagtaggagcaatagttgcttgcacaacagcacaacacaaggaaaatgaactgtcagcacacagctatccttaatttgcagcagcttgcaggtttgcacacactccctgcagagatggagatgctgtgtatgatgatcacggcactggtggtgatggcggcttgatgttttggatgcgattgaagtgtggccgagtgacaggaacgcggctttggaggtgagcttttgcttcccccttttttttcatgtgcgagtgcgacggatgccgcacgccgccggtgttcccggccggcctacgcttgctgcttccttgtactgttaggctttagtagtggtaatttctttcttggtctgtttcttgtctaacctgtactaggagtagcttgctagtcaactaatctgacgcttgcttgcttttggtcttgtcagtacgtgcattccttttcgtctggggcacggtgactgactgactgaaggactgacttaacatcccctgtctgctgctgctttacataagaatctgtacatttcaggccaccttcgttcaattatgtgtgactcaatacttcaattatggtgtgtactccatgtctccatttaggttaagacccagataaggtctaattatgcataaatgaaccagacacaagtccaacaagcactagtaatcaacaagatgctgccaaatatgtactacaccctctgatgcctgaactttgtttgcatcaggaaacggacgaacagatgatgcaggaattcaggcttcgatgatataaactgagatgttgttttcagactgcgagttccggtgcacatcgcgatcgctgatttacagatttgtaggatgcgtggccgggagattttggttctgattcagctgaaggtacaatatgcttgtgcagtagtggtccacctgttgctcttgctgttgttcggacgttgctgtcttccagttcatcatcactagagtagtactcttgcaacacgacatttgcagctccaagaatgggaagcaggagagcttgagggcactacgtctctccagtactagagaactgaagcttctcttgtcttgctcgtggaaccttcttgctgtcggtggagtagagcgccatggttgatagtctgcaggtggtcagaaactgtttttaccaagggatattggtggcaatgtagtctgaggattgatggtccgcatttcctgcttcttcatttgtaataaacgtttattatgtgtgtttgtgtgcatcagttatgcacctcagttatgcagaggctataagagatctcagcacggttctatcatattgatgtaattgtctgagtttttttttaagaaaaagcttccttatctaaaagaatggttgatagtaaagcagtctgcacttcatgttgcgccagttgctacggatgatcagaatcaggatcaagcaagaatgaatatattcatgaattgatgcgtgatgctcaattggagttcaaattcagacaagcaacctttgattttgcatccaagaaggatcaggagaaataatggccagttcatgatattagttgaaactggttgcgtataatctccttcagatcatcggacagtgactagcactaaaaccaagttactgaagatctaagatcagacgcacctgaaagaaaccaacccaactccctccggccttgcctccattgaccattaattttgccgggcaatcttgtcgttgtcttccaattttggctatgtttagatccacgacaaaattggaagtttgaaaaaattagaacgatgtgatagaaaagttagaagtttgtgtgtatgaaagttcgatgtgacggaaaagttagaagttcgaagaaaaaagttggaaactaaatagggcctttgccgggcaatcttgccgtcgtcttcctctccactgagatcaacttctgccattgccgccgctgccttgcatctgccttgcatggatcgcagagaagactacatggcagcttgtgctatgtgaagatgaagcattcgccaagctactgattggtggttgcttatattggacagagtttctgccatctcctgatcagcttcctccagcttagcttgggatgttttgtcgatctctgaattttatttgcgacagtgagcagatgcatctttcagttcggggactttgaagtacagctggaaaatatccacttttttgtcgtggtattgagaacatgtgtgatctcacatcatactctgacttctattttgtcttaaaaaaatatcgattcttgatttgttcagtgggctcaatggtattgcaggcaaagtagtatactacttttcggtggcattagtcatgaatttcatattctccaaggaaaataaaactatatttttacactatggtttattcgatacgtatagtttttctgatctgattctggatgatggtatatttttcttcagatttgggacttggcctggtcactttgcttaaacaatcaaatacgctacaagattttgccttcttcagaagaagaggtagatgcacatataattttccttcgatccactcatgcatgatgcatccattaatctatttggacgatttacttcttgccacgatcatatatattctgcttacattttgcagagcagggtcactaatataatgaggactcaacattattataagaatatgaagagaatccagatagaatcatgcatatatatagccagttggttgtcaccaacaacgaagggattagtaaaatgtcagagcagcgaattgggattaagcatctgggccggaagcaatatacatgcgtgcagatcagccagctactccttaactgcagaaaattatattagcagatgcatcctctaaactccttgaaatctacagaaaccacgctgtctcagcacacagtaataaactaaaaatcacattactttcgcgttctgctcgtgtttctgaagaatgaaacccgtgtcaatgaccttcgcatgattagtatgcatagatatcgtctgaatccatgcgaagacaggagaagactcttctgaaattgagcagccagctttgacgacgctggtgccgctaatctcaactattttttcactagattatttgttgtacgcttaaactctcttctactacgttgttaatacttaataatccatccgtttcacgttataaaacgttttgactttaatcaaagtcaaactgcttcaaacttaactaagtttgtagaaaataataataatattttcaacacaagacaaatttattatgaaaatatattcaattattgatttaatgaaactaatttgatattataaatattactatatttgtctataagtttagttaaatttaaagttatttgactttaaccaaagtcaaaacatcttataactacggagggagtaccacttactccctccttccctaaatgtttgacaccgttgacttttttaaacatgtttgaccgttcattttattcaaaaacttttatgatatgtgtaaaactatatgtatacataaaagtatatttaacaataaattaaatgatagaaaaaaattaataattacttaaattttttgaataagacgaacggtcaaatattttttaaaaagtcaacagcgtcaaacattttggaatggaggtagtattttagacctatttgttaagttcttttttaaaaaaaaaggtttaatttatctctatacctaagtagataattcacgcaataatccggtacataataccctgggcctccttaattaaaaaaaaaaggtttaaccattcagttcactgcagccaatgatcagtgggggccattcactgacaggacttttccatggcaagctgatcgtcctcttgtctgaaagattccaaaggaagggtggatgacaaggaggaagccgccatccaccacccaaaattctattggattctacctatgcatattgtgcgccatgatcagtaagcacctacttgttgttgaaagcaccaagagattaggtaaatcaaaagtgtccaaagacaacatcaggaagcatggaaacccaaagcttgcatcactgaaagagtgatttggttcactcatcactgggttagcgacatagtaacaaatgtcactacttactaggattggataagtgcaaatgtgagctaatttaatcactgtgttcactgtggtaggtagaaaacaacagttgattcacagtttagcagtattataatgctagctcgcctactagtttaaggaaagatcctataatttgacactctataaagtgagcttcgattatttgttggtacatgttgtatttatttgactctagttttttttcttaatcgccacacgttgtcttgtggaaacaaattttgtactatgcgcgtattttctcgatgaatatccaggagcgtagaaataagttcatttgttggtacatgttgtatttatcttttgaagataaacatgttgtttttatgatcttcaacaattagtacggtagaaaacacacagtcatgaattttgtaccaatccgtgtgaagctcacgccattattacggttacaatcaccatttttgatatgacaaatgcagtgaaaggaagtaagaaaaagtctccccaactcataaatacttccaatgctatttttttctacaactacaaatatcagcattgcacttactctgccctttggccatcttccatccatccaaaaacatccacacttttcatacaaacaaacaaaattcagagtgcataaaaacaacaacaaaaaagagtcagatgtacaagggagaaaatgaaaggaaagagaaatagaagtaaccccacaaaaatgttcctaaaatctccaaccaaggagcaaggacccatacatagtatgtctaatactcagggggtttgatacaaaaaaagcttatgcttttattccaaagtccaatacaagtctttggggaattggcacaggcaggagagagaaagagagagagacccataccaatgccaagaacaagaaatcagagagcccaagcaaaaaatccaatccgaatcccctccaaaaacccaccaaacaatctcctccatctccaagaacaagaacaagagagcatcctagaacattaggggataaaggaggaggagaagaagaccaagaaaaggtactacctttcatctctccctcccccccaaatacacactggtcgcaaaacgagaggccgcctcagccttctccaatcccctcttacggagagcaaagcaagcaagatttttcttcgatctctgctcgagtttcttgctgtgaagtctgttcttttttcttaactgttactgctcgtgcgtttttgagaagtttcgagaggagagggaggagagttcaagaacttggagagaaggggatggatccggtgttgctggacgacatcatccggaggcttatcgaggtgaagaatctgaagccggggaagaacgcgcagctttcggagtcggagattaagcagctctgcgcaacctccaaggagatcttcctgaatcagcccaacctgctcgagctcgaggcccccatcaaaatctgcggtaatttccctgtttcttgtcacgcgtgagcaatatctttgatgttggctgccctcgaaaatgtcatcttggggatttgcttggttggtcaacgggtagcaagtgactgcgtcgtgctgtttggatgcacttgcttaatgtactatacccgatcttttgattgatagccagatattatccagctttttaggtgttttgtcgcttgatgatccggttatcgactcgaacagaggtttaccacatacttcctaatgaatcatgtgattcagtatttccgactatatgtttgctcatagaaagcttatactccgtgaggcagacgatggttatatctagatttctcagtggttcagtacaactgaaccataccgactatatttgctgattgaaagctgctattttgtgaggcgatttgttgatagaaagatcaaagatagactttcaagctgctactaggaaacttttgaccgctatagtttatggtgaattgatcatacctgatacaatcacatttaatgtatctcaatatctggcggtctgggtacaccagcctgatat

SEQ ID NO: 59349 - DNA, 49826 bp, Oryza sativa
  unsure (1)..(49826): unsure at all n locations
aggcggcgaattttcgcttgccaacgctccataggagtattgacctcatcaaccccagaccaaactttttttaccatatcaacaaatccatcacgttacaaccaaccaagttcaaacttaaaactatgttgagcgttactaaaagaggaagattttgtatttaggagcaaaggagtatggtctgaaatatctctattgagagcaacaaaagaggataaagggtatttttgctcccattccgttgacactaaaactctatccagtttctcataggttgggtgtgccagattatttgtccaagtaaaattcctaccagtcattcgtatctccctaaggcacaacccatcaataatagcattaaataagaagggccatctatcatcataattatcattatttattaattattattattattattattattattattattattattcaactttgagacaatagccgtcacgtgcagagtggcatggcatctccaggcacaagagaacatcgcatgacgcatcggcatcacatgcatgagcacatgacgtgtggtgtcacagaatctttgggttctcctgaaaataaaaataaaaagctcaatatttcgaaagctactctctgcatcataaatatgttttctttcttccaaaatataataagttttagttagataagacatatcatagtattacgaatctggacataataataggatgtgtattatccaaccatatccaaatttttagaactacgaatctaaacatcgtactaggatgtgttttatctaattatatccagattcatagtgttataaatttaggatgtgtcttatccaatcaatttttttttatattttgaaacgaagaagtaacaactatctactatatagattaatcatagaacaatttgtacgctggtgtccagtccgacgagatgagcatgagctttctgtacgtggcagaaaaaaatccatggctggctgacattgcaccgtgccggacggtggcggcggccgcgtcgccttctcccttcctggcgctgtcagcttgtggggtcgggatgtcatccagcgtagcggaatctactcgcccgcccgcggatcgctctcgcgctgccgaatctcaaaaggtgggagcgaaacctttttcttctgtcaccccagcttttccttacccccacacagccagcgcacctacggtacccgtatggcccacctgtcatacaccacctgacatatccccctcggcttcccaccgcctgcaatcgggccccaccacgctccgtccaatcccagtgacaggtgggccccggacagatcggtccacctgtccgtgacacgtgctcaacacgtgcgactcgcaggtagtagtagagctgaaaatacgcaacgcatccgcgcgacacctagcccttctcgatctctctctcgctgcagatccaaaccaacctcaccgtcgacgaggaagaaggcggcggcggcggcggaggcgaaggcggcgaagatgcagtacaagaacctggggaggtcggggctgcgggtgagccagctgtcgtacggggcgtgggtgacgttcggcaaccagctggacgtgaaggaggcgaaggcgctgctccaggcgtgccgcgacgccggcgtgaacttcttcgacaacgccgaggtgtacgcgaacgggcgcgccgaggagatcatggggcaggcgatgcgggacctcgggtggcgccgctccgacgtcgtcgtctccaccaagctcttctggggagggcagggccccaacgacaagggcctctcccggaagcacatcgtcgagggcctccgcggctcgctcaagcgcctcgacatggactacgtcgacgtcgtctactgccaccgccccgacgccaccacccccgtcgaggagaccgtgcgcgccatgaactgggtcatcgaccacggcatggccttctactggggcacctccgagtggtccgcccagcagatcaccgaggcgtggagcgtcgccaaccgcctcgacctcgtcggacccatcgtcgaacagcctgagtacaacctcttctcgcgccacaaggtcactgatcccttatccctatccttccttccttccccccaactggatctcatcttccaaaacccatagcaatttcaatttggttgggcgatacgcgcggattgaatttgaattgatggcggttcacggatttcatgtgtaccaattgatgagcacttgccgatgtttccaccgcccagaacgagagctcgtttaaaatcgaaagcgaatatgtttaatgctggtattctagtactccaactgctgatgcgtagtactgtacgtaggtttggtgagttgggattaggatcagatccttctctttttcacatttattattgtctctttgatgagctcctagatcctgtagacactagtaccgttagtattccacctgcacggatgagtaagtagtataccaattacatgagaattttggctacacatgatagagcatcggttcgattcgcgatggtgacatctccgcattttcacctaaactttgaaaattaagcacaggtgagcagtcagggaggatgagtagtatagatctcatcctcctcgatgtgacctgtagcactacatggctccagcgatagtatttttctttagcttcagaactggagtagtaggcagtaatgtcggccatgcattgctttacattctcttgtgtcattacgccaggcaaaagacagagcaatgctgataatgaaagctcaagtataacaatattgtggagattacttagacaacaatgctcctttcatacttacaattggaagctttatttgatatttagtctttatcaggttgacaccttgatattcggtcataatcaaatgagatggcttacgtaaatatgtgagatctcaaaaagtttcagtttgggctcccaaaaatttttctatttggcagcttcagcacgcttaaaacagaaaagacagcatgagcttaagtagtcaaggtggagctttctatgactggtagaggaaaaacagaaatggttgtcattctctatgactagtgctacgaataaattagtccagagatttctcttgttgtctactgggaggatgatacaacctagcaggaaatgtacttagttatttatttttgctatgcacaatgcagatttctttttgccgggtcggctgaaaatcgaccaaccgaattgtattaagaagagagagaaatgaaccaggtacagaacgacattgtactgtcgcagggcataagcccccccaaaaaaaagaaaaagctcctagggatcaaggaacccaggagaagactcccacacactactctctatgcttaaacactccagcttccctccaaatcagcacttcatctctaatggctctgtaaacttgcgctgaagtgcaatctttgtgttcaaagattctcgagttgcgctctttccataacatccaacaaaccaacatacatagagtgtcaaaggccggcctgtagctcggctgaaaaagttgccgcacttgtcgtcaccattccatgaagtgttccccttcatcccccggcaaggaaaaggagactccgagccagctccttaacattcttcacactctgtttgtgaattgacagtccactaacaagtgacaatgcagatttctttatgcgatgctttccagaatcttgctgtaagatatttcagaatccagtaagtctaaaggagaacaatgttgaacttgaagaatttgagttgctagttcagtatagccaatgcaatgaattggacttggctacgagtcatgactgatccatctatcagcagatccattgctgatacagaactttttgatataaccataaaaggcatgtacactgtactgttctgtgctgacaaacttctgccattcaactgagtgtgtaggatcactgctttttctcaccaatgcattgtagcaagtccttttgaagattaagatggcaaaaagtttattgctgtgtgtaattgtgtaacaagaagtaacgatcttgtacttctgcaggtggaatctgagttcttacctctttacagcacgtatggcctgggtttgactacatggagccctctagcttcgggagttctcactggaaagtatgccaaaggaaatatacctgctgatagtaggtttgccctagaaaattacaaggtaatattggtaactttgtccctgtactagatacgtgcattcctgcttttctttttctgaattctgatattaaaatgttcatgcttattctcagctgccttgtgccatcattttttctatcgacaatactacgctgtaactatgctttttaaagtatcatgctacctgagtacctgactattaattactccctccatctacttttgatagtcatatttccaaatctgaaaattttatttttgataggcatatttcaatccaacaacctatcatcttaacgactttcttggatttaatgtgtgactctccattcttccacacaagattggctacatgagcatcgagaaatgtaaatattaatgaatcgtttgtttacgaggaatgactagtagcatgtttaaatagatgataagtagaattacttatccttggtctgtgtatcaagatgaaatatgactatcaaaagtagatggagggagtacctttgtccatgcatgaagatcacaatgtcatgttaagataccaaggataaaactcaactattactactatatcaattgcattaatcattggattgtagttcatggtggattcaatgctgcatgatcagtgttccagaacatagcgtgtcattgttgtgacttaggccctgtttgattcagcttaggattattataatctggattattaggagtaagctgaaacaaacagatagcttattgtgatagcttattataatctataagccagattactataatctggtaatccactctaaaggtgcttttttagattattgggtggctaacagctaacaaacaactaataatccggagaaacaaacagctaatagcttattctatgtcggctttattataatccaacttatagtaatctggctcaataatctagattacaataatcttaagctgaaacaaacagggccttaataacttatgtagcagctgctagcatgacttctgcttgttctgaacgttgactaaacgcttgtgtacatcatggtttttcattttctgaatgggcttatgaaacttgcccctaacaaatacatcgatgctacttcagttttccttgtcagatgtgtttgtcttttttctctttcagaatctgagctgttctaaacaaggcaacttttttctctttcagaacctggccaacagatctctggttgacgacacactgagaaaggtgaatgggctaaaaccaattgcttctgagcttggtgtttcgttagcccaacttgctatcgcgtggtgcgcatcgaacccaaacgtctcatctgtgatcactggagccacaaaagaaaaccaggtacgttccacacgcccgcgtgcttcacaagatatgtttcttttgccaagtaagacgccaattaatggtttttctgaaactaagaatactaatccatcatttggtaactaaaaatgagcagattgttgaaaacatgaaggccctcgatgtcattccgctgctaaccccagaagtcgtcgacaagatcgaagcggtggtccaaagcaagccgaagcgcaccgagtcatacagatgaagcggtacagggggtgtgcagagtgtgctccagggatttcaggatttacccggtgggattcttttagacgatattattatcttccattgtcttatgtttggaagctgctttatgtgcctgggtttgtgtagttgggaaatggtgtccagtggtactctgctctatatacattttgtcatgtggaccactcacttgttgctgtcggtgatatatataccttggtcttttccgtgtgcatctatccatccattccctgcgtttcttgctggcatcttttctgattctttggtgtcttgtgcttggactgtccctgcatcctccttcctggtgaccttgttctcgtgccattgtctgcctgccagcatcaaagattcagccgagcgagtgagagtgccaaggaatcaggagtgtttttatcatggtccttgctgatttttctcgctggcaagatttcaatggcaggctggccaccatgtctcatggcatgctgtgctgaggaatcaatctgtttctgttcaccttggggaagatgatagtactaccactacattgtgtcattgtgtcagtcacatctcatctggtagtgagtgatgagtagtagttgtagcatgcgcatgtgctgttgcttgcaggaatcctctgcattcacaggtgctaaaattggaggcaaaaatgaagcaggggaggtggtctggttgctttgctgcttggccggcagaggcaacggaggctggcacgctttcgtgcggatccgggaacggatcaggaatccaggggggtcgctgttcagtgtggctggcaacacgaaaacagccaagacagcaaacaaagtgtgagctatcagcattcaagcaaagcacacacacaaacaagcctctttcactctacattttttctgtctccggatgatgctgaatagatgatgatgccacatggcccagtacagcaactgcgataaggtccttttctcttagcaacacaagacttttttttttcatcacacatattaggaattttggaggtggattaatcaatgaaactccagggctaattcatagagatttgtgaggctgtgcaagagtcagtagtaatcaggtaggcacaaggatcatcatcaaacaccataaaaactactagaaagacatacttgtacatgcaagcagagcaaggcgaccatatgctcttgcagatcgacagtgcaaacaaaaacaggcaccacaaaggcaaaaatataacagaaccgggtgagccctgtggctctttcttactagccttctgctattttaactggacaagtaattaaccatcaagcacgctccaagcttcaccagcggtatagctcttttccttgtcacacgctctcaggatctgcctcttgttgaagcaatggttctgtgaattccctggtatcgctgacctgcaacggattgtcggtaaaatgagcgcaaatcaggttagaacctaaacgggtgcgttttagctgattaaagtgctaaaatcctactagtggcaaaacaagctatttcaagttatcctctagattcagttcaacaggttatacatacaacaataatcgattccattcagacgactgactagcatcaaatgtaataggtggtagaaaagaatctaaccaagaccattcgcatctgatgtcctcatgatcctcaacctcttcacagagctgacaaacattctgcgcacaagaacaaggcaacaccgtaataataagtcacctgaatagctattcgaagtcgccttgaaaattagaactataaaaatttctagtgcccaggttctaatagctacatagtgcaacgacttactcccaaggaacatctccaacgagcatccagtcaccatccctgtcctcgtaggtgagctggtattcggcagagttgtctagtagtttcagcgagtttgtattatctgaaaatgcgaagataaccataattcaggttcatggacaagatgaatcaacctatcatgaaaaaagcttgcgacttactaggtacaatatgaagcatggctattattttaatttgcaaaactatctcattgtcctacactattattatgtattgtgcgcagcaaagcttgattccacttaacttgatgtgatttgaaaatatgtgaaactgtgagctacttaaagtgacagttcagactcgagcttacgagaagcgcaaaggccaatggacggcttcgtgaacatgagttcaagggctaatgcaagggtcttgtatgagcggtgcgcattgagatccaccttccttccaatgacctctccatccatgttcaccttcacccatccagcaacccgtcctttcttttcgccctcctccttgtccttctgcacatcagattcattggtggcggtcttcttggtgtcggtttcagatgtgttttctttagcctgattgaacaggctgttcatcctgaactgtcggatcggtggccatcccaccactccaaagctgctgccaaaccaggaaatgcagttgggattagttgaaatgtattgaaaagtctacatgtgtaggtgtagctcagcaactctggtgctgatatatatctggtcctcatttcagagaaaatcttactagcgccacaagtcaaacaaaagtgtttgtagttacatattagagtgcagatcaagcaccaaacttgtcattttttgtccttgaatttggaaggataagaagcttatgcacagcacaggtgtggagtgtagataataataggttttggaggttgttgctgatgtgagttctatgcacaactacaggagaagccatatgcaaatatcctatgatgctaaccagtgagcagaacaagtggcaaccaatcttgcagacaaatttattactgctactcttactacttcagagaatcataaaagaaactgtttttgtatcgagtaataaatatagtgctatatatgaaattatgaggcagagaagaagcaagaaccctgaaggtgttgtgttctgctctgctctgctcagctcacctgtgtggatggccggaagcaaccgtcccaggcgaggtggtggcggtggggccctcagccctcttcccccccgccgccgccgccgccgcgggggatgacgacgacacggaggagtccggtgacagcgccgccgccggctgcaggtccctggccgtcaggattcggcacggcgcatgctgctgctgctgctgtttcttggagccaaggctgagcccgagctccagctcctcgtcgtccccagctgagctctcctccacctcctccgcctccgcctccgtccccggcggctcgccggcggtgggcccagctactcctcctctcatcggcgccgctgcttgctgcttggcttgtgcgtgtgcgtgtgtggagtggagaagaggacacggacgaacacctgggcctcgagagggaggaaaggaggaggaggaaggctataattaagctgaggcagcagcattaagcggcagttgtgggtagtagtgcagcaaagggctacctgggccccacctgtcctcctggcatgtggggcccacaatgctggcctggggtttgggggttttgtagctgctagagagcacccaaccattttgtagcaagcacaattcacttgggtttttcttggtgttggggtggattgtggtaatgtataggagtgctgcattttatttgtttggtagtagtggtagtagatccgttttgcctttttttgtttttttttctaaattggcatatgcgaaagaagacgatattatgataggaattgcatgacggtgtttttctataaaaaaaatagtgatattatgtttgtgttttatattttcacgctaatcaaagaagatggagttggtagccaagaaaatatacatgggagaacttactgagtgatcaagatgtaagatgatagaaatcatagagttacgattcatctgtctagggtaatatggtccttcctaatactaacaaatcatatgtggacaataagctttggctttttacttggccgtgatgtttgatttgtgctcgctcctagtcgtgcatgcaatagtttttgcaacaaccaaattactactaatgttttgattgctccaatcttagagtgcttactcaatcaatggttacttagttctagctctactgacacggggttgtgcatcactttttatctctatctcatatatacctcttggcttttagattgcgcttcattgttcgcatgccatatccaatggagttgacaagtactaattaatttgcatcatgcaattataaatccatattcaagccgttcaggagccattaggctgtatgattgacgtgttcactttttctgatttgtgaataattcttggtacctattactttgaattttacaacaaaaatgtgtgtgtgtgtatatatatataggtaaattaactggtgctacatggaatatgggctccaagattcaaattgagtatatacccaatttgaatgagtatgaaattttttttaaatgttagatatgaacattaacttctttactaacaagttcaaacaagtttgaactgagtttgaacttttttttttgctagattttggttctaggtatataacatccaaacatataattcgttaggtatgtaataatgaattgtgaaataaagttgagtttgagttgttttgttgttaggtatttgtatgaatcaaattcatatacctaggtatatactcacaatttattttttttaaaaaaaaattgagagaatttgtgtgttttataccttggagcccgggcaccatggagtcctatatgtgtatcatatatatatatatatatatatatatatatatatatatatatatgtatgtatgcatatgtatatatatgcttttattatccgtgtgggatggtttggaaactagtaacatatcagttatgttttttcacggtaactattacttactcctcacgtctaaatcatggatccgtaaccgatcacaattgtgcatattaactctaatctataggtttttctaagtttatacacttgcttaacagctggtgtggggacagaaaaagggggagacagagcaatttgcctctttgtgggatggttgccctttgggcagtgggccccggtatttgccttttgttggtgtacaaaatgcaagagacaagggaaagagaggagatgaaaacggagaaatgggaaggaggggaggggaaagggttggtcacgtgagtcctcacatgtcctttgcatcctttgcgatgatgcagcactgctctgcattctgtttagctacctacgatactaatagtacagtgtacacttgtacatgaacacagtacccaaagggctatgctcaaggttgtcagtatcctaattcgtatcctagtatcttacgatactacgatcctatcaagccgaaacgatactaatcccatctagtatcctaattttcatagtatctcgatcctactattcattactacacgttcctacgaaatcttaggtggtatcccgattctacgatccctacgatactacaaaatattatttaaaataatatggtttgaaaataatgtaactaaatatgctcaaatttatataaaaatcagttaaatatatcaaaaccaacgtggtttctcttgataaatgtctatatttgcatgatatatatcattactatatttttttatatagaatggctatatataattaatataaatattaattaaactttaaaaaataaaatcttatagtatcccgatactacgatatgatcctacgatacgatattacttcgagcaaaatgatactacctagtatcccgatgctgacaaccttggctatgcctgttcatggtctatagtggagtaaaaaattaatgtatcgaaactgatctgggtgaaatgtagttgtaacacttgaattaagctcttgcaaaccgtaccatagttaggttaatttacacttaaaaccttcccctttgtttgttttttttataaaatggaaagttcaattttttattgacgaggagatgaaattttcaataactagagaaacgaaattatgtgataaaagaaccaataaaataacatggtgataaaatagtactactaccgcttcctagctagagcaatgcatactcctgtatgtactctctctccgtaaaaaaaaacgaacatcatatttccagatttgtaatactaggatgtgatgtgtaacatctcatacgtggttggttttattttagtaccgatggagtactctggtagtgctcctatgtagcagtagtgatgtagtggtattcgatctggttgtgtgctggctagcaatgtcatttgttctaaggggtactccccgttcaaaaaaaaaaggtcaaattctagagatgaatctggatacgtgtgtctaaagactttttttttacggagggagtaggagcaaacctcggttattgtagcgttagagcacttacaataaattagtgtaaatgggttttacatgttaccatattatattttgcgcttatgtgaaagagaataaaagtgaactacagatttgtagtcagatgtaaaacgagctccaataaactatgtgagagggaaatgtgggggtatatattaacggtgcatgtatttattgttaactattgtatgatgagtatgcaattgagttaattatagataatgtgttaatttttgaagctagtagttatctatattaggccctatttagattccaattttttttcttcaaactttcaacttttccgtcacatcaaatttctctacatacataaacttccaacttttccgtcacatcatttcaatttcttcaaacttccaattttagtgtggaactaaacacatccttattaaacttgctcttacggacttaaaataccaacttagcacaatccgtttaaattcgtaatactaaaatataatcatttttggtttttttaagacagaggaaatactccgtagaatatacggagcaggagtcgcagctagggtgtagcagtagcagttcttttacagtagtactagggggtagcagtagtagccaggtttcccaaactgccggggccggggttaccgcgccccggcggtaagcacgtttaccgcacggtaaccacggtaactgtaaaagaccgtacgaaaccgtgcaaaatttattaaaaatttaaattattttttaaatttatttgaatttaaagaggttaccgcagtttttttattaccgtacccgcgctacggtaagtggaacctggtagtagtagtagtagggaaaggtagctgcacatgacatattgccgggcgggcaggccaaaacggtttggttgttgacctcgcatcgcagtggacaactctacagtacgttggatgggggtagacaagctcgtgtgcgcgtactagtatgcgataaagagatagaggtgggggggacaagccgacaaagaaggcgcgccaactgttgaccccgtgtgccccgctccgacacccctcgcttttccccctcccatcctctctctcctgtcgcctcctctctcctcatcacactagctatgccattgccacccccacttccactgctccactaccactgctataccatcgctccaatgtactacgggtgtgtttagttccacactaagattaaaagtttaaaaaaaaatttagaagtttatatgtgatggaaaagtttgaaggttgaagaaaaagttgagaactaaaccaggcctaccttcagttttaactttttctattatctaaaaaatagtttactccttccgtcctagaatatagcaacctaggatcggatgtgatgcatcatagtactacgaatctagacagggggctgttcagatttttagtactagagtacatcccatccggttctaggttgttacattctagaatggagggagtattttttaaataattattatattgaagttcgtaaaaatatattgagattagatagaataatcttctatcacactatccttcgtgatcgtcacagatactctcttctggttgataatacttatctttttgtcaagagtacggtctcaaaaaaacaattttgacaattattttctattataatattataatatgtataaaaatgttaacagatatatgattttattaaagtatttttttaagactaatctatatatgtagtcaccatatttaaaagacattttaaaaatgattcataatcaaatattttaaagtttgacctcacccttatctaaaaaaaggacaagtattatcagcccgaagaaaatataaatataatgatttctggttatacatctagacacacattcttatagtagtattaaggaacgaatatacagcatcatatatataccatcatagtgcaaataagatgtgagcagtattttggggccaaacagaattccgaactctttgggctaaggaatgggctaaacatctccgatctagcccacttcattatttcactagaacaatgttttgaccaataagaaatatgatttttgagacaaaattaatgtcattagatttacattcaaaagtaatgagtgctattagatttatattcacaaatgctttcctgtaattatacttctgtgtcacataaatataatatattaataaagcagttggtgattaaagcattgtcctaacaagcaaaataaattgttttatactgtattatttttttacagagaaagtagtactaagtattttggacaacgatcaggccaggccagatttgatttgggccaaattatccatgatcaggcctacccttatcaggcccttcaacatttgcaaccactgtgctcctctcagtgtttcgtgtggaacacttgacaaaacaaacattgagcatgcatgccccttattcgcataaattattattagtgcaaaatgttacatgaaaagatcttcaatatactgttacacctttcaccggagaagattacgtgtttcctgcatttagttttcggtatagatcttactgccagagtatgctccattggactgaccaccatgatgattttgcaccactgctttgctttgcatttctcttagaaaactgccgctaatggtggcgcacgtttgagaattggtcgaccgagtcaccccgctcaaacacagctgctgcccccatgccagatcctgcaaccaattcatgcatagttacatactagtacacaagatgtcatggaagtttaacaacgagggctacttgcatgcattctcctgcacacagagaaatccagagaaaaagaactcaccaatgcacatggtgacaacaccgaatctgcagtccctgccccggcgcttcatttcattcagaagagttgcgacgcaccgggcacctgaccaacagaggaacaatcaccccatttagaagacatgcttggatgatctgtagcaggtactaacagacagcaatgctacttccattgacacctgcacattctaaagccagaatgacgatctcccatacaagtatttgattacctgttgcaccaagaggatgtcctagggcgattgcgcctccattcacgtttacttttgacctgtccagtcccagcttgttgcagcaatacacgaactgcgaagcgaaggcctatacaagaatacagatggcatgggtatcaaccattgtagctaggtacgagtaaacgagtgagctaatattgtaaaaagtaacaaacctcattcaattcaaacagatcaatgtcttcaatctggagtccagcagacttcactgcagctggtattgctactgcaggaccaacacccataacagcaggatctactccaacagcagcaaagctcctaaatgatgattggaggcaacatatggatggatcagttaaaagaaaatgtgataatatattaggtcccaacagcaatagcaataacaatgatgatcacaaactccgttcacacctaacaataagatacactccctccattccataatataaggcacaaccacttttcttagatgttccataatataaggtatacatgcaaacatgcaattaactatgacatcttctccattaaattattacttttttaaatcctccactctcatgctatctaatcctattggatgcatgcattatatttattaggatgatccaaactacaagatgataataattatttcttggtctttgggttaagggtggttgtgccttatattttggaatagagggagtatctcatacagcattcaggaacacatgttaagactgaaccaaatgctgtatatacaaggaaatgcaaaatgcagcacctgaaaacaccaagaataggaagtcccttcttcatcgctacgtccctcctcatgagaagaacagctccagcaccatcgctcacttgactagagttgcctacatagattcgttaaattaaaaaaaaaaaacacatacacaatgtaacaagcaatggacaaacaaagcctggttgcaatagtagtgtcagcagaaaaaaaagctaagagtgctgcaatacctgcagttgtggtaccatccttccggaaaactggtttaagctttgccaatccagatgctgtggtccctggcctaattccatcatcaactgatatcacaactttcttttcctctccagtcttggggtcaacaatctgcacaggaaagaatatcagtgaaccttgcacaggtcctgattagcaaaagaaaaatccagtgacaacaaccattcatgagtcaacaataaccatgaacaataaactaggttacatcacatgaactaaatcccagagcctcttacctttgtaggcaccggaacaatctcatctttgaatttcccagcagctgtggctgcagcagccctcctatgagactcagcctgttaaaaacaaaaatttcgacagtgttttgagtaaaaggaagcagtgggaagaaaaaacacaaacagaatgtatgcaagtgactcacagcagcctgatcctgctcttgtcttgttacaccatatcggtgcgcaacattttcggacgttatccccatgggcaaaagacaatcctgtgctttctggacttcatttacctacaaagtacgtggtgttacaaggcatcaccagagaacaacagaaatacagaggatgctctggtgctcatagaattcatactttagggtttacttgtccttcccaacccatagcatttactgacatggattccaggcctgcaccaatccctgtttttgatggaaaaagacaaattagcacctttaaatgaagcaaccagtagcagagttagcataaccatattgtctagaacgagtaactagttaattacctatgtcgtagaacccagctttaatggccgcggcaacatcagccactgcctgtaatccagaggaacattgccggttgacagttctaacaggaacgttttctgcatcgacagaaaagtaaaatcaagcaaatgaaaccagtgtccataataaagaagccctgtcttcatatggtgatataaccgcaaacacagtattaccgggaactccagcatagaaagccgcagccctgcactcgattgcacgctgcgagcctggacctagcaccgtgccaactacaatgtcaccaatttcaccagggttgatcttagtgttgtccagaacagcctagaaaatacatagaaaaaaaaggagcaaacgattgattgagaacgcatagtctctaaattcgaagtaaccactgaatcacagcatacatgaagggcaatattagcaggcgcaaacctttagaacaacagtaagaaggtcctctgggtatgtatccttgaaacctcctcgcttggccttgcatatgggtgtcctgtaggcactgcaggtggataaacatggaataaagtggttagaagagtatctatcacatccgttgatcgattcagatacgtggtggcatattcacatggctaagcacacaaaacatgctacagccaaaaaagaaacactaaaaaaaaaacaaagcttagaacttgtagtttgtaatacactttgggtgataggtggtgaagagatagaattgacttgtagagtttgcgatcttttatcttgttgcaaaatagcagtaacaaactcttcttttttttttgcgggggtaacaaactcttgatttagtatgatttcagctactagtacaaggtttatcctaaaactaaagaggttaacttcaacaaaacgcatttgacttggatgggcgtacatcgcgataccaagcacctacagtaatcctgattcgtaagaaaagtcaatcagcgcagttgcttgaatttactactattcctcaaacatggcagcaactagtggtagtcaaacatccgccattaacaggtgaccttaattggtgttccgtgtaagtaataacaggtagtagtaggaaaaaaaaagggattagggatgtaaaagcttacgcgacgacgacgacgtcgtccccgtaggcggaagtcctctggtaggcggcgctgtccccggcggcgcacgccgacgcctgaaccaatcaaccaacaatcgaattgaattgagtccagtgagagagagagagagagatggagattacaaagagaattgcgagagagaggaagaggaattgactcacggagaggagcgattggtcggaggaggaggaggggaggaggtgggcgaggaggacgcgctggcgatcgatcgccttctccatggctgagatccgagcgcgcgagctggtcgtcttcttccttccgatggggtggggaagcccgccgcggtgtctggagaagattttctcttgttcgtatcgctctctctcgcgaaagcgccgattacttgacgcaaccaacgttgcttctgctttgcttatgtaggcgccactaccggataagctgcccactttttttttatttcctttcgtactgcttccagattttcttttctttctttctttttttctttcacacaggtagtactagtagtccagtagcagcacgtcgcttgcacgtaacggattactattttttttttgctctccgtattttgcctggtattcctacattcttgtgtgtaacagtattgttgtctgaccgtattgtacagtattctcgtatctctgcctggtaagactacgacgtgggtaagtgagcagttacaataacaagctataaacaggctataaccacgtaccgagaagaaaaaaaaaagagaaaaaagaaaacgggctacagatttatagccagctgcaacacgaactctaaaacgttatatctaaaacgttatatgtatatgagaggtaggacctgttattaatggtgcagtatatttttatagataactattgtatgaataaactattatattagttatagatgatttagagccaacggttggctattctattgaacttgctctaattgtgatgatacgagtgcacatgctaatcgagaatccgcgccgaatggtgatggtctgatggagctaaacgtggagttcgtctgcttccatgcttgtgctgacgtcaggcctgacggcagctggccggttggtgttagttgcagttggataagaaaggccaggccggtagataaagacaacagcagccgtaacagccaaggtctgcttcccacgatgacaaagcccatcttgtttcatgggcttgggcctcacctcatcatcacaacggcccagccaggatcacgtccaagcaaatgcaaaaaccagctcaacttgtccaaaacgacttgcatttttgcaaagacagtaaactctgctgaaatttacaaataagcttcttcttcttcttcttcttcttcttcctcctcctgttaacgaaccaacagtaggaaggaccaagttgtgagttttcaactgtcgacaaatttcaatcaaacgtcaaccaaccaatcccttctgaacaatttttacaccgatttgtacacgagggccattcttgccttctccatcaatcatcatcaggatcaggtagggcagatttcaggaacagggggatcgccatggagctttgcctgctgctccgaccagtaggcctgtgcggcgagcacacggtccaggagttcctgtggaactggagctccccttctttgctgcggcgctatgctcgccgtgtgcaccagggtcttccacttgtcctggttcatcaaatattgtttcacaggttttcagatagtgcatcctgatcctgatagaaagaggcagatctgaagaaaaaacgagatagatttaggcttaccttcagatcaacataggtcctatgatgaacattttcaaatgcgcggaatttgacgtccctccacctagacaaccagatcaagaggtccacatgagacacgcgaactgcggtgatgatctcgtgcctataggaataaaactactggggcattgaagccacaaaccttcctgttccaaggtgctcgacggcttccaccagcaactccacttcagcaacagtgaaaggcctccttatccgtctttgcccaaaatctggtcgctttgacctagaaagcggcacattggccagcgccagtgagtttggatctgcaaaagggacgatggcttgggagcttgctgatgtttcttgtgtgctccattccacgggataatcaacagaaccaggatcactcaagctgcagcctggaaaatcttgcataagctgctggttctcagcaggttcttcgcatttcaccctggaaatggaatattaaaacccttagatgaccacatacagcaaaaatctatggtcgtgtagtttccgaaacttctgcaaaacaacaacgttgacataaactatcagatgcatcctgacaatgttttctaatcatcacatgtaaatccaagcctcctgtctaataatgcaaggagaagatgctttcttgtaacctacgtagcagacttgtccacaacagatgcaccaacaaaatccatttcttctggcactattacaccagggtgagaatcttgcccagcttcacattccagagtaaagcctatgtcatttagttttttaccacggcaaatcccagcctgacgaagcgtcttgttgtcattttgaatattttttccttgaagaagtataccgacacggagaccgcgttcaattatagtagtaacagcatctgacacagttttctgaagacaaatagaaagaaataatgtggttcataagaaagccaatgtctatgcacagagataaatatttaagtgtaaagcactgacaggcagaaatattcaacatatataagattaaaataagtgtaacgaaaaggcaccaccttttcactatgtataagtacgttgcatcactaaaactagaaaactagatcagtcaaatacacattagcatggatcacagagcagcaaatacttgatatatttgagtttccaaaacagctgacacaggataacactaacgatactaagattattgacagcaaatggaaagagtatcaggatgcacacatgaatacatggttgccaactaataaatatatgttacagccaataacttttactgagaagatacacatatggtgttttaccttcaatgaaccaactgttgcattttcagggatctcaattagtagttcagggatgttgaaagatttgatggttaacttgactgaaaagagagaaaaaagtaagtcattgtgtttataaattaagcaatgattcttttaagtcaaccccaaaactaaaataaacatccaggacgccatcatagccctcagatgcacatgcggatttggatcacccatacaaaatggagttccactggcagaaatggcatgcccgtgtatttttaggaagtgtatcaaagcaggggttcagaatatccaatgctgtgtgtaagaaggattaagtcgtaccaactatgtgcaatgttacatcctggagcaatctaaataatttgtgacctttagatacaataagggaaacggacaacacaatacatactttcagttaggatctgagtttttaataaagcttccattatcaaaaaatactttcagttaggataccttcatcagatgatttttcggagtaaagttgagcaagtcttttcctcttcaaagttgtttgttgcactcttcggcgcgtagtgggcatcttcttttcacacaaactcagcttgttacctagttaaatgataaaaaacttggtcaatataaagtccaaatcctgctaactagctgaaaaataaaattaagtaggaaaagaaagtatcctctcttttcacaagctatggagctgtagaagagatgatattagcttgaaatacctttacaagacatctctccacatatcctgttgcgagctgccttccttaacctggaggcaaacaatctccttatcctgcggtcacctatataatgtggaatataaccacggttatttcctgaggtgcttggatgtacacacccagaagaattttcgtcatcatctctgtctgcagcatgctgcactttagccaaacacgagggatgggagttatgccccctgtcagggccgcagatgtgcactcctgagttactaccagagctagcctcagcaagaggtttggtgtccaaatccatggtctcgaccaaagcacatagagctgcagcatcactatcttcttgacttctgattgctgttggtctcgcccgatgcacttgtttaacctctgctgatcttgtggaccaaggttggcatactccaacagatccatactccggaattgtgccaagaccaaaacccaatcgacatgattttttactgctaacaaatgagtccttagccaacacatcaggctttgctgttagtgactctagtactgaatcagctagattttgagtcgacgagttttcagccaagcacatattagcttgtctgagaaagccacagatgcctgcacagcctactgtacaacctttgcagtcatcttttttcacagccacgcttctcaacggaaacgcttcatcaaactgttctgctttaactggtttcatgcttgtaacataaccttctggtgtttcatttatgttaggtccactagataaattgtcttgatcagccaacaatttttctgcagctgtcgcaagcaaatcaagtgcatacatctgctttttccttattcttgtggagcgtttaacctgaattacaatcgatcattaaaacttaccaaattatgtgggtagcacacttaacataagaacataacaaaaatgtaccggcgccaatgttgcgacacgtggcttaatgggagcacgatggccatgggatccatagtccaacctcttctgcaacaccatgtcttgtccttgactttaggaaatgtgttcagtgacagcaaggggaagtaaataaaacatgcgccatatttttctgcgtcgaataagcaagatttagcgaacattgatccaataccgaaagacatcctaatacagctcacaactaaaagaaaatgctgaattctatgcttctgaaatggaaagaattcatcattggtgagccccatcaaaaccgataatatctggcaagatgacattcgctgaaaccacagtctacttgtagtagtatatctttgctcttaaaaaggacaaattggggttgatggtgtgctctacaccccaccccgacatctgagatgatgttgtctggctagatctgtgtatacacaaaccgaatcaaacatgtttcggctcggcaattattcggttcacacctagagcataaaccccatcccgaaatgcaatcgagcatctcgcgtaactgacgagagggaagaatccgcattacccgtcgacgccgacgaagaggagggcctcgccgccagcgttgagatcgccgcagctcggctagggttttgcagctgcgtgttccgacagccgaccaaccggagcgggaggcgcagatcggggagcaccggagcacggcggaggggagcagatggcgcgcgccgccgcagcgctcgtcgcctaggattggttgacgacgacgacgacgatgcccatctgctgcttctgctgtgcatacaagaaacgaattttgcatataagtttccatttttttctccttttcttgaaaacatacaggagataatcagagcaggaaataaaatgaaataatcaggcaggttgtccgatcaagaagggtaaccttgtgggggatgggggaaggttccagaaggttcgagaagagcgggcggggaggaggaatcgctgcaagtggaaggcgcagggaggaggaggaggaggagagggagaggggaaaggattggaggagaaaaaccccgtggaagagaagaagcgaggattttccttgtgtttcttgctgttttttcttttcttttttttcttttttttttgatgatgggaagaaatggttttggggcagagtggttggttggaggtgggcttgcgcatgatgcatcacggcccattggatgatggatcggttgggcttaatttttgtttttggagcaaagcaatatgggccggcctggttatggcctggttatattcgaagatgggctgctctataactggaggcccaacctgtattatgggatgagatcccaaatgcaaaaatcacacaagtttgtcatgattttgtcgtaagatctgtccttttacgagtggaaatgaatagattcacgggccatggacttttctaacaatagattaacgccagcgcacacttcctgggctcctaaacaagtgcatttttttgcaaaaagaaaaagaaaaactttatatatatgaacttacttgtataatccattttccagctttacaatagttaattcattcgtttatacccttaatagttatcacaaatcattcggctattcaacaattaattaattaagcacaaacattcagggcggtgacaagatggggtctaccctgagaattatcctaagaacttggaagttcagggacccatgcacaagcaactttgagtttacgctacagttaattaatataaatcggaaaatatctctcaagaaattagaagtcaactaacacaaatcatattccccttatgatgcagttcttttctcccgttccattgtaggagtagtagctttcacttgatgcatctagcactgaatctacagcaaacggccaagctcgactgcaagttcagcaagcaacttggcagatgcatacacagcatcgaagcatccaagatcgatcgcccacctaacacggcgagctatctgttttccagcggcgaaagaaaccacgggcacggcgagtcggctcaccggccggccggtcggtactcagtaccaaaccaaaggtcaggatgatccggcttatccactgccacgtgacctgggcccaagagaatcccgccagccaatcgccgcgcgccacgtcgcccgctctgtccctgtagaacacacaatcatgtccgaattccacgtcagtccacatccaaacttggagaaatctgagagaattactcacactaacctgacttcttcactgatgaatgcaacccatcgtacttggtagtagtagtacatatccatataaccatatcctgtttcaggccttgtcagtgacaccttggttaaaaccacccatgcaccattctgctgctctcaaatcactatcctgaatacactaatctcaatctaattactaagtttcagccaaacctcagaatatgcaaaatagtcatcttcagcttgcaatttgcagatccataagttttgccatatgcatggactatgataaatgccacctctgaatctctgatagcagaaacaaatgatgatgagatactaacaagcactaatggagtattaaaaaagatctgagcatggatgaggtcaaagtccaccaataggatctgagcagtagcagtcattggtgggccagcacctcccatgcattcctatccacctcagctccctgacaatagacgcaagtatccagttcactataaatgaaggcctccggctacgatctgcaggagaaaaaacagtcagaagctaaggaagaaaaagtatagacacagtgatacaatggcctgcatcaacacattccagagctgctccgtcctcaagggagcaaagatcaatggtaccaagatcggaggagggaggggatcaccaaccttccggtgccgggcatcgacgttcatggacgggagcctccggctagagatcgacgagaaccctgaagccatcatctccggtgagtggccggagaacttctccctgctcagctacgacgatctccgcgcctacctccagtcacaggaggccgctgctcaagccgacaaccaggtgcactgatcacaccatatatacatagattcttcttcttcagatcaccaactgtcgatcttcttcttaagatcttgctaaactctgaactggttgcatggttggtgaattgaccagcgtgtggcgctcctgagtgaagccatgtcggcgcctgtgctggtagccactgccgagcagacgctggaggaggttgagtgccactttgagacggtctcaggtctcccagttatagatgccagcctcagatgtgttggagtgatcgtcaagagtgaccgggccagggcttctcatggggtcagctctctttctcctctcacacacacatacatgatacatatccctctcactcacgcacatactcaacaacaaaaataagtgctgatctattgcttcttgtaacagtcaaagacgaagattgcagaagtgatgacctctccagccatcactctaccatctgacaaaacagtaatgggtaatccatcgttgttttcgcccttattttttttggttattttccacttagctaccagttaagctaacaaggcatatgcaatgtctacagatgcggcagctctgatgctaaagaagaagatccacagattaccaattgtaaatcaggacagacaagtgataggtgagttttgagcagtggccaatacagaaaaaaaaagggctttcattttttccccttgattttataccatccttaacattgataattcagagtatgttgcatgctaaatggagttccaaacactattaacaggtatagttacccgtgctgacgttcttcgcgagttggaagccctgctggaggtttagacgtgcagtggtccatatgcttcggccttgttgtatatatgtaaatatatgccatggtgtttttgaatagcaggcatctctaatctgtaagagtgttgtagcgcgaatcaccaagataagcctgagaaaataaccggagagcttttctttgtacaataagcacactatgagacctccagtgttgtatgcctgtgaaaaaatttacgttagtgaatggtctccacaacaacatagatgaatgaatatgcctagttatctttcagaacaaaaccaccaaggtgcttcaaagatggatataaaagtgaccttattgaagtttcattgtcagaggatgcatagaacaataggacttaacagaagaaaataggaatgccgatgcaagagatatgcctattcggctattcctttgccacttctgagcactaacaggaaagatggaaatgtgttatacccagaaccacaacaggtcaatcaagatagatggaaaaaaaaaaatcaacaaacaccaatatcgaatgtgacaaatctttagataaaaaatgaacctaatattataagctgaaggaaccgtagctatttcaatctcaggaagacccaaggagaaagaacatactcaatctgtatgtcgtggcaatgctgaggctgtcataactcagattcgagttgctgagacttgcccttgttgatcttctcctgaagcaatactagcagcagaaacgggcattgatgtagtagtactcatgttttctggtgaatcagaaatgactttcatctctaggtttgggattacaggtggctttgtcctccgagtaacagtcattttcaacccctcagttgtgtgaatcgttgctccagttgtcatctcaacctatcatattgatacttcacagtgattatctgtatgttgataactatgaagaaccaggaagcagacagaaattataccggaggagctcctggagccatttgaaaatcaaagcgcctgacaagcattgcagttgccaccacagtctgcatacaagttccggcatatccatgttattagagttggaatcttgcatgctcaatagttattgtactacattatttatcatggcatgagatataatgtccttatggtagacaacagaaggctcaaggcaacaaggttcagtaagactggaccatacataagtttgctatgtttccttaaaatgacattttgaaattaaaagaagaaatccttcaaaaactaaaacaaattacctcgaaagtggcaaacatgtcacctacacatttccttggtccgccaccaaatggcaagtaactgagaattcaacagaacacgtgagtcccatttagctatgtagattcatcaaatatattaaattagccagtgaggcagtgacagctaacagatgctagccgcaatacacagaatgaaagctaccacagcctaaaattggagcttaaaaagtttgacatgccaactgaaaatcaataatttggatgttgtcttgaaagaaagatgtgttccgcagtgagttcaatctaagctgacaaaataatgggacatgtcatgtgccaagtaaatgcagattaccatttttaagtttcagtgtgatgcctaggagacttgctgtacattatagttgatgatacgttggttgtttttcaattaacatgatttgcaggtcacaggttttatgccgtgcatcaactccctgcaagactgcaacacggaagaagtttgtagtccagtcggaagtcttcattaactcaggatggcacgaattgttacgtcttctaatcaagtaaggattttgttcaaagcacctctgatgtttgttgatccatacaaagggttctgctgttgacatacttgctacaggtaaggaactcatacgacatactatcagtttatacaaaattactattccaagtactgtttctgcgtaaccagttaacagttctggcgatgtggtaaagttgaaaagtactttcaagcactatcagtttgaaagtacaatagcattttggcacatgttgcttatagccatatgaatatcattttaacatgattgtcataaactgtggtttagctcccaaaaccataaatttaggaatcaagtcatcacagttatctcatctttactgcttcaaaagaaaaaggtcccatttttctttatgttgttgtgactgccttatgcactttctaagattgtggctatgcacatgccagcattagcactaaattaatacgaatcacatgaagaaaatttgatgatttgcatcaaagaagaaaacgaaaatcagctagagtttttgtttttgttatctctagaataattacaacaggtgcatcgcatgaccaaataacttagtgttagtagatgtaaaaacgcaaacttctcgtcaaacaagaacacaactataccgagcataatcaaatgtctactgatttttgtagtagaaagcagaaactaataaaatgggggaattagagtgataaggtgcatccaaataaagagctaatgcatttcatagcattaatagagatggaacctgaaattttggtttgtttcatttggatttggtccatccaaaggccatctttctggattaaaaacatctgcaccatcccaatgctttgggcaatgatgtaggttccacacggatatgaaaatgtcttctcccctgggaaacaaagggaaaaaatatcttatcagaattataggtgaagttcaaatttgtactgaaatttttaaaaaggaacaattcagacaattaaatactctagagctacgaccagaaatggtatacaagcagaagacaaaaatatatcacacaagattgggaagatattctctaaaaaaagattggttagataacttatacttgcacatatcttaggccctctttgtttaggcttataagccagcttatgagctgaaaagtctaagcctaaacaaacaaacagcttttcgcatgttttttttaaaagccataaaccactattacactattaaggctcagcgaactgttacactattaagacaaaagctaggttggaaaaggttttttggcttatgtgagatagaggtatgactccaccattaaacttaggactttaaatccattggcttataaatcatataagccaaaaaaactgacttaaaatactaaaccaataaacttaagcctaaataaagaggcccttagactcagtttcaccagaactttactggtgtgatactaggcatgatctttctgttttcctattccaattgtaacaacagtcaacaggactacaggagagatttcctacacttgagaaataagttctgctagagttttctttaccggccaattgggtaccctcccagcatatcctcctcaatagagcgacgaattaaaactggtggctgtggatagagtctcaatgactgcaaaagtggtgattgaatgacatattcattcagtgatcatactcattgtttaatgaggtagcactgtttatcacttacttcgttaattactctagtagtatacttcaatttcttcacatcctcaattgttggtaaacggtcacctagaacagtatcagcctgtccataagtgagtgaaacaagtcatttgcaacttgtaagatgtagaagcacgtgcctctaaaaataacaatcctaaatgtaaaagcgaatttacctcatcttggagtttggccattacatttggatactgcaagttaccaatgccaagaaaggtaaaacatgagtggtttgacgtatacaatattcatcattacatattgctacattaatacatcaatgatttgagttgctgaacatattttcttttgggaacagctacggaacatattgataccttagatagaagataaaatgtccatgtcaagactgctgcagaggtctcatggccagcaatgagcattgtcatcagatcatcacggagttgcttgctggagacctaatgaagacaaattgaagcaatgtgaggaccagaatgtttggagatctataatattttaaactgcaggtacaccatacatcatctccagatgccaaaagaaagtggaggatactggggtcttgctcattcatgtattcttcatgaaactgcagatcttcttcctcgaccaatctctgcaagagtaacagcagccaatctaaaagccttgatttttttaaaaaataaataataaggtcagaacataagaaaagaagttcaccttgcagatgtcaattagttcatcaagagtcttatttatcagcgcaagagcttcattgaccttcttctgccgcggggaaatatctttccatatgggtatttcccaagttggtataggagaagtgctccgcatttctgcttctcgcagtgtcacatacactgcctgatcatcaatccaaaaaaaggtaaaattttaagaaaacaaacatgaacaaatagaatgtataatgaattccaaaattacagtacaagactgaatactaacctcaactattccattatcgtaagacaatgagtcgaaatcataattgaagactgccttcccaatgacatccagtgttagtcgagagaacaaagattccatctccacatcctccccatccgttgctgccttgtccaacttctggcagagccgatctgaagcatatccgaagagacttatcattgcggtaacgtactgcaaagcgaaattcagatcagttcaatcacaacccgaagatcaaatcatgctaaacctggtacagaaatgatgtagaaccttctggtgcattgctggtacaatggcgcgcctcctaacacgccaaatctccccatcagcagggatcaaacccgtacccatcacaaactctaaaatttctgccagaataccctgcacccaccacaatcaaaatgcaggccgttaatttctagagcacagcctagaacacgtctacatccaaaattgacaacacaaaaccttggaataagccttggagttgtccctcaggatgtgcttagctatagctggatcagagacaatgaggaaagactggggaaaacaagaaaagaacaaagtttaggccatcaataataacacaaaattgggagttgccgagttggagagcaaattggtctgattgtgcatcaccttagggccgaaattgaggcgaaagatgccgccataggtaaggaagagatcatagagcgggatgaagaaagcctgccctgtcaccgcactcatagaccccaccgcctgcggtatctccggtccgccgccaccggcgaccttggtgagcagcgcggcggcgagctcccccggtgggccgagcttggcaagccccaccgcgaggggagcaatccacctgaaaaagagagagggagctctccatcagatcatcaaaggaggaaggaaaggcggccgcaacgtgagagagagagagagagagaatgagcactgacgcggggccttgggcggtgaactcgccggacgcaatgcgcgccgccagctcagcctggcgccgccgccgccgctcctcaagaaccgggtcggagccggagccgtcgccaccaccgcctttcccgttgccgcccgaggcggcgcagcggaggagcaggcggcgacgagctgaagcagcagcagcagcagcagaaggaggaaggcgcaggtgtgcctgaccggagccgagtaagcggcacggaggtggagcagcggcggccgcagaggaggtagccgccatggcaaaggcactcactgacgtcgctgagctcatcgcgagaactcctcagtggtggagtggagtgatgaagtgagtggagtggcgcgaggaaatcaatggtggaggtggaggatgaggtggtggtggacgtggggcctgctcctccgtttgttgagctgcctttcccgcgcgcgcgcgactcccggccggccaaccagacagacaagacaaccaagccttcctccagagatgctactggagtgtgtaacggaatctttgcagcatcctcctcttcttctccgttgctacaattgaattggcagctaggatcagtctcaactgataaaacatactccctccgtctctagatatttaacactggtgatttttttaaacatatttgactgtttatcttattcaaatttttttataaatattattcaaaaacttgagtagtaatagtatatttaagaacgaatcaaatgataggaaaagaattaacttttgaataagacgaacggtcaaacatgtttaaaaaaaaatcaacggcatcaaatatttagggatagagggagtactacatggaatagaagttatatcttatacttcatccatcctaaaatatactctatccgttttaggttataaaacgttttaactttggtcaaaatcatattgttttaagtttaactaagtttatagataaatataataatatttatagtactaaattaaatttatcaaatcaataattgaatatatttatttttttctacaaacttagttaaacttgaagcagtttgactttgaccaaagtcaaaacgtcttataacctgaaacgaagggagtagaagattttagataaatgtggcatatccttgaactataaatctatacaagttaagaaaaatgaatctagacaaggtaggatatgtaatatttaccaaaaaccacttatattttgggactgactgagcagtaactaggagcaagattttctttgaaaattgcactaccaaaagactgcagtgaagaatgggaaatcagaatatagagataactgcagactaatcatggtaaatttgatataccgacagaaagtgcaggttttcgtgtggcggcagttggggcttcaagataccgtgaattggatggtattggcatttttataccttcaagtgcaaacagcatttgtcctggagttggatgttgttgccagagtataaaattggaacacgctgtagcataacagtgatggcaacgtgtaaaacaatcataagaggttcgcattttaatttttttcattttgagatgatcaaaggaagatcatgtacctggtaggtataacacaggaaacagtctccatatcctatcagctgcagctccaattgaacattcagatgagatgaatccaagtgcagcctcttctagtacaaactgtacaagagcatgggggctctctgaagagatgattccaatgcaactctttgcaagttttcgaaggaagacattgacacgtccatttccatcatccaagtcatcgaatgcagccagaagaaaagtagttttcacaaggctccaactttgcattcttcctactaataaatggagcggaaatagagaggcaattttatgttatcttcaaggtggaatcaatcatgtcgtggagaaaagaaagccatctgtatgtgtttcaccttttttttttaaaaaaaaaaatctaattggtaactgaaggaacacggcgcatgtcgataagcatcctgcagcttggagccttgggcaaatcagctggccttcttcagataatgcttccctcctaggcattggcccattccgttaatcacctgaagaggacatcacctgaaggggacaatagtagttttaggaacaggttaagacttaagacgttcaaaaacttggaaagccaaatgcagtgagtccagatgagccgagctccgaaatatgtaccttcgaatttaaaacagttttcacattgaaattgatattttttttccacattcgcctcatctgattgtggacatgggtagaattggatcccatatccaagtacagaaagtgtgcaacatctgttggtagttacactaaagtgccccccagactgtttttaaagaataataacctctacagagaattggaacagtgaacatcagggaatgtcagtaaaatttaacagttgctgttgcaacagaaacaacatgttcagaagctcaatggctaaaaggatctagcactgcaacattgattcgacacgagtggaactagtgcgcgctagtggtggcgcagaagcttgaagcaaagaaaattcagcatatctcaacatctggtacgcacacgcacatcagctaatggaagaaaagccaaattaatgagcagtcatactgcacaaatcaaaccactcgcacacatttgttaagcaattattaacaattagtattaatttgcccagaatgtgttgttactgatccgaagtgcaaatgcacacagatttttgccgtgatccaaacaatagctaaatcggagcaccaaatcgaccacacccaccagattttgtagcagacacagcaaaagcagtaatgtaggagtaccttggaatgaaggagatcgatccatcgttgaagccctaggatgctattcccttcctcctccaccgcctcctcgctcgaaccgcatcgttgaagtaaatctacaagttcatggggtccgtgggcacctggctcgacggcggttacgtggagagacgccggggcgtcgcgccggaccgtgcagcctgcgggtgggaggagatagggggtttgggattcggagaagacgcaggaggagaaggagatcagttgcagttgcggatgcagcgagctggagcgattggaggaaggattccttcgagcttggtttcgtgggagggcgccatgggtgttcgacgaaatgctcgagcgaatcagaggaggctattttttttttcaaaaaaaatgaattaagaactcattaacgtataattaattaagttaatattgtttgtaaaatgattaatatgaatttaaaaaacaaattttctttatatatatatatattaaaaaaataatgtttaatagtttaaaaaacgtgcgtgagttgagttgggaaagtaaaagaaaacacagcggtcgaacggacttggcagagaacgaatacaatccatatcgctgaacttgtcaaaaaaaataataccgtatgtatatctccagaagaacaatggcaatgtagttcattagtacagcatcggcgtgtaccattcataagaaaaagagcagtattagttcatatccaaatctcatgctatagcttgacatcctagagaagtcttgctgccatagccccacatcttcaagaacaattatttgtgcaaacgttaatgtcgtctttaaaaattacatctacctgctatacaggatgatatcagctaggaatcacaatcctccagcagcagataaatggccatggattgcattgtcatatatgcatatatttacaaaatagcatgaacatggagcacagtcagctttgtcagccactgtaacaccgaaatcttgtgtgaatgaaatgggataataggcatataggattacttaaacgtcgtgggaacgctggaagattaggagcgctacatcagctattttttttataaaaacccttgcgctttcggttaattatgtgccggtccccgctgttgtccaccatccaatttcgccatagggtcgatctggccgtccacgtgtcccgttgtgccggcccttccacgcccgtgcgatcgtcggattatggatggacggcctggatttcgcgaaacggtacaaaccatagccgcccgtcctctcctctccccacgcgcgtcggttcgcccgcctcctccgctcgcgtgcgccgttgccgtcgcagctccctctcctctaccgtgctgccgccgccgctccctcccaatgagccgccggatctcccagtgaggaggctggggccgccggatccggtgaccccggtctcctcgccggcggatccggcgcccagacgcccaccttctccgtcgctgccacagctcccttctcctctaccgtgctgctccagccgccgccgtgtcactctgcggccgccacccttgctcccgatgccacacgacaaaagtggtggctccttcgccttcgcctcctccgctctgttcctctcctctctccaactctcctcaccctcttctcctcactttttctacacctttgttgacgagaaaatcgaacacatcggcctgggagatctacttagctcctgtgcaggtccaaagattaatgagatgcgggcgtgccagtcagtttgatcctgcaactgacaagatttgcaaataatagatcaaacagccgatcagctgacaagccgatggagtagttccagccgatagccgataatagatgatgccgataccagccgatggcgatagggtttaagcaatcggctatatgtccaatgtagataatgatataaaggcaatcggctgatgataatataatatagcaatataatctagtataaaccaatcggctaacaatatgaaatagtagaacaaatattgatctgtaggttaaagcacacatcggctgcaggtccgatgtcataagatccacaagattagattaaacagtgaaacctttgttgccatcggctaaatccaacttatatgtatatgcaatccctacaagccaatgcaacgtccagataacttatcggctagcaccccgataaaacattagcatgaacctatcagcttaacaagacttatattatcaacaacaatctagtagatcgaacctaaccgatgcagcatgagattgtatatgataatctaatactcgatgagccgatagatctgtctaatatgatggatataacaaatctatttagaaaaacattatgattgtagagatatatcggctaagacaggagatcaaacctaaccgagacagtcccaactaaaccgatgcgtctctaaacacaatgcaattagagatagaattgagatatcaggtaggcaaatatatcaaccaaaccagagcgatccaagagatcgaatcgatgcagccttgaacaacaccaacatagccgacagattcacagggcccgacagaacgtaggacttaccccttcgctggagatcgaaagccaatgcagccctgcgtcaggtgcccaagttccgccggaagacaagtaaaaacctcagggaagagggtggcgatgtgccgagagtattattgatcgatagattgatagattacaatgaccccgggtgtacatatttatacccatagggagatactagtccttgtcggacaagaaagaaactaaaaaggaaaagataaagtccttatcgaacactaaacacactttcctaaagataaaaggaaactaacaaactatgcctaattaataaataactgtcatgtcgcatccttcttgaactcgaactcttctagataagcttcctttgattgatccgactccaccaagaacacgacatcgtggcgacttgactcccatcggctgattctagaactttgaagccgatactgactctaaatcgatggtaactttgggcttaccaaatttcactattaacaaccttcaacgttggctcgtcccgcatcctgtcgcctcgccccaccctttcacgctctccgccaccgccgccctctattcctctattccaccgccgtcgctgccctctcctccgatgtcgatcccgatgtcaccacctccgtccaaactgcctttgactgtgtgccaggcgtcggcacaagccgccggtggtacttgccgccgtcgatcctcaatcccactcttcccctccacaggttagccctaaactcccttgctccccatcctccatgtccctcttctctcttttccattggaggcaggtgcaaggagcatttgtttttgtttttttctcttcgcaattttgtaacatagaagataggatgactaaaccattgtggatcccataatattaaacatgccagttctattgaactttttatatcttgatgaatgtgtatgatgatttacttgatactactttgatcaaacacacatattgctatcatggtcttcttggatgctatattgctattggccaacttaagatgcttgaattaggtctttttaagacttcatcagaatagttgcacctaacaaagtaaaaaccagcaactttgatggtccctaaagatgtcgaatagccgtatccctaattcgtcacattaaatctgaatgcaataaaatttgtgaagagaacttgtggattaaggaagttgcgcttcattttgatccactatcgtggcctacccactcatgagtggactatatatatgtgtacatgatctaatttattatccttgtgattggctgctgtcattgtgctccatatggataacacaaaaacacacacacacacacacacacacacacacacacacacaaaacagaagcatcgccttgcagttgcacttgccaattattgtatcttctatttggaggtttcgatgctcttttgttgtaaatgtttaatactaagttgccaactattatagcttctatttggatgtttggacaacgaggttgacgctggcaaggccgtgctcgcggcgtcgcttcctggtacctccaatttcttctctggcccttacctcatctctgttgccaaagatttccttccaatcggcaacccttctttcgcagtgctaacaaggacgcccccatgtggttccccgcttgcagttgggcctttcctccatttaataaagcctaggatacctttcaaatgtatgcaatgattctctttgcttgccaaggtaaagttcctttttagactgctttgagattaatatttgtgcttcttcttttttgccagcataagatgtacacttagaaacacaaatagtgtggatccatctcaaagcctttaggatcataatataaatgccctactgtttttttattactgcttattaagcttctggtatccctccactgcatatgaagtgtgacatgtctatgtgagttctgtttttccaacatataaaattataaagtcatcatgacctatttaaaactgaaattttagctatcattgacctatgctgaagccatgtgactttttttggtttacaccaccttacatgaggtgcatattaaagtctgtgtaccttaatttggttcttcctcttagctagaggtatactaagacatactagctaggagggcctacaatccattgataatgtctcactgaatgcaaattaaaagagtcttaagtatctatacagatgtctccagattttaactatattgtgcaaagatagaattaactaatagaacaacaaattgatgtggagaaaatctctgtaataatcaatgtctgctgcaattgcttattataattcatgctctgtacttgcgcgtgatgatttaaatttcagaataagtgtacagaaaataagttgcggtgaactgtgatttaaccatgaccagtgcccgaagaacagcatggagattggagagatgactggtcagacaagagcctttataggaacaaaatgcaacaccgtttattgttgattgggtcatatacaaataatgcaatccgcttatggacaaaaatcaacaaggaagatgcagtacatactacattctggagaacttgatagaaacaagcaagcattttaggtcatcaacaccaccaacaacaacactactccagcacgtcgcagcagcagataacggctaacttgcaaaatgaatacccttatactatacttcctccgtttcacaatgtaaaactttctagcattgcccatatttatttagatgttaatgaatctagacatatttgtttagattcattaacatctatatacatatgggcaatgctagaaagtcttacattatgaaacggagtgagtactatactacctatgtatactacccatgctataagttcattagtatagagttaatctgaattgttggatcgatagtacaatccactataatatactccctccgtttctaaatcttttaacaccgttgactttttagcacatgtttgaccgttcgtcttattcaaaaaaaacttttgtgaaatatataaaactatatgtatacatataagtatatttaacaatgaatcaaatgattggaaaagaattaataattatttaaattttttgaataagataagtggtcaaacatatttaaaaaattcaacggcgtcaaatatttagaaacggagggagtgcgatggtatagagcaccgcaaagtaactctaagggagctcagttaggccatttacaatgcagtgatgtgtcattctccctcgccattccacgtcggcaaagcaggagggcacacgccacgtctgcttctaggcccaccagaatgaggttcgagtgtccaaagatggccactggttcttggcgaaaaagaggacgaatgaagctgggagacgacgctgcttccgcgttgtggagtgagtggcatcgccctccttcccatgccagccgtcgccctccagccagccgcctagcccaccgtcgctgtccgcagccatcgagctcgttctcgtccctgccatcggagctcgccggccacaccgcccccgatccgctcaacccgaagctcgccggccactccgtcgctcgattcacgccggtcggaggagagccagaggagaggggtcgccgccgtgggagccgaggtcgccggccgcgccggccttgcagggccggaagaggaggaggaggggaggcgctcgagcctccggttgcgagtggcattggagtgagaggcgccaacggtcgtgggggacaggaagggcgtgtcaccgccgcgtcgcccggagctcgccggccgctccgaggtcgccctgtaccgccagatctgcgttgccggcctggggaggagggcagcgcggcgacgaccatggtggcggcaacgaaactacggccgcaaccatcctcgcgccgcgcccggacgagccgtcgccactggatctggcaagctgccacgccgtcgtcgagactcgtcgctgccacgccatcttcgagactcgtccccgccatgcgagagcaggggaggccaagaagttcgccgccgtcgagcgccaagctcgccgccctgccaagaccgccgccgtcgtcgcctccttgctgccgagcgagtggcctccatgccaagaccgccgccatcgtctcctccttgccgccaccgccgtcgtccccagatccaccgacgctccgcccggccaccccagcgccgtctccgctcgccactgctccgcccggccccgtcgccgtcgaggccgccgctccgctcgaacgcctcagtgccggctccgctcgagcgtgagagaagggaaggagcaacgttgggctcgaggaaagggagagagagagagagagcggaaaggtggagaaaaaaaaaggaaaactacatttttgtggaccccacttgaggtactgcattgtgcagcttgtgcctctcagtgttcctcagcatatgtggcagctcaggtccggcattttaggtgacgcattgctattgcccttaaaataaaataggttggtttggattccgagcaagctgttcccggattttcttcttcagttcaccttccttgcgccttgcttcctgttcctcttccgcccgggcagtctcataatcagcgcccgccgcgcgcgctgctcttatccttttctcatcgaagtgaaactcaaatctgagctggacttcgttgatgtttaggagaaactctagcccagaaaacccaatttcattttttattagcccttcgacctgcagccgctcaagtttgagcattgttccttcctcaaacttcactgatttggtgccccataaatctgcaagcttgagcaccttgaggcttccaaaagcagttccagtctgtggaggcttgaaatgaaattcttcaccctgaaacggtgaaatcactagaatttccagcttcggtagtttcccaaggaattccatagcaacatcgtgctccaatagcctagcgcccactagttttagcttcacgagatgctggagctccttgatccattccggcaacgttttcagattgccgtatagcttgaggctctgcaggttttccggaggcgaggatatatcatccaagcaaccacacaaacccgacatccctgctgaactcacagacagtgattccagcttgccgaggttggaaatggccaacctaaacgctcgtccattcttcttgttgatgccagccactcctaacttgtgtaatcctgtgagcattccgatgtctcgtaggatggcatttccccttccgatattcacgtcccttagtgtgtacaagtctttcagatttctgatcccctttggcaccatagtgccattttcttcatatactcccctcatgagagatgggaatttcacgcagcaagcgaaagtgcatgcatcacgcctggtaagggccttatggagagggccatcaatgtcccgaagaagaggaaggcaacatgttgcacatagataccccactttacaacgcctctccattaaatcatcctttatccccgttacagtctcttttgagcccaacatggatgtactgtagcttctgcagcttgatgatagtttttggcaaagcctctacatatgtacctctgatgtctagcatctggagttgcctcaggttgcccaaaaaatctggcagtagatcaataccagcgcatcctcggagagaaaggaattttaggtgaataagcttccaaatctgatcaaggtgatgatagtttaggcctctagtcccttcaaagtcgagcactcgtataaacctcatcttgctagaaaccaaaaatggctcccaatacccaaacagagatagcgatcgtattcgggacaggtccactatgcccttgaattaatccttatctcccttccagttgctacttatagcaagatgacgaattgcgccatggatgtacgagctgcagccttcctccatcctaaaaacaaggtttccctccattgactttgagatggcgatgtcacggatgagatcatggactttgcaagagtcaattgatttcctgctgcgagctgattgctggaatggtaaaatcatgcttctattcttgagttccatgaagtagtcgtcagctatttctgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgagaatggatttgatctcccgcgagaagaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatattgattacattcaccactgtcactggatcaaatcctattgtaaatatcatgtttattatcttgttattttggattaaaatatgccgaattatgaccaaatttccaacaatttcaacggcagacttcccatgggccgcagttgagtaaccttctgctgcccaccgatgcaccaaacgccttcgactaatgatctggtcttcaggaaaaatggacagatataaaaaacatgacttgagatggtagggtaaaccatcatagcttttttcaaggacggttcttatcattccaagctctggattcatttccaactcagcactgatattctcgttcaattttctccactcttctggggtctttggtcggtttgccaagaatccacctatgacaactatcgcaagggggagtccatcacacttctttaggatttgttttgcttctttaaccaactcaggattcttctgctcatctaaatatgtagccttctcaaatacctgacattgatacaatttaagctttattgtgctctaagtaaaacaaaaaaataattaagtttagaaatatgtctttactattaaaactagggaatgaagaccaccgtcacataccaaaacaaggtcacatctaacatccatccaatgcaggtcattttaggaagtgcatcgctatggttgtttttttacccaacccgctattgttgtgagaacagattaaattgtatatgcatcatgtgtatgctatttctgtctgcacaaatatcatcttgattggattactcaaatgaataaagaatatcaaaccaagaaaaatggagcacgcctatattaccttctcactcaagaggcacagtgcatcattaggtttaagaactagaaggttgtgcacagttccatttttccctgagcaatgattggcaatattttcttttcttgtagtcacaatgattaggcttgtcttttccaacagggggaataacattggttttatctggtcccattctgaggtatctgagaaatcatccagaacaatcaagcttcttttcttttctaaaagcctttccaattgcttagtcaactggtcaagctccatcgatgctagtgatttcttactgctgactctattttctaccagttcttctttcttagaagatccttcatgtagtcgcccagccaagctcctaaggagctctacaagattgaaaggacgcatgattgtgacaaaaacatacttgtcaaacttgtcgctcagctttgggctttgataaacacctccaactagggtggtttttccaaggccacccattccccacacagagatcacctgaacctgctggctattgtcttttaaaattaagtctattatttcagacatttctttctctcgcccaataagttgcgattcctccgaagcaccaacactcgtcctaatgcgagtaagactctttctaaccaccttcttctcatcagcatccatagattgatcatctataatatcaccatgggccactgtatgatcgtttgtacttgtggtggccacatccgagatagacactggcttcattgaatcctctccattttgggaaccctaaacaaaagagagcaatgattaagaacaacttttagccttaaaattttcatggacaatgtttagccttgttttcagtcatgaaagtatacaaaacaataatgataattcctttcattaatttgcagtatagtataaaccttagttttggatcctaatttgaaaaacttatatctgattgttcaataagatatgtattaatttaactttagaagaatgggataagtacactacatttaatccaaaggatgagaggatacatttgctagattagctcattttacaatcatctctctcagatagaggaaataaatttccgaattaaataaactgtgctaattggatatgaaatcaaatactccatatctaaattatttgtgaaataggagcttcaaaattttaattgtgcaaagaggactcgtgctacatttacatacttgtacaattntgtggannaatctgttagccaatctactacctccattatattctctaatcgaggcgatctntgctatccgatatatttcccttcgataccatcctttctactttcattagcattgaccgttcaaccttggaacataggatggattagaattcaaggtcgctggatatgaaggaatgccagcaattgcagtggcagatgagggagattgttttttatgaggcaaaagggaattttttttttgatgggacatatgagggaatcattatgtttttagtcgccgttttttgcatcgttgtcttacttgtaagcctgtattagaccatttatttttctagcatacatatttgttttgacaaatccaaatacatatatttgtggttgtagtcttaaaatgctgagcacatgcattcccaaaaaggcaaatgagagagagaactggagggggcacttgttagttgcattagctcatgtgcttctaatggaatggtaattcccacgcacttcaactggcctacacaactgaattagaaattacctaaggacataactgaattaaaaatgatatcaagcaaattttttcggggaagcgtctggtcttcgaacaaattttgcaaaatgttcagcgcttccaatccagtgcaatgagacggatctccaaactctccatgatgaattgccatgtcaggtcgcttccttcccttgcacatatctaggattgcctctgtccatcttccgcctgaagaaggaagacttgcagccactggttgacaaaatcgcgcgccgtttgccttcttggatgtctcacttgatgacgcctattggccggactaccatggtgaacgctgtactaagctcaattcccatctacctactcatggccatcaatgcaccgaagtgggttatcaaagggattgacaagatccgtcgcagctttctttgggctggaaaagcttctgcaaacggcggcgtctgttgggtcgcatgggctcgagtttgctcgcccaaggagtatggtggtttggggattcctgatctagagaggttgggaatcgccctgaggtcacgatggctctagcagcaaagaacttcaccggaaaagccgtggcaagggcttagtattccggtctcgcagaaggagcgcaatctagtatcgatttccatggtatgcttggtaggggatgggaattcagtgctgttctgggaggattgctagctgcagggttcctccattcggtcgctagcgccggctgtctatgctgcagtccctgctcgtctccggaatcgtcgcacggtggccgaggcaatgactgacagaagatggatccaggacatcagttccgcgttgggtattcaagcgatcctagagtatttcaagctttgggattgccttcggtcagtgcagctttccgaagagccggactctctatcttggcggtgggagacctcaggagaatactcttcccgctcggcttatcgtgttctcttttttggaagaactcgtctccagcacaagccaatttggcaatctttggcgccccctcgctgtcgctacttcctttggttggtagctcttaaccgttgctggacagcagaccgtctccggagtcgtggtttgtcacacctggatcgatgtgttctgtgtgatcaatgcgaagagacgattgatcatctcttggtcgcatgcccggagtcgtggcaactgtggtgggttgtgctcagagctatcgggcattcggagtgcttaccgctcaatgaacactctttcctctcatggttgtgcgactgtctcggtggattcacctttctggcttcacctttttggctctcgtgactgaaaggatgcatcacccttacccatgcatggcatgggaatctgatttgaacagctgggttctcgtaagctgtcctgattattgttgtttggcccatatcaccacttgttccccagaccgctatcactttaaggtcatgatcctccttgttgattagctggacgagatccactctctgattgtcctgttttgcggcacgccttgcatcatcaatgccgaatatggctgcagcaataacgctagattgctcagctgaggtgatggtggccttggagccggagcccttgatgaggtggtaccgcgcatttctctggctgacatcctcgaccttgttcctgagctccttcatctgcttggccacacggcgccgctcgagcagcgtgcgagggaatcgccaccaggatggcttcttcagatgaacagcaaaatcctggaggctgtcctcaacgtcataggcagtgtcacggacttgcttcacccaagtcttgaccactttgctgttatcttgctcctcgtgcgcctccatcatgaaagacctcatcatctcaagctcatctgcaacaaaggtgtggtctttttggataccaagctgcaaggccacctcctcggcaaatgcagattttgcgtagccaagcgctccattcagcacggatttgcccacactcagcgttgttgcctccattgttctgttgctaaagcatcaaaagcaacaagttttaaaataaaaaagaattatcgagaatttgcgtggctgaagctaaagcaactacttttaagaaagaaaataaatgacgagagtgagggagtcagagtaaagaaaaggacttggtgttgcttcctttgatcctttcagatgaccttcgttttccacctataggctgtagcatacagaaagcgtcgcctgcatcgatgaccactccgttcccggcggcccacctccacctccagcaacctaaggcccttttgccccccccccccccccaacaccaacacacacacacacaaaggaataagtccactatccctccctcaacatggccgtgtatgaataccatccctcaaccacaaaaccaggtataacccgtcccccaactccgaaaaccgttgcaaatcaactccccgggtggttttggaggcggttttgctctacgtggcatctttgaccctgttgacttgctgagtcagcaggtgggacccacctgtcagtggcaaggataaaagaaaaatggtggggcccactatcaaccccacttttttt

SEQ ID NO: 59350 - DNA, 6637 bp, Oryza sativa
  unsure (1)..(6637): unsure at all n locations
gatgataaaagttggacacggaaactcatggctacgcttagggctgtttggatgggggactaatctttagtacctgtcacatcagatgtttggacactgattaaacatagactaatgacaaaactcatttcataactctggaataattcgcgagaggaatttgttgagtctaattaatgtaattcactgggagtaccaagcatagacacaggcaaataagggaaagggatgtcttaactgaaaacagagaaagacaaaaaaactaacaacaggctctttcattgccgatcatttacttcgaatggttctgtgattagattttattttgcttccgtggcagataagctcgctatccaggttgatggagagcataaagcgaatggctgtaacttcacccgaaccgcgaacaattcgaggtgaggagtccaaagcgttgcaattgcaacctgggccttctcagccaggggacaggagaccagctgataaggtaaatgaagaaacaaaagcccaaataaatattaataaattgatttattaacatttatataaatatagacaatactagaaattattatattgtaaaacggagggagtagtactgacagacatttacagaatctactgtggattatacttggtaccgaacaatccaaatttttatattggttgacgaacgcatgtagagtttttggttggatgctacaagcaacgccaagtgctacatgctatcatcgagattattaaaggttacatggggagaaagcccccagcactgaaaatggatcaccctccccgattctaggtaaggtttccatactgagcaaactttcaaatctctacatttcatactataagtctttgactattttcttactgaaagtactttaaatttgccctatgtttatagtaaaatataataatacctttaatataaagcaaacattgtatcaaaatatatttgatgctaaatttaacggaactaatttggtatcataaatgttgctaattttttctataactttggtcaaaattaaagaaactttgagttaaaaaaagttaaatgacttacaatatgaattgaaacggaaggtttattttctccgttggaacaaaggtctattttccaaatccatgaaacaggcacatgtatattaatttgttttgttttctctgctggtaaaatacaaaggcttgttaatttccaaatcctgaaaacatgcacatattaattttttgtgttttatttttcctctgttggtacaaaggtttgccgaatgcgcggagctcctaaacgtgtactggctggcggtgattggggagatcgcaacggaggacctgacgccgggtactcgctacgcggtgtacctggtgtacaagctgacgggcacctccgtcggctgagaggtggccagacgcagaggtcatcgctcaggctctacggcgagatcaccgtctccaccggcaaggtcagcgtcgacgtcgtccctgcagcggcgcgcggaatggccgccggcgtggcctatcctgtggccaggggagacggctggatggagctcaagctggccgagtttgctgccgacgagaagctgctcggtgagaagaaggtgatagtggacttccgcgaggagaacgaccatgtcaagaagagtggtcttgttatagagggcatggagttcaggcccaacaagtgaagctcgcaaaaggctcaacattttgttccacaagaacaatttctagtatcctaactattctcagcacataaaatgacaagttttatctctttaatatactttatctatctatcactgttagtattttaataatgatgagatattttgatcatttttactctcaactaatttcaccgtgagataccactacaacaaaacaacccaatcaatggagacatcttatttgtaggttagagacgaaacgtctcccatagataactgggacgctttataacaaaacaacccaatagagacatcttatttgtaggatagagacgttttatttcgtctcccacagataactgggacgcttttataaagcgtcgtagggacgcttttataaagcgtcgtaggaacgtctccgtttgcactgtcgcgtacctatattatttaagacgttgctagagatgtcgcgtacctatattatttaagacgttgctagagacgtgtaaattgcatctctacaaaatatcgagatgcttttatagaagcattaatataggcacgcacatcttaatatatttgatattaacgctttcatctgtgctcgaacacagcacctgcaggttgcaaagttcatgcactaaccaagtcattaacgtgaacaatcttgaaggtaaatagatagtttttcttatattgcaactctgcaaacatgcatactgtagcagatacattaaaaggagaccggagggagtatactcttcttaaatagatagtttttcttatattgtaactctgcaaacatgcgtcctgtagcagatacatctcagcaaaaacaaataaaaattaataggacccgcttgttagcgttggtttttctctccaccttctctgcttctctatccgtgagaggacagagtgctgccagcgagggccagtccaaacaaggagggaaggaagggggctgcacgagctcagctgtcccacacatggtgagtgggcggccggctgccaatggctgggaggatatggtgggcgtaacggggagggcgcagtgggggttggagatggcagtgcactagcgagggggtcgtcagagatagcggggcagcggtgaggtgggctcgaggcagcggctcatcaatcccacgaataggaggtcgagcttgcttgggagacgtctctgcaagctcatggagggcatccaccatctcctccggattggcaaaaaagccaggaggaggtgggaggtggtggaaaggcttccgggtgaccgacgccgatagcagcacaatggtgaggcttggcgcttgtgaagcgagtgcgggagcaaaggaacccgaggagggtgcccctggggtcggcgacagcggctccgtggtggtagagcttgaagcgctcgctgttgaccacgaagaccaccacctctgtcccgggcgccattgccacctatctnactgncaagcgccgnctgcctcgccgaaaaaactgccgccgcagtagctttnttcagccgtcctcacccgtccctcgcgtataccattgtcggccgcgagatgcgagacgtgcgccacctgctgcctctatcggcgcccgtggctctgcttgcacgggctcaagcccctcctgccattgaccgctgtgcaacgctgatagacaccaccgcgctagctcagttcanagagagagagatggaggtgagggaagggaagggacaaaagagagaggatgggatcggaaatcctgtttggcgatcgatcgccctggggatggatcagcgatcgatcccctcccccctccctccctccacccctccacctggtttccttttttgccaccacattactttcctattttagtaaatttatacacctcaagtttacacatctaaagtttagaaaccaaaagtttatatatccgattcaaatttgaatttgaattcaaatattttttatatatagtatttctatacatctaaagtttatacacctaaagtttatagacctaaagtttatagatctaaagtttataagttaaaagtttatatatctgattcaaatttgaatttgaattatacccgattcaaatttgaatttgaattcaaatatccgattcaaatttgaatttgaattcaaatattttctatatatagtatttctatacatctaaagtttatagacccaaagtttagaagttaaaagtttacatacccgattcaaatttgaatttgaattcaaatttttttatatatagtatttctatacataaatttttctaacttctgttttttttaaaaaaatgtggagatgtgtaaacttgaggtgcacaaactttaggtgcataaattgactaaaataggaaagtaatgcggtgccaaaaaaggaaatcaggtggaggaagggagggggaggggtggggagcgaatctgatcgctaccccatccccacggcgatcgattgccgattaggcgtacccggatgggatgaagggaagagatagatggggagagtatgacatgtagggtccaccgaatttttttaaaaaataattgctgactagatttccatgtaggaccaaaaccaccccggtttgaggcagggggttatttatccggatttaagagtttaaggtgctgaatggccggtattgcagctcagggggcaattcgatcgacctcgatagtttatgggggttaattcatactttttgaaaaaggaagtggaaccaaatgagaacaagccgcttgggctgtgttgcttggtcggtgtttgtcacgcccagaaattcccgaatagaattccaagcatagtgtgcattaaaatccctgtccaggactggccggggtacacaaacgacaaagttgacatacagatccacgtcttacatacattataagagtcttatataagtgcagcggaaaaacaaaagataactggagctaagccttgacttgaacggcagcaggaacaccactccacaggcatcctcgacagcacggacgaagcctactactcggagaaaccaccatctgacgcatactcaaactctggggttggggaaaaatagagcaagactgagtactacccactgtactcagcaagtcataccggaaccggggtatgctgcaggatattgccaaaggatagctagagaggttcttttgcataaagcgagcatttataaacaggtgtttaaagcggtaaaacaattgtactaattaatcaatattaaccatccactgttcaacgctacaccacattgcaacaggcccaaccaataacctgaactaatcagttccatcagactacactagggtgagactaatcacggtgaatctggttgaccgcccataaccgtgggcatggctatttgaatagttttactctgatcagaggtgtacaactgtacccacaagacacagccccacgacatgtttccgtgcaccgacatggcaccacgacataccggatagaggccgtgacaggatccttcgcataaccccctctaaccaagcacaccacacctcaggtttcacccccactcatcgcaaggcagcgggtagtcccctctcgtgcctaggtgaatccggaagccgcatagaccgtcgcaggacccatccaaactccatcacgcccacccttgcctggatgcgtcagctagaggaaagctacactacaagcccagccgttgcccacgctggcttgtggtaagtacgataagttcttccagggcatcccgcgaaccggtccttaattgccatgggcgcgaccatcaaaaccatgcacccatagcccaccatgtgattgattttagttaaccaacaccgaagcggtggcactagtccagcattaacattagaacctacagtctatacattagtttgtattccccattgtgtgctagttgaactaagcatggctaagcaatccctagtccaatctctaatcatgtttatatcccaagttatcaaaggagcatggtaccaaaaatagcatggctgtaacagaaggtaaacatcccatagtattattgcaaaacaatgcagtatttgaaggaaaacaatagaccatttgcaatataggatcaatatgttcaagtgacaagcatgacttgccttgctctgctcctggaggaacctcggcgactatttcaaagtacaccggagcatcgggagagccggaatctaagcgacatacaaggcaaacaatacaaacaggctataagactactgaaacagagaacaaaaccattattaatggattctacacatttttcttgatttactgagacttgaatgggcttaaacggagctcggatggattagatatgaattttagaagattcacagtgattttactataaacagaaaaatccttaattgaattattgcacaataaataaatcccggggagagagagaggtggcgccgacatgcgggccccacatggcgatgacacgggtggcaatccgcggtggaccgagtctacggaccggggaagggacggcgcacgacgtggcgccgacgcggcggccacacggcagccacgtgggcggccgaacggacggccccgatctaccatccggtagatcgaacggcgggtacggctcgtggccggtgcgtgtgggcatgtctcaagccggcccggcggccatggcgcgcggcggcgtggcgtgcctgcagcggcgacgcgaggcggcgaccggccggcggcggagggcgacagcgtcacggcgacgcgggcggcggagcagcggctaagcggctaagcggctaagcggcgggtaccggcgcgggagagagagaggaaggggaggagggaccctactgacgatgaccgacgacggcaagcgatggagggcaacggcgttagcggaacgagctccgggatcaactaagaaatcaaaagggaggggttagagagggggagagagaccacggatggctagggtgccggccgaaggcg

SEQ ID NO: 59351 - DNA, 663 bp, Oryza sativa
acaaataatcttgctatgtctatcaaaagttgggccaaattcttttttttttctcaaaagaacgaaatttccactagtgtcacgatcgaaagacgaaataagattgctcatttgagcatccggtccatttcctgatgtgcgtacataaatgctcattcacaattcagtccaatcaatttgtgacctgacaaaattactgaacaataaattcaaacacacaaccacaaaactttgcactacatgataattcatcctggtctataaaatgacacgaagaaagatatattagacgatgaggatggaacaagataaatcgaggaaatgcgcaagcattatggtgttgttgtgtgcatctacagttggagcccataccagaattatcattaaaatgttgaacaagccagaagcccaaaatgcttttccgttcgattacgcttgtaagttcacggttacttgaccgacctcgtacatttaggaagaactactctccgagggtgcttaattttctcatcaggtggtcgtgccgctcgatatggccaataggccaatcgtgtgcccctttcccatggctcccccttcacatgaaaccagatagaatttcaaaaacaattaaaaaataataagttttaaaaggataatagaaaataaaataaaaattaagtt

SEQ ID NO: 59352 - DNA, 9977 bp, Oryza sativa
  unsure (1)..(9977): unsure at all n locations
tacgctttgatctttaatcccggttcataacaccaaccgggactaaaaatcacgtgagctttagtccccgctggtgttactaaccggcgattactgatcatcgcgtagggtcattccccttataaaccgcgactaaaaacgatctgtagcccccgcttttactgcatccgagactgttgcagtacttggtagaccgggcaaagatggtttttctactcctgatttaaatttaattgttatattaatttatgtgagactacacattcattgccatcacaattagtcttttttaaaggagtatagattttgttttggttgtgtgtgtacttcgtgcagaggctggtctaggtgtaaaatggcattctcttaattatttaaaattaaagaaagaattactttagactgattttgcatgtttaggtatctatcttgtgtgcaatttcattgattataacacatcaatggtgaaggacttgaaatgttctgacagatgcaaataatcgagaaattcacttttgaactggaatggtatatatagtttacctaaaaaaataaaactacaaaagaaaataaggaaattataatccatgttttccttattctcaaaatggcatttgtttttttcatgtaacatcaagattactggcctacatccgctcctattatcttatcaattaaatttaaaaatataactagcattgccttcgtatcttgacttatactccctcttaatatatggagtagtttatttttttaaatagatttgaccatttattttattcaaaaagttatatgtaattatcatttattttattatgatttgatttatcatccaatgctctttaagtatgacttgttttttatatttgtaaaaaaaataatttgagcaagatgaaagatgaatggttaaacgtttgtcaaaaagttaacgacgtcatatattaaaaatgggtggaggtagcatatctttagtagcgcgcatgctctccccctctctctctctaacctcaattgacatgagagaataagttaatcctaagccctactttgatcttcctcttgacaaggtaaacaacaccctgagctagagcgctagcgcgttgtttatatatgctcatgcatgcgtgtgcgttgcaccgtgcgcttgcaatgatgccacaaatctccaggatctcaggcgcaacaaattgtaacggctgatatatatgtgtatgatgcatgcatgagcggtagggtcagatgtgagagagaatccgatgataaaacagccatctgatcgaaaggtgatccatggcacattgcagctttgcctttaatttgtcttttcttctgtcaatcacacaccacatttatattatcatgcattaatttcaaatatctgtagttaaaagtcgtctcactacttaaaacacataatatatactcaatctgtatttaaatgcataacattgttgacgctattaataacaatatataacaaaattataatattgtaaaactactatatataaagaaaaattgatctaaccatatgaatttttacattttcaaactaaatatttttatagttttaaaggcaccactgaatatatactcagatgcatatatgcactaaaatttttcatgtaatttttgggggatgatattgtattggatcctattatgaaagatagtgtattggatcctgttccaaaatagcaaaatattatataggtaccaagtacatgttagatactacatagatatcagttggttcctacatggttcagtcttgataaccccaatattagggattcggttccagtgcagtggccactgtgactgcaagttaagcggtcataagagcatcattggatttaaaacagatggcccagatagcactgtagcactgtagcgttttttaataaaatgtacggctctaattttactgtagctcacaatttagattattggatcaataaatagagggttgagattgtgtgcagttgctattgtgccgtcgcaatagcaactacactggatctcaattccaatattaggtttaaggttagttcatgtgataccaagcatgctacccttggtagtaggcatgatatcctctttgtatcaggctaatacatatttagtgtgaagctagatccaagaaaaaaaaaacttattggcatagacgatgagacatttgaataaggacaagatctttgacagtacgggtcatggcgcctcgtgccccagcaccgctgtgctatatataggttgttgtagccacgcttctctgtatctagcccatcgctgatagagtcaagcagtaggggttccgacagccagacatcgtagacaagatcctccatcgccaaggccaatgaccccctatatgagcccctccaccgccgacagtggcggaggtagcgtgggggctacaggtctttagacctcctaccccctaatgaaccattagaggccccattaagacccccccctaaaattaaatccatatatctattacaaagaggctaaaatagactttgtccgagattgttataaggtccaaaaggctgaggagcccctactataattttatcatagctccgccactgaccgccaaggtcaacaacctcctggacgagctcctccaccaccaagccgacgagctcctctgccgtggcaaagtccatcatcaaaccaagagaaagaggaggcttctagcggtgatgtgtgctcggtggacggggatatggccatagacggtgacgagcagtgtgccaaagcgcatgtggaggagtggaggagataccgtgtgagggccactagcatttccgatgatctcactgtttttcttatacttatacttataagctaaattttgaattttaaaacttagttttgaatttgagtttttgggttttttttcatcgtagtttatattacatcatttgcctttgatcgagtcactaagggcacatatataaatgttttacttacaaaatatttttttaataagttatttggataagcatatgagtaagcaaaacaatggggttactagtatgattaattttggccaggcatatgtccaggggcagagagataggagtagggcagctagggttgcaagccctactcctgatcctaaatattcattgattagaaaataaaggaaaaaactatataaattcaactaattgagtccggtttaaaaaaattatggctccgccgctgatatgcctagccttctatagctggtcacataacagccttcattttaaccggacttacgataaacagacgactgaactcctaccaaattttcatgcagtaaatagatgtcaataaggcatgcagtaattaagtagcaatagtagtaatccctccgtcctataatataaggtattttacgtttttgcttgcactgtttgaccacttgtcttattcaaaaaaatttaggaattattatttatttcttttacttactttattatctaaaatactttaaacataactttttattttttatatttgcataaattttttgaataaaatgagtggtcaaatattgtaagaaaaacttaaaatcccttatattatgggacggagggagtccagtacactaccactgcattcactctcacacagtacatatatacttcctcactaagcatacacacacagtacatatcgctggttaattacataaccccagccagccccaacctgaagatgaaaactagttaaagcttgagatgtctacagatgaattaatttattcaattaaaagatgatgaggacagacaaggacaaattccacagtaaaccatttggtgacatcaccctcacgtacccatccatcccccctccttttaaaagcccccctcacacccacaaactcctatccctctctccttaatttacttctccctcctccatttctccttctcgatcctcctccttcggccagccaccaccacgcgcatgcagtgcatggcgcaggagggctccgaggcctccgtcgccagctcgccaccggcgccgccgcccccttcctcctcctcctcctccgccgccgccgcggcctcctggtggcgcgacatgcaccacccgtacggcgccgcgtcggcgccaagctggctgccaccgccatcggccacggcgccgcggtggcctccgacgatggcggcggcgcaccaacaccaccaccaccggacgtcgtcgtctggcgccgaggacgacctgtcggcgtccaacgccaccatcacctccttcaccaacacctccaccaccaaccactccggcctcagcatggactcctccggcgaggccgccgccgccgccgccgcagccgccgccgagagccacctcatctggaaccaagtactcatgtgagtagagtacacgtatatagatgtttatttgcatatatatcatataaaacaattaattacatgtaagtatataaatttgcatattcgaagagggcgtgaaaagaaggcatgcgtccactaccctttgtcccaatgcgtccaaagcgccctcactttgcctagattctaattaatttaaagaataaatttgtgcatgcatctctctctagctaagctagctagctactgacatcaatccctaataaccctgcttaattcccagctagctaggctaataaaaaatgaattaaaaatggaacaagaatatgtgcaagtatattagaagtgaatatatagtatagccaaccaagcaagatagctagtttctagtactagagagatagagagagagagagagagagagagctaaagcaaagcaaagcaaagccaagccaaagaaaggagcttttcaaatagtgtgtgatataggggaggcttacatgtgtgtctaggcatctattatgattctttggctataaggttctctaattatctctctctttctctgatagattttttcctagctagatagataggttctttggaattggaattagcatatgtgagatttcttgcatgggataagatttccccattaaagaactaaacaaagtaaattccatggtgtaatatatgcatgcttgcatggttaattaaattcgtgcctagctatctaggctttaatttggtagaacaaacctctaggtactctagcttagcaatgccaaactagtaggctgattagagataaataattaagtgcagaagcaagcaactactaattgcaaggatttgtttggtacggatcccaaaaaaagtggaaccatatcaacagcatccatgtctccatataacttgcaagtactttaatcccaattcccaaagatgatccctctctttacattctccacatgtgtactagctagctaaccagatactttaatcgattgcctaatgatgcaatggattatcattagcaagcataataatatgcaattatatatatgtgcaactcgatggctagctagcttgttcacttcagctcatatatagctcatctgttcgatgatggccaggggcgccgccggcggcgaggtcgggaggagcatgccggcggtgcacgacgcccacgacgacagcgagaacttcctcgagctgctcaactcgaggacgctcgcgccggagctcttcgccgagccgccggcgtgcgactacctcaagaagatggagtacggcggcggcggcggcggaggagggggaggctggcccnancaccactgcagggcggcggccgcgctggagaagcacctgagctccgccgccgccgctggttacggcggcgcgctggcgcaccaccaccacgccgcgggcgcgccggagcggctcacggccaacctctccgacctggtcagcaactggtccatcgcgccgcccaaccacggccaccacgtcggcggcgccgccgcatgcgataacccagcggtggccgcggccatggcagcagcccacggcggcgggaacgtgaagcagtccggcagcagcttccttgacagcggcgggggcggcggcggcgcgatgctgcagcaggagagcagcagcagcacgggcaccggcggcggcgggcaggacttcctgaggccgatggggcttgccgccgggtcgtcgtcgtacagctccatgctagggctgagcagcaggatgtacggcggcggcggcacggccaccatggacgtgccgtgggggagcagcaatgccggcgcggcgaggagcctgtcggacctgatatcgttcggcggaggcgcgatggccacgccgccgccgccgccaccgtcgtcagcgccggcgaggacgtcgtcggcggactacaagaagcagcaagggcagcaggagatctcgtccccagtacgtaatgtatatatacataatatttctatccaaaatgtattacgccgtcaactttccatataacgtttgcattattgatcttattaaaaatttagtacaaatatataaaatttaagttaagttatagttacattaataaaagaaaatcataccaaaataaataatatttacataatatttttaataagacgaatagttaaacggtataaaaaattcggtgacacgaagggagtaatatatatggttcatcgccagtgatcgagcgatgcacgcactgatgatctgatcatatacgtgttgcattcacacgcaggtgaagacgagcagcagcggcggtggcgggaaggaggggaagaagaagaggtcggaggaggcggcagggtcggaggggagcacgaagaagtccaagcatgaggccacctctcccacctcttctctcaaagtatgcccccatcatttagtatgaatgtgtgtaaaatattaatcattcttaaaattcttcaattataaaaacaagtaatatattataaccaaataaataatacttgcgcaaattttttttaagatgaatgatcaacagtaacatatatgaaaacagggtagcacaatttgttcctagctcttacgcatgttgcactggttgtccttcacgtgcatgagcaaattgcaagttgatcattataattgatcagtcatatatgcaatatacgcaggtcagatgatggggtttaattaatttaatttctgccagaacaaattaatgtgcagtgattaacaaagtgaactctacaaattatttgacctaaaataaatataaatatgatgtttccatcgatcaattatccatcatctaatagtactatcctgtaggacttttctttttgaaaaaaaaagacattaaggcatcgtcaagaacataaattttacatgtatcagaatttccatagaaatctggaaaagaaatcccatgttttgaggagggtattatcctgagaaatcggagtgttgcatgttttcgtagtagtgcaagctcatcgacattgttacctagtagctcataccatgccagcatgctgcaggcctttatttgtataacagtattcctagaaaactctttgcaagttttttgtccccaaaactttcatatatatacttgtgaccatcagatcgctttgaggtttgtgcatgaaggaaaaaaaactgctagaaaaaaaatttcagacatgtcacccgcaagatcctaatgctaaccagccaaaccatagttgaatataggttttatataagttatatcataattatggtgcagttatagtgtaattataattacaattacattgtagttacagtgcacttcaattatactattacatctcagaaaacttgcgacagtttttgtatactctctttgtataatgcccaacgaacagatgaacagcttacttagaagaaaataattaacggttgtcaaatctcctcgcaatgacactcatgcattatacattatatacatccttactgaaaaattagcctgtattgtaaatatacatgtgtaagcaattatctctacgtacagcagtgcagcagtacataaggtgctttttatatagcttttatatatctatcttttaggattgctgatgctgcttggtttaacagtcgcaggtaccaaaagtaaagttaggggacaagatcactgcactgcaacagatagtctcaccatttggaaaggtaaagtccgattccaatatgtacaattcgttgtttttgtggtaatttttacgtataaactaaaatgtggtcaaatgatgcaaaattttacaaatttatactaattattcctatactgatgcaataagtttgaagagaggggggggggaattactcactcctgtacaatatttaatgatctgttgacatacgtacaatttaagaaaaattatatcaattcattacaaattcttgtctgttttttatgtgttcagttaaacttacagattatacataagttacctcaaatatggatcccatctgaggaacctaaaatttacttttttaggtgacctataacatttatatttttatgtttgtgaaatcaatttctttatagtgaagtttgctatttatgatctgtttcagactgacacagcatcggtgctatatgaggcgataaattacattaagtggttgcatgaacaagtgcaggtaaattgcagaaatttttttctatttttatttcttctcaaatgcaatatatacatgtggtcactttttaggtcagtcctcaaacataattgtaaatatttagaaataaccgctcatgattgtcaaaagaaaagggtaaagtcaacttttggctctcaaactcctcttggagtccaattatcccttatacataaaagccaattattgctcacggttaactttcaaaaccaggcaaataacacctcaaaacttgtttcatggtggttttgattgatatgacgatagtttttggtaacacgaactcctattataggtaagttatgttgatgtaaacctaactaagtgacatccacgtcaagaaaacatatatagtaggaatttgcactagcaaaaactaccatcatgtcaaaaagaagaagaagaagaagcaatgcatgtcaatagggtctagctagtactataatgcgttatttgtttgggttttaaagtcgatggtgaaaacaataggtatcattttagggccggtgaaaaatcgacttttaagactcaaaggccaaaagccaaaatttaccagaaaatacttttctttttttgtttttagaaattcctagctatggaatatactgtaaagaatgtggattagatcaatagctgtgtttcccctttttatgttacgagaagaaagaaagtatgggcttagctttgtgtcattgcctacattttaatttggtaatggagaactttacacaacctttttatgacttgtgtaatataatgaatgcaattattgctttgtcaaaaaggatgtttttaagaaaggccccatatatatttgatatttccattggaaaagccgcatctaattaagattatataagatgaattgctgcaccaccaattattgggagacacgtgtcgaacctgcaaagcctagctcagctcatacccttcctagagggcccaggatagccttccttttgttcgtattttgcacaacatgagtgttactagtgctgctgcttttgtgtaatggaattctttgtcatggccccgttacacacaccctttttgcagttcggctctatcagttagttattcattatatgcaacatggaaaagtttctaagaatcagtttgtgcgaccaactatatacaatttaatttgactccttatttcatgcttaattgttgcagttgttgagtgacccatacatgaagtcgagtagtagcaaggtaagctacaaaccttcttaattgtgcactcctccaccaacatataattttaatttaaatacatgtatatgtccacgtcgaatatgtccatcaaacttaatttctagctagctatagaattttgatcacactaagggtcaaattctacatacgctcactccgtcttaaaaagaatgcaatttctgcattcaaattgtacatcagaggggctgcaggaat

SEQ ID NO: 59353 - DNA, 2085 bp, Oryza sativa
cagaggttgacttgagaagtagagggctgtgcttggtgcctgtctcctgcacccctcaagtgtacagagataacaatggcccggactactggacgccaccctatagaagctgcttataccgatgaatttattatatattattggtgttcattgtttattattattaattactgaataatgtgtggtggatataagattaattattagaagaaaaaggatattcatagccaagtaagtttaattaattagagctctatttgtgtacggccacaaattagttgaactttctcaatgtatcttcagctggtttgttgttgatttgtaggtatatatggttcgtgtgatcagcatcgagctattaatcgattgctttcctgtactgatttaaccttttttttttacttcggagttatttgatcaatttaattgagtgatagttaagtgtatatattgtttctttatttgtgcatacgatacagcacaggtggatactagtatgccacacatgattcatggcttcatgcagcgtgatgatatcagtttatttggggcgccctaaaatatgcttcgccactttcagatcatcaaagggataaaattggtgtgtggatgcttgatttggacagtttacggatacgaattatattcacctggaaatgaacttaattactccttccgtttcaggttacaagatgttttgattttggtcaaagtcaaactccttcaaatttaactaagtttacagacaaatatagtaatatttatattaccaaattagttttattaaattaataattaaatatatttttataataaatttatctttggtcgaaaatattactattttttcatataaagttagttaaacttaaagcagtttgactttaaccaaggtcaaaacatcttataatctgaaacagagaaagtagtcatttattttttaaccgagtatggatgcaacaacaatattatctagaaaaaaaatgtggatatggattatcaggagtttgacgcactactaaaacaggatttttttttcatacaaccaaaaacgatcttcgcaaggggtcgaatagcctgcctacatacaagtgtatgtggaaacagcgcagtagccggcctaaccgcatgagtagacccattatcgtaggcgggcctcttaacgtagctgcctacgaagatagattatcgcaggtggccgcattaagaggtccttcttcaataatgagttaattttcatatgcggcctatataactcatggttgtttgggaaaattacgcccgctatctaattttgcattccccgttagttttaatcgaaatttgaaatgctacacacaggatctaaccaagttttcgttcttagcacagcaattagaatctacaataaacaagttttcaatatagaaaacagaaaacatttatatacgtataaacatgtttgtcccatatactacaaacgatcagtgatgtcaaagcttatatgaacagtaatgtgagagaagaatatatgccacgtaaattgtttttttatgtggaggcgagagagtggggagagaaattattgtttgttaattaccaatctatctgacaaagtggcaattatactctctatataactaaatcactataattgtagtatgtacataacttattatacggttatctgtatgtttaagtataacatgaaaatactacatacagcggccctctaaaccattgttcccattgttcatgttgttaactcgtaggcttatcttactctagcctgaattttttaatttttttagagagagggaattcagaatatttccattaacaacacggtagaaggtgagtcgccggcaacaaccaaatcaagcacacgatgtttttttttaaaaaaacaaccacgagatagtggtgacgtttctattgatatagcagggaaaaaaataaagtctatcgtattggagactatagtcaggaaaaaaaaaagacaaacacaccacgcgtctacgtctgatcctattgctaaaacagaacaagcatacaacgctactatgggatgggtattctaaacaatgccactaagcaggaaaacga

SEQ ID NO: 59354 - DNA, 6742 bp, Oryza sativa
taggttcttccctaatattcgtgaagacatgtgcgcgttgcgggtattttgtttttcttctcaccactcatcttcttttatttttgaaacgagacagtagtattagcttgcaggtgcatatatgtgacaatagttgctgaaaatgttgacatttttcttttgcataaaataatttatttatctctgttgatttggcggcacagtttaaaaagtttaatgttccaaaaaatattcatgaccatatatactatttgttttcatttttatatccagggtacattagtatctgtatcaaaaaaaaaagaaaatatatttgtatctgtatccacacaaaaaaatgtgagagcaaataattattctttacatctcttctctaagaagatagctccaaatagaacatttcctagtactacatatctgcttgtttgtttgtccagatttatagtactctgaaatatcctatttggtcctaggtttttatattttaggacggatgtagtatcttgaataaaacaaaacaaaatcactaccttctggagagagatacctcatctcatgaattactggcagcatttatgttcctcgttacgccctttgtatgctccaggtccaggatgttgatccttgttcaaattcatgtattccagtttccagatgggaactgaaattttattatgcagctcttcttgtgaaagctataagcaccgcaaaaattatagctatgatttacaattaatcatgtgtaacaacgtttgtaaaccaccaactatatatcttcactgaatcagtaaacttgtcaactattctataatatcaacaccggctgctgattgtaatatcacttctgccagactttctgatctggagtgaagtcttacttgtcagtctcttacgactcgcatccatagcgtagaaaagaagcacgcaagccaacagaacaatcttcattctttcttgtaaaggtataattaactgacaagactatctgacgatccagtattattgcagcttatgccaagttggataaagaagcatcacttggccttagtgagaagcagaccatggaaacatgacttgccaacataagtgaaagatttgatgttcaagataaaaccatactacgtaccaaatgattttatagtagatttcaccagcaagctgacagtatgatggtccattatattccaaccacggctgaccagacaaaggtaatagcatgtctaatggcaccaaaccatcatatcacagtgctgaaggtttcctagctcgggtcaatgacggtacatatattctgtaacgttgtcaaggataaggagtgatagcctgcgagctcagtcgagcaatatctgaaattcaatttcctcattttggataagacgtatctagtctctgttgttcgctgaggggatcaagatacctcaagtagttgagcattgcactccagaatgtctgcgccaccaaagtcgtgctctccaggatgttttgtcgcctttcgataagatgaactagtgctatcatatatgttctgtcagaaaggcacaaataatgaacaaaggagtactccagtgtcaagggcagagatactgtcgctgctgatattttactaagaccttatccaactccagaaaggcagagaccaactgacaacaacttctggcagaaaatcaccttggatcacttgcagtttccatgaggcagctgtcaacactttgcatttcgcatggagccatgggcattctgaattcctttgcagcacagataacaagttatcagaaatgttcatcggatgataggagggcagtggaatactggaacgaatttctgtcagcattgttgacaaggatgaaggataagttaacagtcccattccatcaatatctgcaggaaattgcatgcaagtctcagttgtagaaagatctaaaggaaatggcctcatttaacatacaaagcaatgaagttttctgcatcttccatagctcccacatgtatttgatcgaaaacactatttagaaaagctaaaactagaggcggacagccaaacaacagcaacagataattatggttatatgactattattgaaaactggtaaaagccataaagaaattggttgaaaactggtcaaagccataaagctgttgcaacgatactatttgcaaaagggaaaaaaataatccatagttttatggatcttataaagtaattttgcctatatgctgtcaatcgagatcaatgaggaaataagtgaactgcacttaaagaaaacaaagtattaataacagaagacattaaagactgaaatatctgggttatcaaaatatagagacacttacacagtattttgtatccatcttgcattatatatcttcaattgattgtctccaatcagtatcatccagtttcagagcccaaaacaaagacaacttcaccttgtgagcatatcaggtgattgagtgaactgtatcagcatctcatttcttaactgactgataagcaagaatattgctttcattttccctgcaggaaaccacagttttatgtagggtaatatcattgttttggtgtctgagaaagccatttgcacttctaagacctcccggcattccatattccccatagcaagttgtcaaatggatgtaagtagctgtgtccggtttcagccccaactcatgcatctgcatgaataaactgaaagctttatccacctccccacaggacgcataaactttgaaggcaacattgcatgcacactgatctattgtcaacacaggcttcatatatttctcgcaaatatttaatgctgcagcatgcatgccagctatcaaaaacaagaaagcgattacagcttgactagaagagctcctgttgtcattatatgctgattgtaactgtgaaacttcctcaggtgcaatctggattttcttcattatagaaaatatcattccaaacgttgaggcatctggcaaaatgttgccttcctgcatttgttgcaccaattctgcacattctcttagcttgcccttggccacaaaacatgccataacagcattgtatgaagcacagtcggatagtaagcctgaattctgcaagtcatgagcaaccctaactgactcattaagcaagcccatgttcttgtacagggatatcatgctagtatatgaaacatcatcggcctgattatttctcctcaaacagtcaaatatttccttaaccttagtgaccatcccaagatttgcataaaggtttagcatggaattagaggcaacaatatcagggccaccatccatgctcttcatccttgaatacaaatcttgcgcttccttccagcaattggctttactgtaggccttgataagagaagttaaaacaatttggttaggagcaattccagattcttccatcaagttgttataatgcaatgcctcctctagttgccctgtctcagcaaatgtatcaatcagcacaccataaacaaccacatttggctcaacacctgaggccttcatttcattgtacagatatatggcttcagataccaaatagttgcgggagagagttgtaatagcagcagcatatgtctcgcactttggtttaaaccctgcatatttcattttacctaacagcttcttagccctctgtggatatccacccgtagcaaacatctgaactaaagagttaaaggtgcactcatctggtgaaataccagactcattcatgtgctcaagtagaggagagactctatcataccgttttgctgcaccataagccttgaccatcacattgtattcaactatgcctcttctcctaactcctctatgagagtagaaaacatgttcggcttcctcccataaacccctctctgcaaaagcatccatgatggcagcaaatgtcttggaagagacctcatcacctctgcaatgtctatcgaagaatgcatttgctttatcaagcaacccctgatcaatatacatcttcatgacaacaggcagagactgttcaggaacacaagtcccagacctcataatccccacaatcacatcttctgcttcatgtaccatctttctctcacataacacccggagaacaatcccatagctcacagtatccgcagataaacccattttcccaatatgatagtagtgcttcaaaactccctcaacatcacccttggatgcaaacaatgtcatcatcacattaaacgtcttaacatctggattagttcccctaactatcatgctagcaaacagtgcctctgcctccttcacattaccacacgacccgaatatgttgatcaatgtattgaaggtacatgtatccgccgcaaccccataatctggcatacccataaacatgtccatcgcatccttgagcttcccggccttcccgtaaagatcaatcatcgtgttatatgtgacagcaagcttcggaattctagcaactccctgaatgccagatgcaccagcatcgtcgacattgccatggcacatctcctcaagcaagaactgcatcggtccacctgaatcgagcgcgctgtagtcaagatcaatgaacccaacctcgaacctgccgttgcaccagttatcgaaaagagtggccgcgtcggagtagcggccgacgtccttgaggatgcggacgaaggtgctcatggaaacctcgtcgggagccacacctcgggcgcgcatgtggcggagcagcaggagggagtcccgcgcatggccggccttggcgagcgcgtcggcgagggcggcgtaggcctggttggtgggcgggggcgcgccctcgcgcgccatccgcgcccacacgcggcggagctcgccccaccggcgcgcgccggcgaggtggcggaggacgacgccgtagtggatggcgctgggcgcgtaccccgggagcgcgcgcatgcggtcgagcaggtcgcgggcgcggcgccagtgccgctgccgcgacagcagcgccgtctgctcgcgcggggacatggtggcgaggtgctcatcggacggatcaaggtcagcagcctctcctgcgccgccgccgccggtcggggtggggacagaggggtggctcctggaggaggacagcgcaggcggagcggggagaaggtggggcaggtggacgcgggaggctgaggggaggagtctggactgtgttgcagagatcgatagctcgccggagacggcgacggcggcggcggcggcggtggtaggagtcaacatggtggtgggggaaaagggaaggagaaggagacaagagaagggaggtttaagtgtgtgggacccacttctcagtggaagaatctaaagttctttttctttttttttgagagagagaggggaaagtggaagaactaaagttatttattctttttttttccttttgttttttctgagagactaacaggcctgacgtgtactactcgctcgttcctattttctgtttgtcacgtagtccgattacaacctcactaataataaatctcaaatggtagaattaatagtacgacatccttttagcatttatatttcttctaaaaaaatattaatagtatcatgtgttaatcctttctttctataaacccaaagctgcctcctcaattcgccacgtcatcaatattatatcagccattcaatctctttcttccatgtacacgtcctcagccatccgatcgtttggctcactttcggtcaaaagcgggcgagatccgaggggacgcaagattagccgatcaagtagctgacgagctcacgaggattaacaaaaatcattagatccaatcagcactagggaggtcgacctgacgtcaggagtcattgcctgaaaccggtcgactgccttttccattacaagaatctgtacggacatgaaattaagttgtgccaagctatttactaccacttttattcacatttaatctcctttcctctcatctcacattctcacttccactcctccctgtcaaagcaccaagccctgtagctaacaggttgcaccttcatatcgctttgccatggaacatcatctgctgccgtatcactgttctcgattacctgacgagacgaggggtttactctatgagctctccgtacaaacatgccaatctaatattttatggtgttcttacttctttctgtttgagattgcagctgaattttctatgttagatgggacaattcagtaaaaaagagtagaagactgaggtaagttggctttgacacttcacattctaattaactaggtgaaaccccgcgcattgctgtgagaatttagtatgataacaattaaaaaaaataacgtgtaagatagctagataacatcagattaagtaaattaatgtggtttatgataatttaaatttaaatagtatgtagaatggtgattcaaacgtaaaaagtaaggtgatatgactttatggaagaagaaaagtagggagatagtttatacagtagattaatcatctaaaggctaaaaacaattgatgtaatatgacttaattagaggaaaaagggagaaagataatttggaccatagattaatcatttaagcactaactaagtgaggatgaactatataggatatcctgaaacataataaagatatacattgaaatattatgtgaattatgttggatgctaatttaacatgtttatatttgaaaagctcttaaattataaaaactataaagatatagcatgtttgcatgatgtttaaatgtgatgattgttagtggatgatgtggcatcgttgtatgtt

SEQ ID NO: 59355 - DNA, 23630 bp, Oryza sativa
agttgtacattggattttgtaccgctttaataggaataatatcaaactttggatttggggagaagtctagtgttatgacactatcaccaagcccagtgtagaacttacccccaactacagtgagaagggccatatatccaatgacgctaccacgatgacgatgaaacctcctagactgatactcatgcttaaaccattgggttcctccgggataacaataccaaattaccgtgtcattaaggcttaggacgagcacgacacagtttatatcggtgggcttacacgatagcaagcaccttgtataattcgttctgaggaatctgtcttgatcgaagggcaagctaattctctgagatgtgaatgggttccacaagaatgtctcatgcgagtctcggtgtaccatgagcagccaaccttgtggtgttatccagtaaaagtgatctttcaaataatccagcttgctattagctagcaattgtttgctagatatgctatagaggagcaaagtgtcatttacctccttaccctcatcattagcagtatcatcatcattatcattactacttgcatcggtttcatcatcatcagtttcctccatagactcttcatcgtcacttgcctcagtaaactcatcttcgtcgctcacatcctcgtcatcaccactttcttcattgtcctggtcgtcgtcgctttcctctagagacatatcatagttgtaatgaaacaataacatcggagctaatttatgatccaacgaagttgaattttcactttcgtttatcccgatctgcatcgtgatttagccaatacgtcgtacgtactccagctacataaaaaaataaaagaattactcaaatgatgatgctgcacaaagaggcggctcgataatttctaaactcttagaactatatgtggagatagtaattaaaagggaccctatacatatcatgcgaagcataacttggatagcaaaagcttataaatatatattcgaaaaagaatagttcgtgtatgggggcttatatatctgaaaataaccagcaaaacatacaagtctccttaaaaaagagagagaaaaaaattaaggaaaaaaaatctaaagtagcttgatataccgtcatcacataataatataataataattgctagtatagtaattaaattaattattctgttgcaaaaagaacataataacatttgctagatacgaacctctttgcgtgcgttcctttaaattgccgattaaacgggcgcaggcacttaaccaggcaggcgctgttcgccgcgtttctgtaaattgcacggctcgaccgctcaatccctcgatgttcatcatataaatacccgcgaccgcgaggccgtgaatccgcctcggatttattcccgcgatccatgcatgcgtcgtttatggtatcggtatagtatccagtgaccgagtccgacgcgaacacacgcaggaccaggcgccgcacgatcgcagcacgtacgtaccctgcgtcagcttcaggcctttcttaaacgtgacggcctggccgtgctgtggcggcgccggtacacgaatcaaactgatcaaagaagaaggtcgagatcgatggatcgagagcccaacgcgatggaggaacgggactggtcgtctctcccgtccgacgtgctcgccgtgatcctggagcgcctgcggtggtcgagccacccgagcttcgcgttgacgtgccggcactggcgctccgccgtgtcgcccttctacccggcgtggatcaccccgctcctgctcagcaccgcccacgtcggcgtcacgaatattcggtactatagcccctattaccacaagaacttcgaggtcggcggcaaagacggcgaccacgcgggcgccaagatttgctgtgccgctgggcgacacctcacgcttgattcgccgagcgcggtactcgatgtcgagcttgtgactgggaacattaataaggttccacatatatataggggtaattttgattttgtcatctacgacgacagggcgcatagaatattcggtatcgacgcggttctcccactcaagattggctatgccaactggaacagcgatgatggcgtgtgggaggactggacattgatggagctcggcatcaatgggccacgactactaccgtcacctgtcaccaacccggttatccattgcggcttgatataccttctaaacgatcaaggagggttggtaatgtatgacccatgcaagcatgatgaagggtttgagtttcttgacaaccccacgagcttcggtttcaaacactacaatagctacctggttgagtctgatcagcatgagctgatggccgtcctccttggccgacgcgggacactgaaccatgtcatcaagcttaacgaaaagaagatggagtgggagaaggtggagagtttgcaaggacggacgttgttcaccggcacactcacatcgatggtgaagaagaccaagtttaagtggatggaggatagagtgttcctcccggtgttctacaaatggcctgacaccatccatgctgaccttatttctcgtgatgatgaattagcctttgtataaaaaaatcatcgtcgtttgacacgggtaatcccaatgtggtgaatcacaataatggcgcatgttgcgaaaaatgtgtagacgtgtggtcgtacaaattgggtcaacaagaagaacccagagaaaattggggagccgagagggtggactacggtgtgtggattgaccttcactagtgtcaattgagctacctaccaacttatagagtactcattctactttttaatagatatctccgttgatttttttacgtaacgtttgatcattcgtcttattcagaaaatatatataaatatcttttgttttcttataatttatcactaaataaattttaagtacgactcatagtttagcatatttacactgtttttttaaataagacaattggtcaaacattattttaaaagttattaacggtgtcatctacttaaaaacggaggtagcatcatgcatgtatctacgaccctttttttattataaagtcatgagtagcagcttaagaacctcatcttcaacatcaatacaaaattttagacccaaaaaaattgtaggaggcaatcttttcgttaacactcattcagtagtaattcaggctcacaaaattagcctgaactaactcaaagggaatcgcttgcggctacaaccttgctgatcgcactgaccaccatgaaccagcaaagacgctagaaacaacttgattgctattgtgtaggatccaaaatcatgaaataccatatttacaaagttcatacatatggtaaaaaaaatggtatacacttatagcaaggttaatagtatagcccactactagctccgaatcatctaatgccaatgtaatagccaattcatacaatagttgcttactatactattaatacatggttccacctgtcatacacatattacgttttggagtccgtgctgcagctggctacagatctgtagccccttgcttttctctcgctttctttatttctttaaaatatgtttatagctggcttatagcctgctattgtacctgctcttacagtggcagtagttgcaacgacgacatgccaggaacgccgcctgcctcatcattgtgaaggcaaacaattctgtcaatataatgcaaaatctttcttaccaaggcgaaagtttcgcgatgcatcatgcggatttgtgtttctctttgggggggagggggtggagggaggtgacgcgcacttcctccgttagttcacgctaatgacagtaattagaaaaaattgtgaagatttttttggggagttttttttactaatggattgaaaattttttaagttggatttgaaaactttcgacttaagatttaaattttaaagtcaaattttgaaaacttccaactcagattcgaaaactttcaagtctagatttaaagattttgaaaaattttcaacttgaaattcgaaaattttcaactcgagatttgaaaacttccatgtccagatttgaaaattttgaaaatttcaacttgagattcgaaaatttttaactcgagatttgaaaactttcaactcaagattcaaaaactttcaagtccagatttgaaaactttcaacttgagaactcgagatttgaaaactttcaagtccaaatttaaaaatttttaagttcagatttaaaaattactagtaaactaatcactagtaaaaataggaaactaatcactagtaaaactaattacgaatttttcttctacccatacggcatcaaactgcgaaaaaagcaaaaaaaaagaaaagaaaaaaagaaacggcggtaggttagcgaaaataaaaagtatcgtgcgcgcgtgcgtgggccgtgtgagccgggaatgcgcgccagcagtgcgcgcgcgaattagcattctcgttctctgggagcgtcttccaccaaatcccacaacatgagcagctcagaaatatgtcctagatataaaccatccgtgagcatcactctcaagttttactattttatctctctcacatcctcgaatgttttgccgttgacgagagaattttggggagatgagaaaatacgtaagcatcactctcaagttttactactttatctctctcacgtcatcgaatgttttgccgttgacgagagaattttggggagatgagaaagtggattatagtagagttgtcgccatcccgtgcgttgcacgggttattattattattattattattattattattattattattattattattattattattattattattattattattattattattattattaaaaatttttacgttaaatatgttggttattcatagcggcttataataaaaaaaatttcatgtcatttacaactttctgattattaattttagaattaaattaatatgggaagctaaattgagaatccaagatgggttctccgtatttattaattcaaaatcatttacgaattatggggtttaggataaaaatgtcacttataatttacaattatcaatttggaatttcaaaattaaattgataaagtccaaatagatacaattctgtatctctattgattcttagttttagagaaaaaaaaaacaaatcctgaatagtccttggtatcgcccatgccatgttctatctaacacaaattctcaatataatatactttcgcaataatacttttaaaatatccaatgacatgaatagcaataatatgccatgggctgtatacagtacgcataaggataatatggacaacacatttgaaaattagttattagttgttagttttctttcagaaagatatagatcaatatatattctttgtttacagattaagatcaaataaataatccaaattttatagtgagcatgagatttatgccgttaatcaacctgatttctttgacaatgtacttatgagttatgagaaaacagatattgaattgatataagattagcagcataatttattatttcaatcaaaataaagcaaattcatggatgtcttgaattaggcaaatagaacatgcatgtttggcataatacatccgagaatgtgttgaaattaatagaagatgcaaattcagctgtacatgtgtagattacagatgaggtgatcaaccatagatgaatctctttctgttcatcggactcaactgtcagacataaatattaatattagtgctacttccatttttatttttaatagatgacgtcgttaactttagaaataacatctgactacttgttttattaaaaaatagtgtaaatatgctgaagtgtgagtcagatttaaagtatatttaattaaaaacatacctcaacaaaataagaaacatcatataattttaaatgagatatatattttttataggaaaaatagtcaaatgtcatgtcaaaagttagtggtatcactatctattatatactaaaagtccattaaacttcctacaaacgcttctaaacctctacgtagcactcctataaatgctcctataccgccacgtggcactttaatttaaactggtggacctaatattttaaacaattaaattaataatttccaccattaaatattatcttcaagaaaaaaatcggcacgttcccctctctgttcacaagttcaggtaatatacgttccgaaagaaaagaggaaatacgtgcgcatgtatgtacttactcccctcccacaccctctaccctccccatccgtgtctctcctatttatttcctattttttagccaacaaccaaatacatacatagaaattgtttatatacagatcgatatattaattaatacgacatgaattatctattattattatatagtaaaagtctattaaaagtaatacaaacgctctcaagctgtgacgacgctcttataaattaaagtaaatataagaaattctgagaaaaaaaatcatcttacccaaacctatcgaccttatccgtcagagtgcgtatgaacaacacatgtatatagttgcctcctcaccgatgagacgaacccactggctctcgcctcatttttttccttacaacaattaatttaaccaccgaataaaagaagattctaaaaattacctaaaaaaatatccaccttaattttttaataaaattggtggattaattacttcataccattagacatctaacaactttctaccaacttaattatatttcttaacttgtatacgaggtctgtttacctatacaaatatgtaaagctaaatcaatgtacaaaggtacaaataaatccgtctatgaatgaagctcttttttattactatatatctccgtcctataatggatcctaacattttataagaattaaggaggaacgaaaaatactaagatacccattattaaataaggctcattaaataagggtatgtagagagttagaagatggttagagtaatgttggataaaaattaaatgaagaatggctggagtagtattaaaaatcccttatattttaggttaaaatttgaatccttcgatttatggatggaggtagtagtacgtgactatgtctttaattagataaaaaagtcatattatcatatttttaatagaaaattccttaaattaatatatcctaaaatatacagagacatatttagtatacaagaaaaaaaatataacttaaaagtttaaattaagattctaaatattttaaaaaagaaacacatgtagtagaaaatgatagtttcatatgaaccagctccattgttgtgacatatttttctcataaatttaagatgacatgtgtaaataattttagtttataatttgtagctactttagtttaaaatagtcaacctaaaaataatatggttggaggggcaatgccttattagctacactcttgcttaactagcaagatgaaactactcaagtgcacataatgctgtttatggacaacacatgttacatcctttaaattaaaaaaaaacatagaccacatcctaattacactaggatgtcacatacaccccctcaaaagacccgacatctccgtcggtctaacttacttgcatagtcgctgtaacagcccaccctccagaaccacgtagctaagcccaaccaccaggtgggctcacttacacataccagtccacttacactttcgttatcgcttcgtgaaaaagggttaactcaggagtgacatagttggagggatgaggctataaaagggttaactcaggagtaatatagttggagggatgaggccttataagttggttatactcttgctaaactaggagggtgatactaaatatatgcacacagctttcatgggccatagttactgtaacagcctgctctctagaaccacgtagctatgcccaaccaacgggtgggctcacatacacaccagtccacttacaatagtccagtgatcaaaaccaactttcaaaacaatcctaaaaatgttattaataaacaaagatttagaagagcaaaaaaaaattttttaaaaaaatcctatacataaacattcgtcacaaattttcaaacaccactaaaaaaggtgcccgcgcatctgcgcgggctaccttcctagtttagaaaacagaggtagtagttaatttctttttccgcataaagccctcatcgaccaagaaaaaaatggagggagcattaaaatgaaggttaattgattgtgcattagtcgtcgctgcgtagacacatctccttccttagcctgtattacatacaaccattagatgatgccgtgagaatcatgtgtgactgaccatacaaatttcatcgtatgcactcagaataaatcagtagtgaaaatagatgacacaggacatgcataattgatcgatcggttcatgcaaaattgatgggtacctgcatcttacttagaatacagatgcaagggtggaggattctgacgatagaagattgcatgcacggcaacggatgcgcaagcgttattttttatttgacgaccaacatcttgatttatgacctatcaaatttagaggttcagacgatggcaaatctcaacccaaaaggttttgtattgtttgggatgcatgagaaacctatctggattgaggaaaaacattacctggaagagatctgaaggtcatcacttgtgtgccatagagttttttccatggctttgaaacttcaacaaatttcgcttgcactgatgcctccagttggagtccagatcgaccatcttgtgtcgttcgtcaccgctgccattgctgcaggagacaaccctgtttctctctatccctggtgctggagataactattcgtaatagatagaataaaataacctccttgctcgatcattagatgggctttaacgtggcccatcagaattgctatgcgtagctaaattattttttacatcaatggttactataccatgatttatctaatcaacggttggatttttctggttaacgtgagagctcgtaggaagtgtccaattagtataaatatagatagacggatagatagatagatagatagatagatagatagattggccttaagtaatcaatttcgttaattagtactccccaattgatctgcattcgaatttcagatgaaatgagagaatcatgcatgtatgtatgtacgaccctatagctcttttatcacatcagggccggctccattttattaccttagcgattgctgactctgattgtcttggcgctagaggacctcctatgagaacaattatagcgctaaccacacaacgcgaggcgaatcagctatatcgggtactcacatggtcataggtcacaattgcgtgagtgcctatatatagcgcctaatcacgccgccgttggtcgttcgggtacacgtaccgccgtcacgcctctcatcaatcgcggaaacggtagtatagtactacgcacgttcagcgcagccgcctctagcttcactctccgaagcacacagacacctagcctgcacgtacggttacacgccacggcttacgtgacggccaggagcgcatgcgatagccggccgcgcgcacctagcactagtatacttcccaagcatatttttttcaaatacttttatatagaaatttattttaaaaacatcaaataaacacatttgtaattttgtaatttttaatatttaactagtatatatttcctgtttagcgtgcgaagtaacaaggcctaaacgagctttaaagagagcctaaaaagctccaaactcaaactggatttattaatttgtcgtgcgtaccttctgcgaaaatcctcctactcaccgattcacgccgaaaagatcggaccaccttttgcatgcatactcctatctattgttgtgcactttatgcatgtagctgtcgcctactagcctaccttcctttatctatccttcccatagataatgggttctttaataagtttcaaactattttttcacttaaattattattttgatctatgatccgattacaccattaaatttattataattaaatatttataacaagatcatacttgatcatattatgatgaaaaacaatagctttattaatgttgcacgtgtttttctttaaatgtttcaaccaataatctgtgatgtcacagtggcgctctcccatcgcctttcctcctcccctttgacagcggccgagtgggcctctccgcctccttcacggatccaccactgactggcctcgagaggggtggatccggccatggttggcgggaggcgtggcagcgacgggtccaatgggggggaggtgctcggcggcggtgagaagtgcagcggtggcggatcccactatggggaatggggcagcaatggatccagtggggaggcacatcggtgtcggatcctgctcgccctcccgcgcggcaatggcaatgataacgagccaccggggtgatgggagggacagacccaactcccccttcctctcccgcatggatcctgccgccctcttcctcgcacgacgaccaggaggaggatgatgagaacggtggcggtggctttgagcgatgatgaggacggcggcatcaacttcgagcaacgacataagcacccacatgcaaaatctaatttatggttttgggatttatggatttttattttttccttttcgcgtgcggacaatatatgcacccacaagcaaaatcttattttcgcatgtgggtgcgccacccacatgtaaaaatcactattttcgcaaaccttcttggtcagactggcagcctaaccgcacgaaaaaaatatgttttgaccccatgaaaaatgctttctatattagctagtgttatttattctagtgtcttccattttagtttccgataacagaagtacatgttggggtccttcctcttccggagatccagaaagagttgccaacaaagcacgcgtttgtaacgtacacccaactttcttgccatatgcatcttagttgtaccatgtgcaagctatatatgtatattttgtaatacaactatgcgagaatgcatatgcatgcagaaacggacctgagcaagtcagacgttggcgcattaatcgtccctggcatacactagctcaatacattccattttccaaaaaaaaaaaaagtcatcccttcctcatgaatgcatgaggcgctgcatttgaactggtcatttgcttcttgatcaatataatttgctagatcacaaaaaataaaatagcatattcagtttttaattatctgcaagtgatcacacaaaattacatccatctgtatttatatgtttgtatctatctagctctatctactgattgggcactttttaggtaactctcacattataatcgaaagatatgacgattgattgggtggattgtattgtaataaccatagatcgtattatataactaaactagtagcgtgtccgtgctaacgccacagcaaaattttgtactgccagcaaatccctagctgaatttcaccgaattaattaacatttttctctcacatatatgagagggattggacatctctgaattttattgccaccatttgtttatctgttcacattattttcttgtgatcagtgcatcagaccttgttttagacaaaagtctttcgcccagctttaggccgagttcagttccaaactttttcttcaaacttccaactttttcatcacatcaaaactttcatacacacacaaactaataacttttccgtcacattgttccaatttcaaccaaactttcaattttggcgtcaacacacccttactaaaagcatacgagtatgatacacgttttgctggagtttcaagcttaacttgcagcagcatgggacaaaggcaaagctgctagctcagcagataggcagaacaagccagtctgagctaagcagcaaccaaatgccaagctgctaaaacaacagaaccaaagctatatctctagagaacggttcatctcgagctatctcaaaagggaacggtccatttcggcacaaaaatgacagcaacagacatcaaacagttgcagaactaccgaatacttatagctagctggaaaactgaactccacggtctcccatcttcttgatcattagttgagacttgatcctcatctcgtgaattttgacaagcagcaatccctttaaagcatccaagtaccctgccagcttcgaaggaatcaaaggtctccactgttgcaaaagggaaacaactctacaaggcaaatgcaacatatctgaaagcaattttttttaacacccaatcatttcgggttagcgaaatggcccatgttcctgcagagaacaaatacaagaaggtaatattctgattttgtttccaggctattgcagcatggacatgaccttaactctagaatttgggattctatcccggtgcacatctctaaaatagcaacctcaggaattttgctggagcacatttgaacattaagtgatcaggctatattgcataatatatttcttgtgatctgcgagtttgttggtaaaaatttctttgatgtgatttaaccacaaacgctgatgtgcagagataaagacataggtaataaggatattgacataccagcttcagatattgtgctgcattttcttgaaccaatccatacatcagttttgcacacctaggccgtcccaaattggcatttcctcaagcaggatgccagcgagaaaacatatgcaggtacctgcatacctgggcatgcttgatgtgggtggtagtcttgtcccaggtgctctgtacaacagagtttggaggatggagttgtcgagctgtgaagtccatgaagatagaggttccagatttggtctgtatagaaggattcatctcaacacagtgcaaattaggagagaaaaatacatcatgacagattacctgttcaagtggggaggtagtgtccgttgtgttcaggtagaaggcacgactggcttcgtcaatggcatgccatcaagaactgacacttgatgtgatactccgtagatcttaagtggaaaataaatagctagaaggatgcaaaggtcatctctcacaattccttattgaagcgtacattgaatgggaaatgcaatctgaatcatatttttctatacagtgcactccaagtaagaggtgaaactgtaagtaaagaaatttgctgccaaagcattatactcgtacataataataacaaatggccttgttttctcataactgcaaaacagatttaatctaaagaaaaatacagaaatcaaagatcttccattcctgttttgtaagctgaatttgagactatttgagttttccctcgggagaaaatgcaagcatacctacaaatcaacaatcatgaaaatgaattaagattagcatatgaatttattatattatgcttaaacacaatcatattcagtcgtaaatctttatctgacttttacttacatgcacaaatactccaattgataggatgattaatccaagatgctactgtactattgccacatgcttctctacatgggtcataaactcctaacacaagcgtacgacatggattaataatattctcaaattcttggttagaatccatctgtgccactaaagttacaaaataaaagctctgcattactgaccatcacccattttgacaaaagaagccttcccatgctgaacaactgaatttgggaaataataccaaggaatagtaaacaaacaaaatggacctgcataatctttttacttgcaaacatgggtgggaacatactttgacctgatctgttggagcgctagctagtgacatgtctaattgctcacatccaaacagtaagttacttttatatcatccaaggaaaaaggaatttcctactgcatcataagattttatctactaaacttatgaaccaaaacagcacaagattctacatgcattcatgtaaacagtcaggcaatggatgaatcggggaaaaaaatggagggtgtagacaaatatcgagctgtcaattcattcatataaataattatgatgcaagacatcagatcggtagataaaataaggtacacctatcatcgaaggatttttttttgccaggccatttcaacatccttacagataaaatgggattagaggattttttttctcttctgttttttgggtttgcactgaattttgtgtgggtgtgtgaaagtgcaattttactgcattagtacaggatatttattaaaaaaaaggctttaaattgtgttttatatttcaccgggcactttgtgttttgtatgaaaggtgctcttacctgaaaaattatatgaagagtgattgactgtaatagtattttggaatttcacaacacatatgtcaaccgttaaaaaaaactcacttgatattgttaatgatgttggaagtcagtaactatggaagtccaaagctgaaatattgccaattctttacaaatgcactactaatatagctatgtggagctggagatatgccctacacgttttgaaacacagaaaccatgcagttggttcaaacactgtagcatctaggaacaataatcataaacaaatactgcctgacaataacatagaaacgctgccaatcatgtgcaattaaatatgttctcatcaaggcatttcatcgagcagtacgagtgcattggaacgaagaatacctgtccagagcgagtgttgtgagcaggatgtgccacggcgtcggtcgggcggtgcgaatcggcggccgacggtgaggggagggatgacgtcggcggcggccctcgtcgacggagtctagcggcacgatgagccagcggttagaggaatcggcgggcggcgaaggtcaggggagggatgacgtcggggcagcgagggcggcggcggcggggtgtaggcgtgtcatccgacgatggcgaggggagggatgacgtcggcggtgaagctagtcgacgggtgtcgggcggtgcgagggggcggtggttagggttccggcgatggtgaggggagggacgaagtcggcaccggggaggtgacgaagttggtggaggcgggtgatgaatcccgaggtcgggcggcgagggcggcggaggtggggttggggcagcgagggcggcggatgtggggtggcggcggcgatacgagaaagaggaaaggaggagcgaaaggagagagcaggcgagcgaaaggaggagcgcggcgatacgagatgagaggaggagcgtggatcgttggatgcaatgggaggatccttcgagcaatcttagcctttagtagtagagataatatagatttaaaatttgctccctctcagtcccaaaattactataatacctacgattcagctaataaactatcaggaaagaaaaataatatttagatgttcctcattaaagaaagggtgattagaagtgtgggagggtggttggggtaattaagatgaaaataaatttaaataagatgtggttaaagagaaaaagagttgacaggtgcaacccgcctcaaagaatagaaaaaaccattctagccctagcttctttttttaagtccgatatcaatgaaacaaatcaactttttagttaattcagtgaatcttataaaaatccttctacaaaagtgcacctattaggttgggacgaaatatgaatattaggatagccctttatttaggatgtagggtgtatttaggatgaagcaagctagcttaagacgaggtcaagaaaatgtccatttcaaattaagtactcctataaggacaatgcacctgcaaaagaattttacacacttgtgggtataacaaaaagatgaattaattagctatacacatgcaggaatacaactccgagtgacacagctaggggaaatattgtcttccatgaatcaattgtgttacataactaatgttcttgctgagagtcaggagaaagcaagtatgctggtggatcacttaatcagggcatgcaccagaaaagaaagatgttgctattaaccaagatgtacctgttatatattgaagattcagattcttcaactgttgagcactcaccgaaacattctattgcaaaagataatcccaaaagaaatactagacctcctcgaaaatatattgaagaagcgaacatagttgcttatgctttgagtgtggtagaagaaattaaaggtaatgcagaaccttctatatattctgaggctattgtttctaatgattgcaatagatggataattgtgatgtatgatgagatggaatcatttgaaaagaatcgtacttggaaattggtgaaattgtcaaagtagaagaaacctatccgttgcaagtggatattcaagaaaggaaggtatatctccaagtgatgaggcaggacaaaaagcaaggttagttgctaaaagttataactagatttcaagtattgatttcaataatgtttttcccctatcgtgaagcatagttcaattcacatattactcagtattgttgcaatgcattattttgaactaaagcaaatggatgttaaaactgcattttacatggggagttagaagaggacatttatagggatcaacctgaaggttttgttgttcgtgaaaaagataacctagtatgtaggttgaagaaatctctttatgggttgaagtagtcacctagtcagtggcataagagatttgactctgtcatgctttttcagaagtttaaaatattcaattttgatagttgtgtttatctcaaagttgttcatagttcaactaaatatttgcttatttatgtcgataatatgttgattgctgcaaaagataaattagatatagcaaaattgaaggtacaattgagtagtcaatttgagatgaatgatttgggtgcagcgaagaaaattctagatatgaaaattactagagaaagacagtctgacaagttatatcttagtcataaaggttatattgaaaagttcttcatcgtttcaatatgcatgacgcaaaaccagtcagtacgcctttagctacacatttcatattatctttagatttatatccataatcaggtcgtgatgttgagtacttgtctagagttccatacttaagtgcagttggttcagttatgtatgccatggtatgttctcatcctgacttatcatatgtattgagtgttgttaatagatatatggctaattctggcaaagtgcattggaaagttgttcagtgaatcttcagatacctacttggtacttctagtactttgttcaatgaatcttcagatacctacgtcgtacttctagtgcttgtttgtagtttgggagatctagagatgggcttgttggttatgtggattcagattttgctgcagatttggacagaataagatcgctcataggttatgttttcactattggaggatgtggtgttagttggaaggcaagtttgcaagcaactgttgccttatctactattgaagcaaaatatataactatttctgaagattgtaaagaagctatttgtcttagaggtttgtacactgagcgttgtggagttatgtcttgggttgatatattttgtgatagtcatgagatattactttatttgaggtgtgattgctgaaggtgatgtcaaaatatgcaagataaatattcatgatatcctagctaatatgatgacaaagccagatcccgctacgtactaagtttgagctttgctcaagctaggttgatgttacagtatagtcctagaaactatttggcatgcgttgattttacctacataaggtattttgggtgattgatgattgatttttatgctacaagaggaaatttgttttaaggtggagattgttaaatatgtgatctgaattttaggcatacaatatattcggattcctaataggacttcacgtcttttcctattacgtgtcttttttatctcctatatatactcatgtaaaccgtatgagaaggggtgacatttcaattgtttttctcttatatttgtaatcaactcctcaatagtgatcattgccggtcggcgcccgtggctttttcccgtaagtgtttttcacgtaaaatttgtatctccattatgcatctttttaatttcataataaaataaaacatcttatgaaaactatttcatcccaacttatcctcgttaagtgaaacaataaacacatttgccaattattctatcacgaatatcacacgtgaagactaggtgaagtcaactgtcagcctgcgttaccaatagcacataatatatgatgaaatgcaagttgcaaaagaatctcacagatgcaactagcaaaacgactaactggtttccatgcatgtcggactaggacaacgggatcagctgtactcgcgtgatgctaattattgaaaggcaaagcgctccgaaatctcatatataagttatccgtgtgccatgcgatctggtaccattcgccccagacaccacatttcttggtacatagctagctaggatacactagttgccggaggatcgaggtcggtcgatcgccggctcgatcgttgagctcccttggttctctttcttgtagtggattagtggcgttcgcgaagaacccaaatacccaatggggactgaacctgatccaatccaacaagattcgcctgcacctccacgtccgaccccggcacctcaagctacgcctccacctgctattccagaatccggaccaccgccacctcctgcaccagacatgccacctccacctccgaccccggcacctcaatcttcgcctgcaccgccacctgcaccagacatgacacctccacctggacctggtccggcagcagcaccttcgccacattctcctagtcctagcaacgcaccttgggtcgcacctgcggcggatattccgcccccgcccccgccaccgccaaatccacttccggtcattatagctgtaacagtcccggtgtgcatattatttatggccatccttctctacgtatacgtcaagtgccgcagaaaaaggatggcccttagcacgaagcatcaacatatcaaagccgccgccacacacgagagcgagcctaacgagcttcgtgacgctgaagccggtgcgctcgagccagtggcgtcgtccgccggaccaaaccacggtaaagagtacggcggcgacccagcagccgccgccggaccaaggcagtacgaatatggcgagcgagtggtgtccgacggcccgaggcacggtgcagcgtacaacgagctcgttgccgctggaccgaggctgtacgagtacggcgagctcgcggccgcgacgcgtgatttcgcggaggaggagaagctcggccggggcgggtttggcagcgtctaccagggccgcctcgccggcggcgtcgaggtggccatcaagaagttctcgtcggactcgtcgtcgcagggcaggaagcagttcgaggccgaggtgaagatcatcagttccctgaggcatcgcaacctcgtgcgcttgttaggctggtgcgatagctccatggggctcttgctcgtgtacgaacttgtccagcacggtagcctagacaagcatatctacaacgccgacaagccattaacatggtcagagaggtatgcatgccacacaagatctccttaatttgaccatagagatctaggttgatcgatgatctctttggtatgttatacagatcatgcatgcataatcattggttttgtcgatatatatatataggtataagatcattcttgggttaggatcggcactacgctaccttcacgaagagtgggagcaatgcgtcgtgcacggcgacatcaagccaagcaacatcatgctcgactcgtcatacaacaccaagctaggtgacttcgggttggcaaggctcgtcgaccacgacaagggatggcagacgaccaaggccgtgctcggcactgccgggtacatagacccagagttcatcaccacgcgccggccgagcgttcagtccgacatctacagcttcggcatcgtcctcctcgagatcgtctccggccggccaccggttctcttgcaggaaggcgcgccgccgttcatgctgctgaagtgggtgtggagcctgtacggccgaaacgcgatcctggacgcggcggacgagcgcctctgggccgccggtggcggcaaagaggacgacgcgcggcagatggagcgcgttttgatcgtcgggctgtggtgcacacagcctgacatggcggatcgtccgtccattccacaggctatgcacgtcctgcagtccgatgacgcgaagctgccggatctctggccgcagatgtacatggcctcgccgtcgccggcgaagaacttcgcgatgggcgagtaccgtctctccggcgtctcgtccttcacgagcagcggcgtcccctcgtcggctaccagtggcacgacacggtcgtctggctcgtttgcgtactgattccccggccgattcgtggaatataacctgcttcgtcgacctcctggttatcgatctcgtaaaatgtgatgtactgtacgtcgtaccatgcttgcatgcatgatgtctgaggatctgtgtctcggtctctcggagatggtcgatctctctcttgtcatattgtatcaaccgtatgtgtcgtgtgttgcggtgtgagtgtggtgtgattcgattttatatttcggaaatgctatatttctggcaaagtttttccaattgatttctttcacatctttcaccagcccatcacgccgagattctcgcactaggcaggctgggacccgtgacggacacgcccgacggcttcttgttgttctgctgaaatgggtgtggaacctgtacggccggagcagtatccttgacgcagtcgacccgcggctgaggggcgacgacgatgacgaggagcacagcgatctttggcagatagagcgcgtgctggtcgtcggcctctggtgcgcgcaccctgaccggagcgagcggccgtccatcgcaccgacgacgtgacgctgctgcgcgccggcgctgccgcggcagttgtacagggccgtgccacagctcgcaatcactggacgtgcgtacgggtctcgatcggttgacgccttgacggctccgccggcgccgtcgttcccatcttcggagaccaccgatgggaccgcactgtcttccgactagctagccggcatctcgttgctggaaaaatcgatgtgtatttatagcttaatctccatttttctcatcctttttaaagatccaaatatatctgttttctactagaggagaatggatgttcataaatgtttaatgtactcagtttcggaggacggcagctaatttagctcagagcctgagattactggtgaagcaacttaattttcttgagaaatatctgctttatccataagagtacaagccaaatcccttctcttctttcaataaaaaaaaactttttctggaaaaatgctaatacaagattccacaagctattttaaccggctggaaattttcaagggtgagcaatgtcgaatgtattccctacgtttcaggttataagacgttttgattttggtcaaagtcaaatcgctttaagtttaactaagtttataaataaaaatagtaacattttcaacccaacataaatctattatattattaaaagaatagaaaaacgagcctccacgttcgctctcatggcctagaaattctcacattaatcggtgaaaaagaaaaagcagagtccatatagaaatacaatttagaaatagctgaaattcggaattaaaaaataaggaatattagaaaaggagactagagtccatatagaaatacaatttagaaatagttgaaattcggaattaaaaaataaggaatattagaagaggagggtagagtccatatagaaatacaattaggaaataactgaaattcagaattataaataaggaatattagaagtagagtatagagtccatatagaaatacaattaggaaataactgaaattcagaattaaaataagaaatattagaagtagagtatagagtccatatataaatataattaggaaatgactaaaattcggaattaaaaataagaaatattagaagtagagtatagagacattatagaaataaaattaagaaaaaaatagaaattcggaattaaaaaataaggaatattagaagtagagtatagagtccatatagaaatttaaaactaactaaaatttagaataaacataataaaattaaaagtagagtttagagtctgtataaaaatataatttacaaataactaaaattcgaaattaagaaaaacatgggaagaagagtttaaagtcaatataggaatacaatttagaagtaactgaaattcgaaattaaaaattaaagaatattgaaagatgagtttagagtccacatagaaatacaattagaaataataaaaattcataaataaaaataaataatattgaaagaagagcatagagtctatatagaaatacaatttacagaaaattaactaaaatttgatattaaaaataattaataactaacatgtatataaaatacaatatgaatattacacattagtagttttataaagttattgcaaaatttagaatcatgttgtcattttaatatatttgaataatacaataagaaaacatatatgctattatataagagaaaatataatgatgctagccgcgcaatctgtgcgggccaccatgctagtttattatgaaaacatattcaattattgatttgatgacactaatttagtattataaatattactatatttgtctataaacttagtcaaacttgaaacaatttaactttgaccaaagtcaaaacatcttataacctgaaacagaggaagtacatatcatgacacgtttagatttcactcagtctggactccaccatattataataagggcaaaatttgctacatgatactcaagagatgtggtctttgctacaagacactccaagaacgtgaattaatttgctcaagaaaaataaaagtgttaatttgctggtgcacaccatacatattattttatgatttcctattattttatgacaccatacgtcgacgggattcgcgaagatggctggcggagaggtcggggcagcgagcgacgatgcgaggtagtcatctagcaaaggagacggcgggcgacaaggcgtggccggcattaattagaggaagaagcctcccccgtccctgcagcttggtacggctgcaagcaagcgaccgccgaagaggcccatgatggcaggaacaccccttggtactaccagcagtttcgtgcgcctacagttcttgatagttgttggagaaatgggaacaggggtttccctcccccttgggtgcttagggcactacaggccccaccaagccatacaatatctgcatcttcaaggtcttaagaacagtgtcgagaccacaagaactaccctaggagtgctcggggcgctatgggctcctccgggcctatcccccgagggcgatctacatattcaaggtctcacgaagagtgtcgagacctacaagagatttagatcttcaaggtgtcaaaaagagagtccagacctacaagatctacatcttgttggtgcatcggcgggcaccagctggtacagatggcttatcttaagttatgcccatcttgaactccttacatcgag

SEQ ID NO: 59356 - DNA, 978 bp, Oryza sativa
ggcagtgtctcgcggcggtggggacgcggtccggcggcgtgggggcgcggcggcggcgtaacgtagaggcctggcggcgtacgtcggcgtcggcgtcgtcggcggtggcggccgtgccgaagtcgttcgtcggcgaaagagagagagagagctttatcgagagagagagggcgggggctctcacccaagagacgtggcggcggcgtctgtggcggaggcggcgaggaccgccaggcgacggtgagagacaacggtggcgtcggcgcggggttgccctaggcagtggctgcgaaggagaagccgatgctcgatctcgatggaaaaacgtctgagtgttggtggagaagacgagtgtcacgcccagaaattcccgaatagaattccaagcagaatgtgtattaaaacccccgtccaggaccagccggggtacacaaacgacaatgttgacatacagatcctcgtcttacaaacattataaaggtcttacagaaatgcagcggaaaacaaaagaaactggagcttaagccttgactaaaccgcagcgggaacaccactccacaggcatcctcgacggcacggacgaagcctactcctcggggaaaccttcatctgacacatacccgtcctctggggttgggaaaaatagagcaagactgagtactacccactgtactcagcaagtcataccggaatgggggtatgatgcagggaattaacaaagaagagctagagtggttcatttgcataaatactggcatttataaacaggaatttaatgcgaaaacagttgtaataattaagcagtattaaacatccgctgtccaacgctaacccacgttgcgacaggcccagccatccacctgaactatccaagttcaacagattacactagggtgagactaatcacggtgaatctggttgaccgcccataaccgcgggcacggctattcgaatagttttactctgatcagaggtgta

SEQ ID NO: 59357 - DNA, 2429 bp, Oryza sativa
aaattattttatcctcatgagtttcagcaacatggagagataaacatcttacaaactaagtcatgtgataatcttgctgatttattcacaaaatctctaccatactccacattctttaaatgtgtcaaaggaattggtatgagacgacttaaaaatttgcaggattcagggggagtatcttcctctggaaaataacctattttcgtcatattatactctttttcctttgtatgagttttaccctttaggttttctcatccaaaatttttttaatgagataatatcaacataagcttatatgtcttatcatttggcttttccccactggggtttttactaaatgataactgtagacattatactattttggatcatactatgagctttactcatagatctaaaatagtcaataatatatatcacggttctctccttatatttcccactgggttttcgaggagttttacgtgatgtatttaatatactgactataattatttctaagattatctttacagatatatggaacactaaatgagtaatgatcaaagttggattcgatcaagggggagtgttatgaaatatttgggtgatctcatccatctatatggatagaacagcaaccaattctgggacacgacggttggtcgtgccccacacctcttctcgcctcacggcgagaaccatcgcgtcttctgttgccgcctctctcccccatatatattgtaaccattgttatcaataaaggatccgctcattcattctctacattcttgtgtgcaactctctctctctctctctcgatccctctcgctcaatcaatcttatacactttcaacacgatctatgatccgattacaccgttgtgttcataacaattaaatctttataacaaaatctcacatgattatattttgatgaaaaattataatttatttttataatatatctaaattacttttaaatttcactaaattactacttagataaataaaaataaatttagtaaagtctaaaagtaatttacatgaactacaaaagtaacttaaaacaaaaagaaagtaacttttctgacgacattagaagtaaattcgttatagggataaaaatataactctatctagaaattaaatttaatcagcacaagtaagtttaacaagttttaaaagtaacatgttaattggaagtaacttttgcatggttcagaagtaactttctataaatttgtaaatttgttttaaacattgattgttttttccctttcacttttgtttttcatgtagtatgagataagaagataaaacctttgatggattgtaaataagttagaattaatcatgtataagatgtaaaagttacttccttataacatggaagttacttcctaacatgtaataaattacttttaaattaataaaatatttaaatatattaaatatggatcttgttttgtcgcatattttgactggagcacaatggtgcaaatagattttaaaaacaatatgtgatttaaaagatataagttattaaagaggttaaaaaaatacacactattgtatttatacttgatggtgtggtagctggataagacaaaccagctaccagtagttgtctagtcatgtccataattaaagtgcatttaataataaacaagtaaaaaataatattatatttttaataaaaaataaagatcaaatgtatatttaaaattcaataatatcatcaatgataagctaaagttcaaaaggaggaaaatctcgtccagactttccgacacatcaaataaggaataagtccactctgactccccgaaatctaatttgtatccctcgactacaaaaccagatataacgacacccccaaatattaaaaccatctaaaacaactaactcgatggtttttgagagcagtttcgttgacatggcgtccatgtggtaacccagtcaacaaataaattaaataacaataaagtaggacccacctatcatccccttctctctactatgcgctctcacctcaaggacacgtcgccactaatctctctcacctcaaggacgcgtcgccgcaaccaccctcaccgtgccggcgtggccatagatgacgatggcagatggtgccctgcttcgcgaagccatactcatgctcggcctcgtcgatcaactcccctaacagcgggtgtttggggtgtccgagcagcacggtgaacctccgctgctcctcaccttccacccccaccctaaccgttacacacggcttcagcaccatccccctgctgctgctgcttcccgtgcccgaagaaaaagaacaagaagcttgtgatctcttggtggaagaagccagaggaggaaaaaggatttggggtttgatggtggttagagtaggagagagaagggccacatgttggagctgagatggcgacggggctgcag

SEQ ID NO: 59358 - DNA, 4710 bp, Oryza sativa
ggccccaacagtgccaacccctatgctgccaccgcctccgccggccctttgctaccggcgcaagccgtccagaaggtgggcgggacaggggaggggggagggggggtggccggctcagcgagcgcgcgtaggcgtcggtagcgcaccggagcacatccttgatggtgggggaagaggaggccaggccagagtggagggatttagagaggaatatgtagtggcgacggagggcgaagggggagagggccgagccttgggagtgagaggagtcgaggagacagagggtagtgcagtggaaggactcgtctacgacgaggacggaaacgacagcgaggaggagcaaggcgcgctgggaatccgggtcgaggtgggcggtgtggcccgcgtgcttgtgcgctgcgcggaggcggatagcaacaaggtgaggagacggcaagctctcacgacgtcgtccgcataacaagtgggccctactttattttttaagtttatttgatgattgggctgtcacgtcaacgaaaccgccctctaaaaccaccgagggagacggtttagatggttttaatagttaggggagtcgtaggatacagattagattcagtcagttaagggaatcaaagtgaacttattcccctcaaataaacgtcaacggtatccagcaggctgcaacaggagacaatgggccggcccatgggatccggccggccagttgttggcgcatcatgcacactgtaaaccgggcctcctgtcccgccggcccactgggcggccaaaactttcaacatttttctaaacgccgtctgatgaagttgaattgaatgaaaaaaaaggaaaggcgccgttgccggggatcgaacccgggtcacccgcgtgacaggcgggaatactcaccactatactacaacgacttcattggtgattacgtgtgcggtacagctcaaagtgatattttgttaaccacgtacaaagacggaattttcttatcgaatattagatgcaggcaagtgtaatcatccctataaattttacgggatctcaagatgcaggtcgtgggttttcagtggtttcatgcttgttttgtgcttctcttttttgaacggatctgccatgacctatgaataatggagatgaatcattatagtttctaacgtaaaatttgatactttccgatattatgtaccttatctttgtatgtactttgtcaccgtaaaatttttaaatgttttcaccgttagtttatgctttcgttcggaaacgattaggctcaagcgaccggtgcctaactaaatatcgggcgtctctcaaccacctatttcttaacacctcgtaaccacctcctctctctccttaattgctctccctcctctctatctctcctttatcgctctcacacttacaagcccatggcgaccaaccagccctgctcgcgctccatggtaacggctgggccatggttgtcgtagccggcgaggactcctcacggctgcggtggcttgctagtgcacatcggcatagcttgggactagaagctgggaggaagacgatgacccccatgcagatgcttccattttgctcaagcgatgacgatgacgtagtgagctcccagtagtagcggcaacagggtggtgagggcctgaggaagcgacagctgctcacctcagggtacaaaaagggtgttgtagtatcacggcgtggatctctagcgaagactggaggagagcaccaagccggcggaccttggtaaccctgtgttcgttggaggggaagaaaatgcagtccataccaggtatattctcgtgttttttttttatgtttcagttagttagtgtactcgtgatgtttctttgtggttggatcgaatgttgcagtggatattttgatagtgtttcatattttcatctttgatgcatacgggtttcaaaacgtaaaaaaaaagatgaaaaatgaaacactattaaaatattttgacactcaattcgcatttttagctatctttataatattattgatagatggattgaccgtagagttgggctataatgtctaactagaaatgtagcgcgccatttggcgctccactgtatataacctatattattatttagggtgtgtttaaaacttcaaattttataggatttattaaaagttagttcaattttcatcgaatattctattcttgcatatcatcttatgagcataatcttttgcaatgtccagcaacaattacatgttaacatgtatctgtgcttatttgggatttcgtattttgcctcataactattttgttgatgagatatattcttcttttcgtctataaatttgttaaatttgatggtagctaaagttgttctcacgaagatggcagtgcagatcctccccaccacaaacaaactccatgatatagaatcagagtaagcatctcaagaacagttcacctagcacctctgcatgtattggttagtgcgattccctctccttacaggattcgaaaagggaagctgtaactaattcatgcaaagtgtaaatgttagtcaaggaaaggcgaatagtagcaaacatgcatgtactaactcttagatttacaggaaaatggtcatcacaaccttctttctgaaagcaaacaattaactttctagaaaagtaagtgtttgtaaatcaatgtggtatttatcaaagtttgataactatctaagcatttaataatcttattacttttgatgatttccatgcttgagaaaaactcatgcagtaagataaccgggcaagcatcctaatgagtaccactaataattttggaacaatgccaattgaaattcactctgtattactttaacaaggtaaaattacactttgttgattcatttgtattctaatcagcaaccataatggatatttacattaatatagaaacaatgaagtcaactcatattgcaatagatgactatatagcaataaactatatgaaataaaactcaaagtatacttgatgtcttgctgatcattgatgtccacattctctcacgacacattcaaaaagataaagagatattctgaaatttatttttatagcagtgggagtgtgtaagccagctgatttgcttaccattgtttaagatgacttgatactaagattaatatttacaaataaaacaaatagaaatagattatgttaaagtacgtagtctcaagtattttgtagcacatctattaaattacggcgtaacatatgaaaaacaaaaagaaaaatagtaccatgggttgcatgtcaagcaaacaatgcatggcttcattgtaacaaaaaaagagaaaattccccgtatacccttgaaagttcccccaatcctttctatacccctgagatctgctcattcccttccatacctctaaatttcagtttggatcccttctatacttctcccgtcaattgaccgttaaattcatatcataaagtccattttactcttttggtatcaagaaaatgtaaatttatgaagcatattgatggagtgtataagcttattgtacgcgaatattatatttatgagtttattttgtgagatattatttaacaaaaataatttttatctcacataaaaagatttatcttataaaaaaaattcgtactactataacaaaatatgctatatatacagtttttaatggtaaaaatatattatttttttgttttatctaaaataatttttgttttatctaaaataatttttttcatagataaattttttttccttcgcgaggtgaaactaaaatattacttttgttaaataatatctcacaaaataaactcatacatataatagtcgcgtacaataaatttatacacttcatcaatatactttataaatttatattttcttgatagcaaagggcaaaatggactttatgatagaaatttaatggtcaactaatggaagaggtatagaagggatccaaactgaaatttaagggtatggaaaaaaatgagcaaatctcaggggcatataagggattgggtgaagtttcaggggtacacatggaattttctccaaaagaaaggatttccattagttcaagcgtattagtgaagatgcatggggagtttcaaggttttctaaaacatattgaatacaattcgtaagttttcttcagcgctttcaagttttttcagcaacaaaaagacccctgatgaagtgctcgaactgaatgttcagacaattcaacccaattttcagttaagataaaaatgatttttaatatttcaatttatccatagttcagtagacttgtgggagtacctccctctgtgttctactggtgtttgatacctgtactaatggtctttgctaaattgaataagaaactgaagagactaagataaatggctatgtatcaataaatcgttgtgacttcttaacatatagggtgagacagcaaatttaatatttgttagaatttgatggaataagcttgttgactgagaactatcaaaatgatgaaatttactccattctgaagtcagaatatctttcagatgtagagaatctataagactgaaaaaaggacataaatatgggctagtgttgttgttgttgttagtcaggcagcataaaaagggtgtgaattatagatacttatgtaccactgacgtagactgatcaacattttgggttacaaggaaattaatgattaaagtgcccttagcatagataatta

SEQ ID NO: 59359 - DNA, 1348 bp, Oryza sativa
caagaaaggtaaaccagcatgtttctttgtcacttggaccgttagtgaaatgcaggtacctttgcagctttgctgaagcaatgaacttgcagaaaacaaaaatgtcaaaatcatcgaatgcgactatttacttgaggaaacatgtaggtgaaccattattggtaggtaatacatagagagttccgaaaatggcaataacaaacgcttagtaaaaagaactttaatgaatgatatggtacgctgcatttaacccacttaggtatacacaatgatgaaattgtaaatcacaatgaatcaagaagactaaacacctagatagaaaccaaaaatcaacatgcatatgaagttctgaacatttcagtgtaattcattctcacccatgacgcgaatgtcttgtcatcctgctccctgtgggctgtggctgagagacccttgttgaacctttgcacacatcttgaaataagaatcaatcaaaaaatgaagattggagtaacaagcagcagacgcgctgagtaaatagtgacaaggtaaataatgattgattggctacaccggagtaggagcaccaagcggacggcaatgccatgaggagtaggaggatgcggcagcccaacagatgaggaggatgtgccgacaacctcaccgctggcagcaatgccagctgctggagtcggagcaccaagcggacaacggtcagcggacagcggcgctgagatctgaccgaacttgatctcatggccccattgacaccaccattggctcggccggcctcaccagacacgacgtcgcctatctctactaccgcgccgcgggaagccacggtggggcgccacctcgcgcagcaccgggcggggatcgaggcgcgcgcgcgacgtcttcgccatgtcgggggactttaacctcacgctattcaacgagctcgaggtcgagctcgtcgggggagagcctagtcgtaggtgcttgctgcaaggagctcaacgccgcggatggagggatcggcgatttctctagaatactcgattattttgccacaccttttcttcgggagagggcagggccgtgaggctgtggaagggcgaaggcgaggcttgattcttgaccctgaaatcgtatatagagatatctataatcaatctgtaaaccgaaattactgtttactggccacgcacggcattttaactcaaacttttgtaaccgaaagcacaaatacgtacgttaccgcgcatcaagcgtggtgatattgtctacaatctactatacagtgcggttatgaaaatgtcaaaaaaaacacaagactaaaactgaattatttgaatttagttcaaaaaagaaaaggaaaatcttagcc

SEQ ID NO: 59360 - DNA, 671 bp, Oryza sativa
atcgggaataaagcgtacgcaccagcccacgcacaagcgcatgcgtagcccatccttatctctttttcttctccttccttatcttcatcctctccccttcctcttctctcaccccctctcctcctccccgacggcggcggcgggatgggggatgggcgcgggctggcggcggccggccggcgggggcgggatggaggcggccgggcgcgggctggcggcggccaggcgcgggctggggctggcggcggccggccggcggcggcgggattgcggccaggcgcgggccagcgggatggaggacgggcggcggcggcccggcgtgggccggcgggatggaggccggtcgccggcagcctcgccctcccctcctccagatccggccagaggggaagcggcgggatggaggacggccggcggcggcccggcgcaggccggcgggatggaggccggtcgccggcggcctcgccctcccctcccccagatccggccggaggggaagcggcgagatgggtggccggccggcggcgggatgggaggccggccggtgagtcgatttttttttttgattttttttaatttgtggtttggatgttttgatctgtgaatgaatctatgaatcgatattgtgaatgaatctgtgatgttgtgaatgagtatgcgactcgatgttg

SEQ ID NO: 59361 - DNA, 7463 bp, Oryza sativa
catatagttttacatatttcacaaaagtttttgaataagacgaacagtcaaacatgtgctaaaaagtcaacggtgtcaaataaaacgaaacggagggagtatatacatagtagcatcctatgagctgtaatcatgcaaggcatgttcaatgtgtttgcttaccatatatgcacataaagaaggggccatatgtgtacatatattggctagtcatcatttttttatttggtttgatagagctcggttgtgcttaaccagattgaccagagaaagaaagcgacgaccatatttacgttcgaccatatgagacagacccattaatacacctatagggaaaaggcaagataagagacatactgacacaacaaaaggtctaacactcatctagcgcactactataactatagtggagaagccatcaatgtgcttgtcgtaattaaaatctcagttgtattgtactttgtacatatatacatgattaaattattgtactttttgatagacatgattcgatcaataagatacatcatttatatatatatcgaataaggtcatgatctgttcttttttaattaacgtgaaattttctagatgttttatattaatattggaatttcgagctaattaaattattgacctagaatcaatgtggggactttaaaagggcctccaaagagtatagaaaaattatatcaataagatacactatttaaatatatagatcggatagtcaggcatatggtctttctttctttttattaatgctagaatttctagatattttatattaatattggaatttccatctaatttattgacctagaattaatgtgggaactttaaaagagcctccaaagagtataaacaagattagtgctaaggctccatctagatctactacatatatatatgtttgcaccattgtccactggacgtatgtatatacaatcagcagcatatgtttgcacaagaataaatatgcataaccaaagcatgctatattctataaattgcatgcaaggcagcatttcatatagaaccaaagaaggggaccatgtgtacatatattacagttgtatacgtacgtgtaccaatataagccggtggaatattgaaatatcaatcgtatattgtaaatgcatagttacacataattagccctcggtgaccatgatctgaaagatacttcatatcgtgttgggttttgtgctgatcctatacgtgcgatacatcatttgtagagattaaatggtcacgatagatttttctttttcttgattgatgtatgcgagaataataaatttttagataaatatagcttatatatatttacttggaattaatgtagggacccttaaaacaatctcgaattaataatatagaaaatacaattacagctaaaattcatacttactttagaagaggaagatctgagagagcgtacttggaactatccactagacagtcaataaatgtggctccagaggagtaatattatacatagccatagcatcctatgagcaaaaaacatgtaaggcatgttcaatttgttttcttacaatatgttcacataaataaaggagggaccatgcgtacataggctgtacgtgtttagttgccctgaaaattagaagtttggttgaaattgaaacgatgtgatagaaaagttgaatgtttgtatgtacgaaaattcgatgtgacgaaaaagttagaagtttgaagaaaaaagtttgaatctaaacccggccatatatttgctagacatcaaattgttttggtttgatctagctcgattgtgcttgcccgattgactagaaaaagaaagcatggctcatatttacattcgatcttgcgagataggcccattaatatcttaatagagagtaggcagacaagagctagagatactgacacaacatttaagggtctagcactcgtctagccaataggcccactgggtctagcactcattagaagttttttccttcaaaacgtgtaacaaaatttcaccctaacctactggcacattatttttttttcccaaatctaagtccgagcaggcaacgtacaacaagtcagcaacgtcgtctcggctgaagtgacggctccttcttacgacgcgtgacggaaagtgtcggctgaccaaacggcgccgtgcacgtcgtgcgtccgtccgcatctacagtccgtgatacagtaaatgaacagtagtaactcgttaccaaccccaactgcacgctcccaacgggcgctgtcaaacgcaggttaactagagtagagaagccatcggtatgctaggtggaatcaaaatatgagtactttggattccgatcagctgcagtcactataacttaagcagcagtagtgcatgtcattagatgcaaatcggatggtccagattgcatgctgtactgcacgtagtactgtagcacaatactgtagcataaagtactgtatatatatatacgtatacgtatatatatacacgtatatacgtatgtatgtatgtgtgtgtgtgtatatatatatatatatatatataaaagcctgtatactactcccaggagtagctactcctattgtaaccatcggacacctgtccacctcacatgaaggtttcaggtgtcaacacactaacagagagaaaatatccactaatccaccgatgcagaaaatggattttctttttttttgaaaaatcggatcactgcactgtatgttctgcatgctgaggcatttgaatgttctacatgcacggcttgtcgatccgcacgcatgcaaggccgtgcgaccaggagagtagttagtgtggaggttgctacggagactccatataagtttacggtgggcaagcagatcatttctgcagatatttgatggagcagaaacactccggtggaaagggcagaacatcgtcggtgagttctgttccgtcgccttctgtggaaccagaagacgtcgacgcgtgatgtcgagcggcagaagccggtcgtggccgtaggcgtgtcatcgccggtgagttctagcaagcagcacaatctggcagaggcagaagatggaaccgtttcagctaatggtgttatgcagcagaagcctgccgcagattggtacacatcggagattaatttttgtttatgttctattgaaatttttttctcttgtttgtttgtttggttctgactatttgttgcgttctttggtcaggaatggttttgtgcattgcatggatactgcttcccggagtgaagagatgaatcactctctccagaaatatgacattcatttggatggcatatagccagaaatatatatgacatgtagccagtagtgaaatgatcaaaaaatttgtaatatacctcaaaagaaaatagcagaacatcaattggaagaaattcataggaaaaaactggccggcagaaaatatatgttagccggtcaatttgaaaaactggcagaacgtcagctaaagaaattggcagaacatcatcgccgttaaaaaattgttggcagaacaaccacctaatttttctctatacccagtttttaagagcagtacatattctgcctattgaaagctgacagaagtacatattctgcctattgaaaattaatggaagaaaatcttctgctcagaatttaatcacatccgcatagaagaagtatgcaagttcgtgtaacagaaagctaattaatcttccattccaaaatcaacggataggatagcagaatagagtctgtgagctgtgaaaggagcagaacatcggatggaaatggagtagaagattaatttcaaagaagaaccttctactcctgttcctgtaactaaatcccatcgtgtaatatataaagcagtttctgctcgtcagtgtatgagtaccatatatatgcatcaccgtaggacagaagctctagtctggaatgtgtgcagaaaacaattttctggtctctagatccatagctcaacttctgctcgtataattgaatctcatcattgatatgttctgctcctcaaaacgttttaaaaaatgagcagaaaatagaaaaggtggacagtaggtaaccggaaaaggagcagaatatcggttaggaagggagcagaaaatcggaagtttggaacagaacaaacgaaaatagcggtggcttgtgctcttcgtttccattcgatccggtcatctaaaaaggtgaagaatatcttctacccctataactaaatatcatcacctaatatgaagcctggcaagaatattggcaaaataatttctgttcgtccagcgtgtatgtgtaccatatagtatatacatcatcgtatgacagaaacttgggtttgaatgcatcgagaaaacagaccttcaaatcacagttgctcattttttaaaaaaaaatcatgaacctatatccccgttataggacagaacaaagttgcaataaagctaaggcacaatatatctacataaaaacctcatctgctcatttttactagctgattgaattgacatgcattcaaaacaatttgtatcccgtgaaaagagcagctggcttccttaatggattggattacaaatctgattagtcattaacccgttaacaaggactccaaattagcaccaagctgcacagatcgtgtaacaaaccgcatggtggatgagacgggagtaactactcccggtagtagtatataattttcctatatatatatatatatataggacaattgtgttcctaccgttgctttacaattcaattgtgattttacctctgttttttagggtttgtgattatgctcctgctttttttaagcgaagcagccgtctgccctggttttgacggtagttaggtgggcccggaatttccaaatttaacgaagaaagaaaatgatattataatttgcgaatgaccctcttacccttggttcactgaaagggccaacctactgaaacgatttccccaaatcaaaaatatccagaaccctagcgagaagcggcggcgcaagcaggggcggcgcgcgaaggccagcgcgcggcggccccgcgtgccagcgcgcggcagggtgacgcagcggccttgtgggccaactgccgcgggccagcgcgcggcggagaggggcagcggtgttgcgcgcgggcagggaggcgcggcagcggtgtgcacgggcagggaggcgcggcggacccgcggccagcgcgcaggaggattctccatcatctcatctcatgcatgctattgcaaactgcagcagttcattgttcagaaaaggaatccactactgtatgtatggtttcttggagaatggtgtgtatgttgtcattaagcctttgttagtcatgatctctcccaggtaacacatctctaagcttccctagtattgcaatcctttcgttctctagctgtgtggagccacatggttcatgtacagtttttgttggatggaaaatatgacaggtttcaaaattcatcaggagaattcagattcagaattaagttccctggctggtgggtatggtaaattgcagttatatcaattgatcaaagttcagatccagaactttgacttcttgttccagggcttttgttggatattaatgtgtaatgttgagtattgtgctactttctgataatttgtgatgcttgcacatgttatatgtgatatgttggaaatatctattgaaattgtgtcgaaattattgctgaaattttatccatgatattgtgctgtcaacttgtacaaattgtgttcaaattattgttgaatttctatcaaaattttgtctcaatttattgctaaaattctgtcaaaattgtcctacattttttgttcagtcaacttttacaaaatttgtcaacatttaggtcccatatgaaatacgcacaaatttaacttcaaacatatatatccagtgtttatgctaaaattattgatctcaatagtagaggtatatttgtctattcatcacacatttaacaccgttaccagaccaggggtaggcggctgcttcagttaaaaaagcaagggcaaaatcacaaaccctaaaatataggggtaaaatcacaattggactgtaaagcaagggcaggaacacaattgcccctttatatatatatatatatatatatatatatatatatatatatatatatatatatatatatatatattaattgggcacttcctacgagctcccacgttaataagaaagatctggccattgattaaataaatgatattatcgtcaccgtagatcgtaaaatccatccgtgtttaattttgtgggccatatgtaaatcaatctaacaccacctcatgaaggaatagatcataagagaggatatgcgagatgcaagattgtttatgttgctatcgagcgttaagaacataattagacctatttaattgacagcacaagaagagaagaaaatcagcgaatcatatggcaacaccttgggcatcgatagggaggcatggaaaaggcgaatcagagcctgcgtacgtgacaagacgattaattcttcaagcacgccgtacgttcacgtctatggaaagcagcgatcagcaatggggttcagaacggcgttcacaatgcagcacatcaagtcgctgctcgacgccgatgtcgtcgagtcgccgcggcttccgccgctgccatgtccgcgcctgccgaagttatggcatgtcggtgcgagccttgggggcgccgctgcttcatacgccagcgacgacgtacgccgacaacacggccatgtccatgcaggctgccgctgcaggtagatgcatgtacgctccatcgtctgtaatttctccatatacccgttgattcagcacatagaaaagcaatcacagattgatcatgagaggctcagcgcaaggctgattatccgtgccagagatgcatagataaatacccttaatttgttaacaccatactttcagttaagaccattgattatcgattaaccatcatgttatatatatgtgtgtgtctatttgtttcagttcgtatccatcagccaagctaattgcctggctgaatcatatggatggactaagacacagaaacatggtacatgtataggatcaacatgatgaaggcttaatccaaaaggttaatccgtgcatttcttttataacttcatactctatttaaaaaagattattggccaatgctaacatcgatcacatagatagatcgatccatacaaagccaactcaaaacaaggagatcaagttagctatactgaatgtgtttatttgattttgactaggttataatagtttttatatgggtctgtctatttttcagtcactccaaaatgtacacaaatttcaagcactttgaatggcctagaccacgccaatattcatgaagatgcagtatatacccagcatatcttctactcttcctttcacacctgtaggacgctcgcattttcgcccatcctgctgctgctctcctccaatttagggcgat

SEQ ID NO: 59362 - DNA, 2171 bp, Oryza sativa
aattcctgcagcccagattcaccggcgactaacagaccccaaccaccgcatccggctgtatcccgttgccctcttcttccttcagccttcctgaccattgccggcaccgcctcccctctctgttgccgccactgccttctcctctaggccaccggattcagcggccacgggcatatggctgccggatctggccatcgcagtggctaggagcggctggaaacagcggcatgatgcagggagagagatagggacgagtggcgagggcgagatagggtcagtttagacatttcagaccgaaatttcggtcatttcggttccctccgatacgatattattccggccgaagtttttcaattttttaattttttcataaatttgggtaatatttatttaaattcaactaaattttgctcaaaatttcggaaatttcggaccgaaatttctgaaatttcgggatttcggtgacccccgatataaaagcacaaaccgataaagcaaaccctagatagggatgagtggcgatgtgggtgaggtcttttgtttttttttttccttttctcctttgtttttctaccgagagattggcacaaacttaatatagggtactccctccgctttaggtcacaagacattttaactttggtcaaagtgaaactatttcaaatttgactaagtttatataccaatatagtaatatttataataccaaattaatttcattaaatcaataattgaatatattttataataaatttgtcttgggttaaaaatataattttttttctacaaacttagttaatcttcaaaacgtcttataacctgaaacggagggagcagcagttacgttttgacactgatatttgttaccgtattttttaattagtataccatcggtcatattgtgcgaattctttttttaccactttgctagtaaaatatctccattatttttatgttgagaatgctaccgtgactttgaacaccaatattattctttgcatgtgataaattgtttactactatccaaataaaatctctatctctactattataaaaattaaagatgtttccttcaaaattttagtacaccatccgtgtttgagttggttttataatatttatctgaatgtctaatatatcattatacctaatacctataataaaaaataagcaaggatttagtgtatttgatttcgtatgtcatccgtacgtgtctaatccgttgccgcgcgcctccagccgttgctacaccgctcaggccaaaccctaacgccaccgccacatcgatctacctccccgtgagtttttcctctaattaattgcaaaaatcgattctccattcctccctcatccttccccatgatttcctcttttaatttggctttaattcactagatttaatatcaatttaacagtagtgaatgatgcccttccggtagtgaacttccccagctgtttttattccgggttttgtggattcgctccaattttaggaaaaattgagagaagagatcaagtggatcaaaagttctcaatcaattttggaagatcaagaaagattcaacttgatttgatagggattggcaatgtataggcacggaactatcttccgtaagttaagaggcaggcagagtgaatggaggtatgtcttccggaagttaagagaggtagacagagtgaagggatgtaggaggcaacgctttttcaattataatgtatagcgatactgatgtttgatgttttattttaagtatatttcaataaacagacgtaaaatcttgaacaaattacaagaaaaaatatcacaagaaaaacctcgcaaaaacaccacaaacaacagctgagtggatgcaatactaccacaaccaaaccttacgaaaccagctcgctaacaactaaaaccattcattcaaaggtattgcattcactgtttaggcgctgaaaaaaatattagtggatgcaatactaccacaaccaaccttacgaaaccagctcgctaacaactaaaaccattcattcaaaggttttgcatttactgtttaggcgctgagaaaatattatttctatagatcatctccactaatttaaaactactatatccgttctaaaatataagttattttcaccgtatgtgatatgtcctaaaataccaaaagtatcacatccaaata

SEQ ID NO: 59363 - DNA, 10888 bp, Oryza sativa
ttgtgtagcgccacctctcaccactactcgctatgtcatgggtttgatgctcggtcgcaagcatgagttttgaatttggcttaggacacccctagcgaaatgacctcactactacaaaaaccctcatagggaccgggcttgggaccgcgcttataggtgctggttcatttaaaaccgacaactataggcctttcccacattcgcacgccaaaaaaaaataaagaaccggcacctttaaggaagcataagtgccagttcattagctaaaaccggcaccttttctaaaagaactggaacctataatatattatatgtaccagttaattaaaaaccaacacccataatatattagaggtgccggttcttttaaaaaaccagcacatataccataccgagccgagcttacgagccgatcgtgcgccggcttatccatataatagcgcgtcgcctcgatctctcctgtcccttctcgatttctctatctctctctctcgcctctttgtctctctctcgcctctctcacttctctcagtctcagatccggccgggcgacggtggcggtggcggtggccgcgccctccggaggggaggcggcacaccacggtggagcggcggcggccgcgccctcccctccgccagatccggcaggaggggaggcggcgcacctcggtgacggtagcggcggcggccgtcgacagcaggggtggagaaggacgccggtggtgtaggcgaggtggcggcgggcggcttgagttcttgagtgtatgggtttttctatttttgagttcttgagtttttgttgagttcttcctctcttttctcctcctcgatccatgtcccaaatataatgtgaacttgttgttgattgatctattgagttcttttcggctggctgtcggtttgttattgatttggccggccagcaggggtgttctaggggatgatgtgatccgggaggcggtgatgaagggaggagtagggctgggctcgagggagacgacgggtgtatggttggtgagttcggctcgattcgagtcggctctcttttctttttttgctcgagcaaagcaaaaggcgtcggttctatattcatcataggtgccggctgttagtattggtgccgaccgataggtgccagttaggaaaccagcatgtatagccggttccaaatcggcacctatgatgatttctgtactagtgcctagattattccgagcacttcgcacatcagagaaacatataaaaatgtgtggtggagaatgcgctaacgtgcaacggcttttgcgctagttgctcaaaaaaatcgtacaaaatttaagcaatcagggttttttttaggggtgtgtgtggagaaaaaaaaggccaagaaggccatttttcagagctatacggcatgtttgggtaggtttaggtagtttcataactagaccgatttgaaacgtgaaatatcgtgttttttgagcataagtatgtctttgcctctacctgcacgcgcatgtgatgtacacatgcgtatgcgcatgtgttctattggcgcacatatgcgttaaagatacattcaaaaagtcacaagaaaatgtgaaaatcattttagatgtgcaacaccataaaaaaataaactcaaaattcgatgtgaatgcgaagaaaaaaagacaaaatcgtgctcaaaaaagtattcaaacaattaacattactattcacatcagatttgtttttttttctcaacttctacatcgaattttgagggggggtttttcgtgcgaaagtacatatcctattgcgtatcgtggttttttgtcatatttttttatgacttcttaatgtatttttttttagtttggtagcatgtatagcacaacactcttggattgcacctgagattctctccttcacgtagagcagctggccttaatttgtctggcctccgcgcgtaacacatgagcccgaaacgtatatcaatcgggtgtcgactttataaaaaaaatgtttcagcacattaaaaaaatgtctcagcagtaaagatgatgaaacataaccgaagcacacttaatcactctgctgcgatatatgaaacattgattttgaaccattgaaacatcgacaaacccgtgcacattaaagataaaaatatgaaacactatcaaaatatccactataacatttgatccaaacacaaagaaccatcacgagtacagtagctaaaacacacacaaaaaaaaaatattataccctatcttcgttgcttcttccttctctccggtgaacacagggttatcgagggccaccgactcggtgttctcctccggtcttcgcgggggccatcagcgtcgcgggagaagaggacgtagctgtcgaggatatcatcatggcgccagagatccggggacaacgggaggaaggggcaggtgaagtcgacgatgtcatgttcggcagcggagcaagggtagggcagctacacggggatgaagctgccatctatgttgaggaagccgagcagcggtggtgggtggttgacggcatggatctggcggagaaaggagagctcggtgatgatgcggcgaaagctagcgcgggtggtggcagtgcaagcgagttcaacgggggaaaggaggcgatgcggaatgggtagctgagaaggtgcatgatatttagttaggcatccaacacccgagcctaatcgctttcgactttgagccatgtatcagttcttgataggaagaagaaattttagccatttacctaaacaatatgcaatcggagaagatactgcaaaatagcgtgtacatgcatcctatatatccccattaagtgtagttaatgctaattctctcctctcataaaaccacgtcacctcaattgtttttagtatttggatgattcatcaagtatgtaaattgcatctcttgacatgacctcaactgtttttagccgttggatgattcattcagggtataaattgcatcccttcccccaaaaggcacaccatacaactagtcatttataacctttggataattgataaaagtataaaaatagataaacatataaaaaaaatcgtatagtaggtaagaaagaaaattttagaactcatatatagtatattatcacacaattctcccgtagcaacacgctgggtatccatctagtttaatagaaagcacacctcaaaggcatatgccccaattcctctcatgtttttcctattcccttgcccttcttccgtcccctctgtcccccttcttactgttttattacattctgtacacctgaaatcattattccaacatagtagatgatttgttcagactttttagcattacctcaaaaaagtatgcacataatataccgtggtatatagtccaactgacctttttctacctacatagctacataggtgttagcgtgcgcggcgtggcaccgcgctcacatttctagttacaattcaagatgtggttccagcttcatgttaagatgagggaacagaggtgaacttattaaataaaatctccaacgtcgggaaattatgtggacacacgagcgcacgacaacgaattggtcgctggaacaaacattatgcgctgcaatcctcgttttccaaacgcatctgggatcattttctacgtggatttcccctaggaaatttccacctccaattttaccaaaataaccctcagagaaattggagcccacgggggtattctccccaaatttaccctcacagaaatttgggcatattagtaaattaacaagagacggcccgacccgaccgaggagctaaccacagctcggctctggcccatataccggcccattaaacagtaacccctcgtttccatctgatcacgttctcccaccagccgccgccgccgccgccgacgaccgcctccaacacctcaaagccgccgccgacgatggctcgttcgaagcgggcctggagagccccgaaggtgccgaggagggagatggcagagaagtccttcttctgcccctactgcgtgaaacagatcaaggctgacctgatcaggggaagcgaacactccaagaggtgcaaagcgatacgagacaagcaggtcgcggagagggcgagggaggaggcggcgctccgccaagccgccgaagagctgcgcaccgccggcaagaccagcaccggcagcggcggatcgaccccggccggcccatccagccccaacatcaaaaagtgagcagaggtaataataagctactactgctggagatgattatatgatattagcaatatttttctgcatctcagtcttgagcatgtgcgaattgtttaattttgtctgccattgttaacaaccctcttcctccaaactaattgttctcaagaacaatagaattcaatacaaactcagagaatagaagagaaattgagtgagaagaagtagaggaagcttctagaaatggcagtgaagaggaacacgagagagtaagaaagagatagagatcgacgaggttcaaccgaaccaagccgccgccgtggccgaagccgctgatgcctgatctgttcgttgcttgaagttctcctgctgctgccttttgtatccctctcctttgtttgtttggcccttggcatggattagcaattgagtcagcccatgtgcagcccaatgggttcctgacaatctcctctccttgaaactgacttgtccataagttgatgacaagtaaacttcagaaatggcaaacctccactttgatttctctagtattcttgcatcgttccaaaagcttcattaatgtccaatttgttttcagcgtgccaacagaaaacttgcatctcaaaagaacagctcaagcaaatcctggcacttcgcatgtgaaagagagaactgtcttgcaatgagaatttgactgcctgaaatgtgatttgtccaagagaagagatagctagaaacttgagtaaacataaaccaccaggatcccatggcatttgtagatcaggtgcactaagacacaattcatccatttgatttacacagcctctgaacatattttgaatgaacaggccacatctttcatcttgctggatcagattcttccaagttttcatccaagatatccataggcgccgcaagcttgtttgacactgatcagaaagaccatacaacagaactgtaatttccacacagacccataattccaatactgtagtggcaatggtatagagttggtaaatgaggtacttgctgcaatggtgacaaccctgccactgcccttacttttgataaaactagtactttgataaacccaaactgtagcgaactcctctttgtggaatatcaattgttcatacaagaattcttggcccatagtattcaaccagtacacatctacttcaccatcttcaagtgttattttgtatgataatttgcagctctctgttatagtccaatccgcactaattaaataggtagcactagaagtagcttctgattgcatcaatttatagccagtgggcttctgccataattccattgagagcaaagtatacaactcgaaccaattctgagaagaatcactatatgttttttatttaaatttcctttcccagcaaacctcataggatgtcatgttcgatctccttcgctgcataaaactcaccacccaacaattctcctttaccacaaaataactgtagatacttccaaacttctctagcagaaagcagcgaacagcccgaagaccacaatattcttctcacataattccagctcatccaactaggaaccatagagaaatcttctcacataatgttctttgttatgttacccaactgtatatgattttatatgttatttgcttgcaggtaattgctaagatgatcagagggagaccatcagacagatgagaaatgatggaataaatgataaactacatactgcagttgattactttcttataatctcataatgcaatttaggaattatttgaactctcaccatgttacctataatcaatgtttctgtactccatggcattactttgcgtaattcgacgacttactttgtgtgatttgggaactatttgtgtagtttgctatatgattaaatgctagcaacattcagatgaattaacaagccttaccattgcatatctatttgtgttcttgccacgtagcatcacatgaaaaggagttccgtgatgattggacaacctggcaaaattaattaaagatatgtcattagatcatgtcaattcatataagaaagacattgcaggttaaagtaaaaacatattaggagtttgacagttcggagaccagatttaaacgaccttcaaggtaatctattgaagggaaatcatcagtgctaagggtgttttgggcaaaagaattctatagatatttcatacggattggtcaagtttgttcgacatccattttctcacacttgtataaattagtaaacccaacttaggcaaaaaaaaaactcatgtaaaccccgatcaaaaagttgtttaatttcaccataaaaatcacacatgtagatgagacgattttacataatcttgtaaaaattctcctaaaaactatactaaatttcaaacataacaaaagttttacataatcttgtaaaaattcttttaaaaactgtactaaatttcaaacataacaaaagtttgaaatttgttatttttgtaactcataaaagttgagtttagacaagatctttatacatggttatataacctcatctcatttgcatgtgtaattttttaatataaatttagacgacttgttggtcggggtttatatgagttttcatttaagttcgatttccaacgcatatttacccttcctacacttgcaggttggtgtctcgcaacttaatcaaggtcaatataatttgaccgtatgcaatcattactaccgtgatctgtgtggttcagtggtgactaattcgtcctaaatttaagctatgtacttactccaaaaagattcaaatcctaggatttaaatcttgttgataggagtagacagttctaatatggaaaactacacacgcagacagtaaaattttattgaacccattcgacaatatttcatgaaaaaaaacatgtactactttgttttatattataagtcatttgactttttctctaatcaaactagcttatatgaaaatttaacaacacctaaaatatcaaattagttttattagttctcacattgaatatattttagtaatatatttgttttgtctttgaaatagtactatatttaagaaaaaagtcacaacttataatatttaacaacatctaaaatatcaaattagttttattaaatatcacacattgaatatatttgttttgtctttaaaatagtactatattaaagaaaaaagtcaccacttataatatgaaacaaaaagagtacattataattacgaaaactctttgatctatctatttgagttgtgtttatcttacaaaatgaggcagcatagagatccgatcacttattagaactcacctccattgttaacaacgacttgtctgtgcacggtgctggcaaataatatggacatgaaaggaaaatattctccaacttgtaagatgaacatgctttcaaaatccttgtgcgcgagcaaaatccgcatgataaatacagaacaatagaatgaccatctccattttagttcactctgtaataacacttgtatattgccagtgatatgccaacaaaatataatgacaacttccaataaagtccgaacagcatgatgcttctcaagccacagaaatacggatctctggacctacaaatcacgccatataatgattataatcactttgtaattctctcgcctaatgaccatcccgactgagattcaggtcccgaaacttcaatcatcgcacgtcctcattctcttcaagtccaaatcctctcgaaaaaatagtccccttcaaatcaaatactctcgacaaaaaaaaaagagttgacctcatgaggctgcagagaacatttgcagagtgatgattagactaaaagaaaataaatcttgacgaacagagttgcccggaatcaaattaaagatcttaccatcaccaatcgcaggcggatgtcatatgcgacaagaccataccggcggaaaagccggcgcctttggccgctccaacaagcgcacggtcgctatccatcggaagaacagcatacagagcttttcctctctatcttgagaaaataaatcgtttatacatacaaggaaaaaaaagagaaaacagagacaagaatcaaataaccgtcaccggatacatccggcgaagaaaagccgccgccgccgccggccggcgaggagatcgatttccacttctccagcgcaccggccggcgccggacactctcccccacggcgagagcagaacaccatcccccgacgtcgcggatccggtgtgccagccttccagagagccgaatcgacgggggctggccggccggggagagtaccccggtggcggcggcggcggcgccgatctagggtttgccgggaggaaaaagaaaaagctttttctttcttcgcagggggagagtacgacgctatgcaaaggataggaagattagatgtggcgacaggcttttgcgatttattgcgagccacaagggcgtcatgcaccggtgcacgcggtgcacagaatcgatgcgagtgggccgagttggatccggtgacgcggtccatgagcctggtgtacgccacaaaactgccatcaatctcacaggcgaatccaatgtttgtaggcaaccacgtttgtagacaaattagaaaattaccgagagaaaaaaaaaaggtaattttggatagtactttctctctttttcttttgtgaaatgatgattagaggttttagaaacttttcctatgctacctcctctcattctaagtgcatctatgtgtccaacatttaatcatatttgaatgaattttttttattattagcaaaaatgaccgtgcgttgccacagaaagaaaaaaaagagaaaattgaattaaaacatattaaattctaattaaataaaatacaaattttctaaaatatttgggtatttttaagtaggtaggtatataattaaactaatttacaaataaagtaagcgtcagaaataaaatgatatggttggatttaatttttattaaattatccatattaattacactttttgaaattttcttggaatttacataacttaattactaattttgataatacaaacatcattttaggatttatttaaatactagcaaaaatgcccgtgcgttgctacgggtaaacaatttcatacttttaaagtatatttcatgataaaacaaattacaataaaataattaataattatatgtacttatactatatttcttgataaaacaaatcacaaaataattgaatcctaacgttcacaggtctctcacttaagcatcaaatatttctaaacaatcaagaatttttggggaaaaaaagtggcacgaactgagactagagctagacgattcattaatcgaacaatcctttccttgcatcctcttatttacctccaagcagctagccaagttcagttttgctacctcttatctcgcccagcacctcccctccctccctctcccgtgtaggcctcttggcccaagaggcccagcccgcccaagtttgtttttgtccctcccaagttgccaggtgggccctcactacagtgtcgtcttaagctcgtgaccaggctggacttcgccatcgtcaccatctcctcaagaaacataccagcgacctaccccaggcagtggcgcgtgcgtgacgaaaaaccgagcgtatcaaatacaatctgactatggacctctcaaggtccatctgttccggtgccaatgggttaggttgactggtggaggcgtaacgattgataacagtgggatgacaacggttgaccttaacaaggttggatactcggacgaaccttttgtccttgtcaatgatgtaacgcaagttttttacgtgaaggacatgtctagcaaaggaaagaagggcaaagggcctgacgagccgaagcgccacgtggttctcccaggcaaaagaaaaatcgtcggagtagagaacaagactgatgaggattacgatcagtttgatgggcaaccccctttcacggtgacggttgaccctagcatcctcctatcaaacgaagacaccccttactcacgtagcgatcacaaggaaggaacgataatgaggagaaagtatgtgcggacaaccgtcaccaccgatctattgccgtaattgttgtaacctattttggatgtattgaatatgctagttatatatgattaattacaatttttaacaatttaatatcatgcatatactaattatatacgattattagaatttttaaaagttttaaatcatgcatgtgggatttacatatgttaattacaatttttaacaatttaatatcatgcatatgctaattatatacgattattagaatttttaaaagttttaaatcatgcatgtggtatttacatatgttagttacaatttttaacaatttaatatcatgcatatgctaattatatacggttattagaatttttaaaagttttaaatcatgcatgtgggatttacatatgttagttagaatttttaacaatttaatatcatgcatatgctaattatatatgattattagaattttttaaagttttaaatcatgcatgtgggattaaatatgttaattagaatttttaatgcattattttctattttagaaacacatatgcaacgaaattcaatattcagtgctattaactttagtcccggttcttaaccctaaccgggtttaaaaaagaatttggaaatagcgggaaaatatctttactcccagttggtgag

SEQ ID NO: 59364 - DNA, 9409 bp, Oryza sativa
attcctgcacccccgcgtctgaagaaggagaacgctcagctgaagggtctcccagcgccaggaggagtccggatccgcactacgccccgtaagaggacgactgcacctgtgcgcatccagcttgcgcccaggaacccacctccaccagcagcccccgcagcagctccagctccgcccgcagttcctgcagctccagctccagctcccgcgttcactctctccttcgctccagcatcagccgccagaggttcagccagtggtaccggaggttggctgtctgctactcccagtggcagcggcgagactgatccgtcagactccaggagtcgctcagagggaccgggtgacgagcaggaggacgccttcgactccaccgaccgcaggagccgttccgagcattaggctcgtttttccactagttcatcgactgtctagtttttgtttgttagtttgtgtgtttaggttgcttgtttggggtcagtcgacggtcgatatcatgtgcctatgatatggctgtcttaataaggatgtttgcttgctcttttaagtgtttttaattcagatcagaacaattgcagttttaattcctatataataaagcttagttcttgagcatctgtttttcttcttttccccgtctgttcttccctccagatggtctacaccaggactggcaaccgcacgacaggcgagggcagcaacggcgaagaacgcgctgatggtgtgcaccccaacagtgattctggcaatggtccgccaccacttcccgagaacccgaccctggcccaagttatggcgcatcagactcagatgatggcagccatgatgcagcagatgcagcagcagcaccagcagatgcaccagaggatgatgcagtacgctgaacagcagcaccagcagtttggtccccctcccccgcaatccaagttgcctgagttcctgcgagtcaggccacccaccttctccagcaccaccaaccccatggaggcaaacgactggctccatgcaatagagaagaagctgaatctcctgcagtgcaatgatcaggagaaggtcgctttcgccacacaccagcttcagggtcctgcgtccgcttggtgggacaaccacatggccacccgcccaccgggtactgaagtcacatgggcagagttctgccgtagcttcaggaaggcacaggtgccagatggggtcgtggcacaaaagaagagggaatttcgtgcactccatcagggcaacaggacggtgacagagtacctccacgagttcaatcgcctcgcgcgatatgcaccggaggatgtccgcactgacgccgagaaacaagaaaagtttatggcaggcctggatgacgagctgaccaaccaactgatatccggggactacgctgactttgaaaggctggttgacaaggcaatccgtcaggaggatcagcgcaacaaaatggacaggaaaagaaaggcggcgcagttccggtccaaccaaggtagtcagcaccgaccgcgcttcactcctggacagcagggtggacctaccaccatgatcgtccgtcagcaccgcccgttccactctggcaacttccaccagggcgctagcggcagtcagaaccaccagggaggccagcccaaccgcggtgcagctccacgcccaccaatggcaccagcacagtcagcccagcccgcgcaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgtggaggaggcacaagcagcaccagaggtcgtactgggtacgtttcctgttaactcaatccctgcaacagtactttttgattctggtgcaacgcattctttcatctccaagaaatttgtcgggatgcatgggttaataagagaggaacttagcacaccgatgcgggttcataccccagggaatagctccacttcggttcaattcagcccttctataacaatagaaattcaaaggacaccgtttctagccaacctcatccttctcgactccaaaggcctagatgtcattcttgggatggattggctgaccaagtttaagggagtcatcgattgtgcgaatcgcacagtcaccctgaccaatgagaaaggagaaaccgtggtgtacaaatctctagtctcgccaaagaaaggagcctcgttgaatcagattgagacggaaatcccagtggacaccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcagaggtcaagaagcaagttgacgaacagctgcagaaagggtacattcgacccagcacttcaccttggggcgctccggtcatttttgtggagaaaaaggataagacaaagaggatgtgcgtcgattatcgcgcacttaacgaggtcacaatcaagaataaatatcctttgccgcgaatcgacgatttatttgatcaactgaaaggagctaaagtgttctctaagatagacctgcgatcaggctaccaccagttgagaatccgggaagaggatattccgaagacggccttcaccactcggtacgggctatatgagtgcacggttatgtccttcggacttactaacgcacccgcattcttcatgaatctgatgaacaaagtgttcatggaatttttggacaagtttgttgtggtattcatcgacaacattcttatctattcaaagtccgaagaggaacatgaacaacatctccgtctggtactcgagaagttgaaggagcaccagctatacgccaagttcagcaagtgtgacttctggttgacggaagtcaaatttctgggtcatgtcattacagctcagggtgtagcagttgatccatcgaacgtggagtcagttaccaagtggaccccaccgaagacagtgtcgcagattcgaagttttctaggactggctggttattaccgtcgtttcatcggaaacttctcaagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgcgtcctaatgcaagagggcagagtggttgcatatgcctcgcggcagttgcgtccacacgaaggaaattatccaactcatgacttggaattggcagcagtggtccatgctttgaagatctggaggcactatctgatcggcaaccgctgcgaagtatatacggaccataaaagtctgaaatacatcttcacccaaccagacctaaaccttcgacaacgaagatggttggaactaatcaaagactatgacatgagtattcactaccacccgggtaaagccaatgtggtggcagacgctttaagccggaaaagttactgcactgctctatgcatcgagggcatgtgtgaggaattgcgacaggagcttgaacatctcaacatgggaattgttgaacacgggttcgtagccgctctggaggcacggcctacgctcgtggatcaagttagagccgctcaagtaaatgatccggaaatagcagaactgaaaaagaacatgagagtcggaaaagctcgggatttccacgaggatgagcatggcacaatctggatgggagaaagattgtgtgtaccggacgacaaggaattgaaggatctgatactcaccgaagctcatcagacccagtactccattcacccaggcagcaccaaaatgtaccaagaccttaaagaaaaattttggtgggtcagcatgagaagggaaatagctgaattcgtcgcactctgcgatgtttgccaacgagtgaaagcagagcaccaaagaccagcaggtttactccaacctctccaaatcccggaatggaaatgggaggagattggaatggactttataacgggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagtatccgaccgaggtagtcagttcacctcaaagttctggcagaagctgcaggaagaattggggacccgtttaaacttcagcacggcctatcacccgcaaactgatggtcagaccgagcgtgtcaatcaaatcttggaggatatgttgagagcttgcgctcttgattttggtggagcttgggacaaaagcttaccatatgcggaattctcgtacaacaacagctaccaggccagtctacagatggcaccgtttgaagctctatacggccggaagtgccgcacaccgcttttctgggatcagacaggcgaacgtcaactgttcggaacagaagtattagcggaagcagaagagaaagtcagaatcatcagggaaaggttgaggattgctcagtctcgacagaagagctacgcggataaccgccgaagggagctcacttttgaggcaggagattacgtgtatcttcgtgtcaccccgctccggggagtacaccgctttcagacaaaaggcaagttggcaccacgcttcgtgggaccatacaaaattttggaacgaagaggagaagttgcctatcaactagaacttccgtccaacatgatcggcatccatgacgtgttccacgtatcccaattaaagaagtgtttaagggtacctgaagaacaggctgattcggaacacattgatatccaggaggacctaacatatgtggagaagccggttcgtatacttgacactagcgaaaggagaaccagaaataaggtcaccaggttttgccgtgttcagtggagccatcattcagaagaggaagcaacctgggaaagggaagatgagttgaaagccgcccatccgcacctcttcaccagctcctccgaatctcggggccgagattccgtttaaggggggtaggtttgtcacaccccgaagttttcctccctagtcaaaattgcaatttataattgaccccaagaaaatgcagaggaaatcaggataaaaccctaagaaaacaatgcaaataataatcggatttgacatgtggaatttttcttgaattctacatgtcgaaattcattaacaggatttttagtggaattttcagagccctagaaataattttaaccaattaaaaatcactaaagtgcaattgttaattccagggaaaatcctttttctttttctttttcctttttccccttttttccctcctttttgtccaatgggccgtcggcccatttctctttttcctccccctcctctctgttgggccggcgcaggccgaggcccagcccgacagccggccgcccgcccgcctcctctcggggtcgccgacaggtggggcccacctgtcggacccgtctccctcctcccgccgatcccgctcgtgccgccgccgccgcaaccgacgccgcgcccacgtctccgccttccccgggccacgtcgaccacgcccgcgcgtgcgccgcattccccgcgcccgttcccctctctctcccactcgcgcccgcgcccgagatggccgggattcgaaaaccgaatcccgcctctctctcctccccactcccccacgtcggccgtcgaatcccgccgctcccggccacgtccggttcccccatcccctatttaagcatcgccggcaccccctctcgctttttccccattgcgccgacctctcccgagccccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggaaccccctccccacgtgcacgggtgagcgtcacctctaccgccgccttcggccatggatcccgatcgccatggtccatctctctctctctaatccctctcttctccttccttagggcacgccggagctcgtccgctagccgacgccgtcctcccgtggcttgccgtcgccgtccgccatcgccttcctccgcgccggccaccctcggtgaggcatcccctccctccttttccccttcctctcctcctagagccgctagccgccgctctccgccgccggacgatcgccgtcggtcgttgctttgcgccgctgccgcatgcgcgccgccgccgtgtgagcgccgcgccgccggcgccatggtcgccgctgtctcgcgccgcgcccgcgcgccccggccgcgaggtcccgcgccgccgtccgatctacccttgggtagatcggggccgtcggttcggccgccacgtggcgccgccgcccctcctttccccgtgccgctgaccggtgggcccgcgcgccgccacccccttcctctctctcccggtcgctgaccggtgggccccgcctgtcggcgccgagccgcgccccctcgctgacgtcagccctggttaatattgcgcaataaaatatttaaggatttcttttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgtttgctttgtatgtcgctagattccgatctctccgacgctccggtgtacttcgagatagtcgccgaggtccctccagcagcagagcaaggcaagtcatgcttgtcacttgatcatattgatcctatattgcaaatgtcctaatgttttctttcaaatatcgcatttgttttgcaattatactatgggatggttacctattgttacagctatgccttttgataccatgctcctttgttagcttgggttataacatgattagattttggactaggaattgcttagccatgcttagttcaactagcacacattggggatctcatttaaaacctagactataggtttatatgataatgttggtttaataccaccgctctggtgttgggtaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagttcaggtggatggctgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccccattccggtatgacttgctgagtacagtgggtagtactcagtcttgctctatttttcccaaccccagaggacgggtatgtgtcagatgaaggtttccccgaggagtaggcttcgtccgtgccgtcgaggatgcctgtggagtggtgttcccgctgcggtttagtcaaggcttaagctccagtttcttttgttttccgctgcatttctgtaagacctttataatgtttgtaagacgaggatctgtatgtcaacattgtcgtttgtgtaccccggctggtcctggacgggggttttaatacacattctgcttggaattctattcgggaatttctgggtgtgacaagttggtatcagagccaggttgaccgtaggacaagccgaatggaaaaacctaagagccctctgaatccttttcattgcatatgttctttgcaattggatttgttccgggaaaattgggatctgttcttgtggttcaagggaaaaatcttggtcgctcgtttaagtgagatttttcaaaacgggtcagtctagggttttagtaaaggtattggcatttattcgtcagtcagttggggtttgaggggtgaaatgcattaggtcctagctcaggaatttgggttgcaaggtgtttatgcttcgtttgctattattaatatgtatctaatttctcattattttgacgttgtgtgagtctgtcttatttaatcgctctcatgcaaaatgatctatgcataaaatttcgctcttatttgattcccttatttgagtcctttattgctttatttaaatttggatttgagcatgcattgatcctactcctttgtcttctctagatggccggtcacccacccaaccaccgcggagaaggcatgatcgactttgttgcagagctggcacgcatgacactggtagtgggctaccccgacgcgccggagtacacgacgattccgccgctcagtggcgagcttcctcaccgtgtccgcttggaggtccatggttacgtggggacttgcctcgctaacatggcggtcgaggcgtcaggaggcacagcagatcacgcttgtcaggaggcagcctacctgatgatggccagactacgggagcgccacaactacattttccacgacacggcgtaccgctaccaccccagtcgagcccacggtgatggcgtcagctccttccgtccaacagctggcgagaacgacaccacctttggccacatgtgtgcggtgatgaggggtttggacaggatgcactcggatctgcacaaggcgaccaaggccttgaatgatgggaagctcatgaggatcgtcgctctgaaggacgagatagcgcgtctgaagaaggagaacgctcagct

SEQ ID NO: 59365 - DNA, 13646 bp, Oryza sativa
cgtcggtccttcctcttctgacgtaacgcaagcgtctaagtcgtagctatagatagagagcaaatgaattgtactatacatgcatgtgtatatatatatatatatatatatatatatatatatatatatatatatatatatatatatatatatgtacgtacatttactttagtgttaatatatattttggtaacatatatgtacataaaaatgttaagtgctttaaattataaatatgtgtgtaatatatgtatttatacatatatacatacgcgcatatatatatatatatatatatatataatcaaccatgcagcaaacagggccatgcaaataaaaaaaatggtacatagatctttagtcccggttggtcacaaccgggactaaagatggattagccggccacatggctgaccgatctttagtcccggttcgtgttaccaaccgggactaaagatcgatctttagtcccggattcgtagtcctggttggacaaccgggactaaatggggttacgaaccgggactacaaacgatttctccaccggtgcatattctcgagaatttcatttatcttatagcatttattggccatgtgcttatatattgttttttatagagtgtggactgtttcatttttaaaaaaaggagggtctgttgggctgaggctgttcctgacaatggaaacgctcgaaagcggctgtattggtttatggactccaacacattcatcttgacctgcacgaggtcaggtcaacctgttatcagtccgtgttgatcagatcatcaccactgggtttcctcagctcatcggcatttttcctaacagagggttgcgaagggtacctgcgaaaatcgattgtattgtagtgtccatcctaaaatataatatagtaatatattattaaattaggcaaaacaataaaatttgaataggtctattaagattcgtagacgtttaaatttatagtactactccctccttccaaaaatctgagaaatattttattctttgatttttctaaaaatcgaagtcttatttgtagtcactatgtgctaaattaaattgttgatcggaaacaaaaagtcattctaatacttattgcttgcatgtttattggttttgccactttgttgcatgaatgagttaattgcttattgatattgatgaaaaagaaataggtgtcagattttttgaaggaaggagtatttaagatggatagagtacttgctatgtagctccaaaaacagccacaaatgaaattaaggtggcaattgacctttgagtcaacttgccatgccatttcattttctactccaccatggctctttgatattctatgttgggccacccggccaacacgacgctcctcactttgaacaaatcaaacttgtgtgcaatcactattaattattagtctatcgatcgtactccctccattcacacaacaaccctatactcaaagaccaagaaacgattattattacctctttgtttaaataatcccaactaatactatacatgcacccaataaaattaagtatcttgatttaaaaattaataatctaggtgagagaatttgctattaattgtcatacatatatgcacgccttatattatgaaacacctttaaaaagtagttgcaccctatattttgaaacggagggagtatctaatattctcaagctggaggcaatcctattagctcattggagtgagccacaccaccacagactccaatttttattattttttgatcatggcccacgtaggatctacgcggctaccaatatttctctttttttaattcggagtttcaattatttataaattgtatcctactctagactttttttcaattatttcttttttaattcagaattttagttatttataaattatatttctatatggactctaaattctatttttaattttcttatttttttaatttatgtctttcagctagttctaaattccaatatagacagtaaatttttctaccaagattcctactttttaattttgaatttccgttatttttaattgtatttttatatggcctctaaactaatcttacaatattcctttttttaattccaaattcatttattaataaattatattcatgtatggactctattcttacttttccaatattccttttctattcctaatttcagttgcttctaaattgtattcctatatgtactcaagactcttctcctaatcttgcttattttttaaatttttaattttaattatgaccaaattgtacttttatatgtactccaaactatacttttatttttcttattatttaattttgtctttctgatagttctaaattcctatattgactcatctagactcttctttcaattttctattttctattgtaattactgccaaggctttgcctcgctatgtgattttcattaaaaggaaaagtatttactaaagacaattacaaggtgagcactcaaatattacaaaggttgtaaccaatcaaaaactatttgctttaaaggatctttcattctgcatatatgcaatagaacttctttcttgaacaagattctccaggcttcaaaacatggttgctcattccgaaatatcatttcatttctctctttccaaaaatatgccaggcaacaataaatttttttatattttcagttccaaatatccgttatttctaattgtatttctatatggattctaaactcatcttttaatatttctatttttttaattttgaatattagttttttctatattattttctatatggactattgacttttcttccaataattttttttaatttttaattttatttatttataaattatatttctactagaaaagatgcccgtgcgttgcaacgggtagagccaatttaatttatacatatgtatcggtggaaaaataatcacagcccattgtttcgtctagtcatgtgcttacccgaatcacttattatcaaataaaagactatttgtgtgtaaataagttctaaaatttaaaatttagcttataggaataagcataagccaaacaataaggccttcaaacacgagctcgatttgttgtccagctttatctcaagttgggcaggaattgataatggacggaatcagcaactttgatcatccttatttcagttggcatgttctttttgaaagtaaaattgattattacagattattgtaacggcatccctggtagtacgtacgatcatgtgtggagactgacttgaaatcatgctaacatatcctagaaatcgtgtcttataatacgaatagaattggatgatctgagcaactatgtatgtgatatccacacggattctgtgagtatcattcgcttggtatccacatcacacgaactctctctcgcagttcactcacgagtccactacaagagatcttatgataggtgacgtttcatttacatcacaaacgctgaatgttacgtcatgttgtgaaatctgtgacgctcacgtgacgaaaattcattcgtcacctatcatgtgtctctaatggcgttctatgacgaaaccttatttttttgtcattaatctagtgacgattcttctatcgtcataaagttatgacgtctattttcgtcactatcaaacccaaaaatcgtcatgatattccatgtggcctgttaaggcccatgtagtgagcaacctatttttaggctaggccttgtgaaagcccatgcagtgagaaacctattaatgggctaggcctattgtaagctcaattagattttaataaattcagcccaattcatctatattgaattaaatattgaacaggccatacacattcaaaaggcccaatcattgcaatgaaattgcatctgggccatgcacactcgagaaacccatatatcaatcaaatttgaaattactcgagaaaactattaatgaaattactttgaattgaatgttacgtgtgacgggaatcagatacggacgacgtaccatagttttgaaaaaaaacatcttcagatacgggcgagggcgacacaatctcaatcgaacaagcggcaaaggcaaatcgcgcacgcgagggcgtcgcgggcctaatctggcatgcagaaaatcacgggcatgagggcattgcgtgtggcaagggacacgtgaaaagcgcaggcccaattaattcacgcatgtctcggataagagggacactttgacataagataaaaggaaaggatttgacataaacattaaattaaaactaattaaaattaaaactaaaacataaaatgaaaatcgattcaaacacaaataacgtatcaaatttttaggggaaacatttttaatttttataatagtagatatggagatagagatatggatagatgaaaaaaggtcaccacgtcatctgaaggatggaattgaaggatgacgtgggacctgggacatgggccaggatacaatcgatttggggcctgcatgcaatagatccaacgcgtgggaaggaaatcatacggaaaaaaaaatcgatctcaatgaaccgcgatatacccgtacgcggggtagaaagaaaagggaagaaaaataactgcgcgcgtggatagagtccgacaacgtacgaaatattttttttgacaaaaacatcttaaacttttataatagataaagatatggattatggcttctacttttaatttatttataattccgaatttcaattagttggaaattgtatacttgtatagactctagtctcctctttcaatatttcttatcttgaactccaaatttttattatttttgaattgtatttctatatagactctatgtttttttttctccgtattctaaattatattctatacggactatagacttttcttccaacattctttattttttaatttcaaatttatttatttataaattgtatttctatatggacttgtcttctacttttatttttcttattttttaattctgaattcaattggttgtacactgtatacttgtatggacaatatcctcttacaatattccttatatttaattccgaatttttactatttttaaattctatctctatatggattctttttttcctcttctccgattaatatgagaatttctaggccgtgggagcgaacgtagatgcttctttttctatttatttaatatgttaatagatttctagttttgaaaatctaaaattctgacgctggtggaaattctctaacttatcatatcatatcttactataaagttaatatccgctaactcctaaagctcatgtcacatcatcacccactagcaattattatttagagtattttaaatcacatgcaagtgtactatatcatcactcactagcaattattatctagagtattttaaatatcacacaaacatgacatatcatttacaaatgttgtattttagaactcaatatgcaaacaatatcaaatcattatctctacatatcattttatattatttaaacatatatatctaccatttctataacgtataatatgtatttatctatatatcccgcaacaaagtgaagggtatgatcaactagttgggggtgagccacacgaccattcgtctgatgacaggtatcatcataggtcctcgcggactccaaatttttattattttttatcattttaatttttaattttaaaaataaactatcgtaaaacttatctaaaataagaaactttgagccatgccatcccgcctgacgtggcgaaacaacactaccacgtcaaccataatggacatgacaattttgttttaccacatcagctatgatggtgcagttaattgttgtgcaggttacatcattatggtcaaataatgttgtcatggtagctagaccggtgtgacaatattgttttgtcatgctattctagctggtgttgtcatgttttgagttgaaatagattctgaaagagattgtttttaaattatataggttagaaaaattcgcaagctcccacgtacctcctagttggccacacaggcaaccgaaagcaaattacgtaggacgtcggatcttcgtcaatccaaaaaatgactccactcctgctgacaagaactcgtactactacaaaaatcagtttcgctggcggccaaaatgtattttcgctagtgagttgccgccaccggatctgccctccgcgcacctcgttgccgccggacctgcagcctcgcgagttgccgccgccggatccgccctccgcgcgcctcgttcccgccggactggctgccccatgagtcgtcaccgccagaacccccgcgtcacgagttgttgctgctggacaccacccctcgcgagtcgcattgccgccggatctgctgccccgtcttggcgaagctccgccgccacccgtggacgccgccgccaatggggaaggaggagaggggcgcgcgcctatagactccgacaggcgcatgtagggaaggaggaaggggaggaggggggggggagaaggagacttggagagggcgggggtcagtggagacttccagagggtgagggtgtgcagacttttaatattgttgtagtttttcactgcagtgctctttggtggccgctagcgaaaatcgatttttgttgacggtcacttaagtggtccacctgtaaaatagggctatttttaatggcggatctcttaagataaccacttgcgaaaatagattttcaatgacggtcactaactaggaacctcctgctgtattttcaatggtgttttctattttagccgtcagcaaattaaaacgtgtggcactaggaaaatttttttttcagtagcgtcgtctcctacatcaacttactgataaattacgtagggaacatgaattttcccttgggtgcaaaaataccacttccatcttgaaccgttagatctaggatatccgtgcaagatcaagttcctccatctgtcatcgcacattttgcaaaaagttgccagccatcaaagaatgttatgcattttactccatgtagcttatagttggccaaaatgcccgacggcctggcccatagcacgaggtttgctcccagcccaaacacgataaagcccgaccggtgggctgtaaccgggcctctgtctcggcacagtgggctggcctggcacagtccaaagatcagagaggtaaaatagatgatggagccaaaatagacttattccagccataaccaaaagagtgcggaatgtaaaatatacttattacagccatataagagatgacccaaagagatgagggatgcaaaatagaatttttcaaaggaggagcacagtgggctttcgtaccttcaagccaacgccgcacgtcttattgggccgtgcctaggccaatggttcagcaagtgggctagaacggcccggcccagcgcgtaggacgggccgtgccggccggactgatgtcgacttggccatctatagtgtagctttctcttcctccattcttctgttcgagtaaaaagaaatcacagtgctaaattaatttgggagtgtattatttactacagttgatgaaccggccttaaaaacacttggttgagtaaaagaattacctatctatctatacctatattaattgggcaatttctacgagccataattagaaatatctggctatcgattccatagattaaagcatcatgaccgtatattaggtaccgtgggctctgtacagcccaatcatatctaggttagacctaaccttacataggtttgcccatattaatgtattgatctcatcccttacgtgaggacttccttcacctcctatccgttccgctagcatggccgcgcggagatcgcgacgagcggacttatttcatcccgtcgggtccttctgctcgcaaggccggtcaaagatcgcgacacgacggaagacgtcgagcagcgcatgcacgaagacgaggtagacgtgcagccaggctcacgcacgcagcgaaggtaagctgtccaacaatttttggtatttacctcatctgatcttattataaattttatgtattgagatgttgatttacaaagtttgcttgccccaaataagtccatccgtggtcagtgactaattgcagttaaaaagttccattgtagacaccgtacatcctctagtagtattaggcacttgctttaataattatagcagcagataatattgagaaaataaaacgcgaggcacaatgatataccgtttagtctattttcttaacgtgcttttcttaatatagatctgtttttaactttttatcccatgattaattctaaccctacagaatattacttaattaggtagacaggatttaaggccactaacatgatacaaaagacaccgacacaaaatacaacttgatgcaaatcatgggaaaactatatgactgactacaaaacaaattcaactttatattcataaactaagacttctgaaattattaaaccatgaaaaagttataattgagatgaaactaattaattatcacacaatatttgtgcaattattagattatgataatctataatcaagacaacaatctacagtataaatcttggtataataattctaaagttttgaattgaataaagggggaaaatacgaattttgatatgttgttaaatcacgaaattataataattaagcctgcaaactaatggtacgttgttaaatcacgaaattataataattaagcctgcaaactaatggtatatcgggtatattagttctcaaattctaaattagactaaggaaaattgtttcataacttgatactattaaagcaagaatttgtataactgagactgcatactaaggtattccagtatattagttctaaaattttgagttaagttaataacgataacaaatagagagttcaatgtgagaataaatggtacttctgaattcggaattctaaagtttaagttaatacatatttacattttgctatgctaattgggcactccacaggagtttctacattaaacaagcagatttggatgcacaataataatagcccgtgcaacgcaagggttggtgagtaagtaaaaaaacctaccttactgtccttacgtgagtcaaaaaaaaattgcacactgttaagttcgggagtaaaaaaggtactacagctgatgagttggactaaaaatatttcacgtagatgaaacgttggagtaaaagaattacaaatatttcaatctagagagtaaaaacatacatagaggacaataaagaggaaaaggaaaaatggccaccagagggccaccgtccatgagcatggccatgtaggcatcgccgtgtcagagatgtttgcggcgagccattgacaccaaattcgatattggagatgagcgaaccaagccaccggcaccaatgggaactgctggcgtggaggatgggtgagggaagctgccggtataaggggaagtgcgaggtaggcaattccatcgatggcaatgagtgggaacaactaatctgtcgatgcaaggggacatgaccgaaggtgacagggatggtcgttaggcaacagaacgtgcgactcttgatcctctcgcacgtaggtaggcaattccatcgatggcaatgagtgggaacgactaatctgtcgatgcaaggggacatgaccgaaggtgacagggatggtcgtcaggcaacagaacgtgcaactcttgatcctctcgcacgtacgttagcgagagtaagagggacagaggaaatggaagcaagagggactaaaacgaaaatacttctagtggaggtggtggctttttgcaaaatatgtggtgggaatgaagagctcagggcttatttggttgctaccctagcctaggggctctcgctcaggcaggtcaatccacctgcagacgcacaaaatcggatgcctgagagctgcactgagtcaggcgagatttctatggcacgaagcaaacaggccctcaatctgggccatacatgataaatcgatccaacaatggagaatggtagttgcattattgcatcaattggtgctattgcacatgatactcattcttttcccttcaatcctctctcgatccgctccccgcttccctcttttctcggttagaacccgaatctccagtgggaaacatgctccacctccgggagagaatttactatttgccatcctcccatatgcacatatatccaaacatcactctccctaattttcattctcatttgtcatccggtcccacatctcatttgcccaaatagggaacgaggttgacatgtggactcggatggcaaatatctctatatatctaaatccacgcagattagcgtgcgattagcgaggccacatggtgctgcgtggttcgtgcatacgcttttcccgcgaagggctaaaatataaaatatgatcttgtgaaggagtaaaatgtaaaaacgttagcctctcgtcttctcccgaaggttcgaactcatgcctcttccccttccaatcgttctcatctcgacgcctcccttttccggtaacggtgccagcgagccgacggtagggatcccagcctacggcggagcaagagaagaacggcgacaaacatcccgtccacgctctcgtccaccgacggtggcacggtggagactcgtccgatgtcgcagacgaaggcgtggtgatcgaccgcctccgccggtaaaatggacgaagaggcacagccaagctcctcgttgatagtgtccgtgcaaagcccgcagacatacctcccctcgtaccgcgcccgaatgctagcgatatggggccgtgcaatccgccgtgaatccgcagcagtcacagctccccgccccgacgaactcccctcctgggtcaccaaagccagcaccgctgccggtgctcgcttcgccccccacgtcggtggcggcatacgagcaagagcaaaccaatgtagacgatgtcttctccaaaaccaacagctcgggtaatttattcacaggtattttgatttttgaaacttttggagaaatcactgatttttacatgccaaagctgaccaaatttggaatcattttattgacaggtacatgatgtttgattagcggctatgtattctctgtgatatcacgattaagtaccaatacaagtagagacactcttccggtgtactagttaattacatttaatttggttctgataaggacgattgtctaaactaatactaacgctagctaacattctctggactcctttggccttctctaattaggcatgcatcttataagagactggatatggaaggtgcagattgaatataagttagcacagaaaaattatttaaaataggattcttcttatttgtcacaatcagcagtaaatggaactacaatgtgtaggaacatgattggaagggccgtcgtgaaattgtgttcatcacatttcagagtgcaggtacatttgcagaaatcctccatcattctttaggctttaatattactttgttgtctgcgaagaacaatcttaacataatgaatctttatttaatataaaaatggaattgtgtcctcaatctttacttcatttctgtattctttaagcatgattgcttttccgatggtatcttatcttgaatagtctctgtgttaggcatttattctattttttggagtatttgttaccaccagaaatcatcggaaccaggatgaaaatgtcagatatcctccgagcaggacctctcagggtggttatggtgcatataatgcatacatttaagctattatcatatctatctatctatacctatactaatcgggcacttttttggagctctcacgttaaccagaaacatctaaccattgattagatggattgtaaaatcatggccgtacattgaaatctgtgttatcatgggcttttttaagcgaatccaacgtgtatagagagtccctctattatacgtattgttaactacctacattgatatggatatccaatctgttaatatatctggacgtatcctatctccagttatgtcaatagatcgggctgtgttaaccacgtacgtacgtagcctagctgatgccgatcggaattaatggcggattaggcagcacgatatgcaaccgaggcatcgtcgtgaggagcgaccattcgatggaatcgtccggcaagacggtcagccccatcatattcatgatttccaggttcgaccgctcctggccggggcttcatccatggtactaacaagttcttcacttttcaatttattttaattccgaataaaaattaacaactgagtagatgaggaacaaggcaacatgtatgtgggatgatggaactgtcaacagcagtgcaatcatacagggtaagaaaaatacagcttattccctttggttctgatctgttaatgtcactgtatacatatattttctggaacatatttttaattttgtttgaaattattacgatctttggcgtatcgatagagttattttatcacggtcgactgacagtaaaaatttattagttcaccaaagattaagttgtttcataataattttgaagcaggcaacttacatatcgatttatagtttttctgaacataaacaagcattttgttctctctatacgccaggttgtgtaatgtgcaattgaactactttaaaaaccattttcgcaggtatccctttactacgttctttttgccgtacttctgtattctttttcgttggaaaatagctttcttcgttttggtaaaaaaaagttttcgtcagattctatggaataattcaataaaatgtgaatactactatttgaagatttgcttcaattcaattagtcatgaatatttactcaggcacccatctgtattccttctaaatagattttcaagccaataatatataggaaaagatatatctatatattattgattaaaataatgtatcaagacacatcacagcttcctaattgttaaaattacattaataaataaatgaaatactaaaattcagacccctaataggaggacgatctcatattttcaattctaatttacagaattattaaataaaaaattacgactccaaggagagttcaatttcgtatgtattaactgtgagtccacattatctatgatttttctattttgagaactattaaattagaaaataaaaaaactagaaaaaggatatagaaaagcataaataatgcatttggtactccagtactttgcataaaagcgagtgtcgttgtggagtaagattttgtatatattattattatcaaaattcacaattactttaaataggaaattaaattacttggtttttattaatctatttgtcaattaaaaatatataattctatgtataaatccatttatacattatatatatatggtagttctgtgtgaaaatcaagattcttttaaagtcgatctccactcaaatccgctaatatgaaatcaactaattgcctttatgagatatttttgaaaataaataaccaatattctagcatatgattaaaatttttaaaatattaatatagcccgtgcaacattcttacaaacattctcaaacgcaggtggggtacactgtgatttaatcttaattttctttaaccttcaacttattgagtcaagtggtagaggtttagagttcttttattgcacatagtagt

SEQ ID NO: 59366 - DNA, 4016 bp, Oryza sativa
aattcctgcagccctctggacagtagttagttggatcgaattatcatggccataggtaccattaaaaattaaataacaataccataattaataataggctattgtaattaataacagactactgaaaatactttggattcttcagtttatactatccacattgtaattgacatctgatttatcttttagttaaaccgatataattaaaaaataactaatgatttttctataattagaatctaaacattataatattaataataatagccgtggaacgcacgggttggcgactagtactagtaatgttgaatagtctcacattggttgtcgaagggcaaaggacttaaagatataagtgggggagcccctcacctcaatggctagcttttggggtgggaaaggccatttacgatcctacaattggtatctgagcctagctaggttaacatctctggcctgatggaccgtgggtgcctgcggggcccgtatacctgatggaccgtgggccggtggggcctggatacggtgaaggggcggtgaaggggctgagggacaccaatgtatgaagggggagattgttgaatagtcccacattatagctagcttttagggtgggaaaggccctttacgatcctaccagtaatatgcccgtgctaaatgctacggtacatttaagctttgagtgcactaactctatcttacctatccacggtcagcttatggaagtaaggctgcgttcgtttgtgtgatatagggtgagaaagcacctcgttttccacgcgcacgcttcccaaactactaaacggtgcgttttttgcaaaaattttctttaggaaagttgctttaaaaaatcatattaatccatttttaaaatttaaaatagttaatactcaattaatcatgcgctaatggctcacctcgttttgcgtatcttcccaatctcctcaatctccttctcctcaaacacaccctaagtcttctgctatgaagtaccatatgagttaacaatataattttacaaatgtaaatgatggttctgtttggtgaatggtgtcttgctttttgcctaaatccacctggaatcaaagcgggaatcaaagcgagaatcaacacgagaggactgacaacagaggaacatagtatgaacgataaatagttccctctttaccatcaactgtataaaaaaagggctaataaagggcaacggcacgggaatacgaatgatgtggagttgtagagacacaagacccgaggtagaaaagaagtttggattttatatttaatataaatcgcaatatatatgtgtttgttcaacaggtccaattgggttgaccctctactatttcgcatggcaaagccatgcgtacttctagtgagaatgaaaattaggaagagtgacatttgggaatgtgtattttaggaggatgataaacagtaaattctctcgtacctgtaactatatctgacgacttgcaatcttccactttctagatggagtacccaccagcaacttttggaaaactattttaaatcctcgagaggacattctctcgctgtttacatgtcgtctagatgattatgaaagaattcaataagatagattaatatgtgataaattactttgcaaacatgcaagaccaaattaaatttctacaagttgtaaaaaaaataattttgactgtgaatatacgctaactagacatagattatactccctccttccctaaatgtttgacgccgttgacctttttaaacatgtttgactgttcgtcttattcaaaaacttttgtgaaatatgtaaaactacatgtatgtataaaaatatatttaataatgaatcaaatgataggaaaataattaataattatttaaattttttgaataagacgagcggttcatatatgctaaaaagtcaacgatgtcaaataagaaacagagggagtatataattacttctctggagccacattatcgactggcctgtggataatagtagcgtgtgctgtctctctcataaagtaggtatgaattttagctgtacttatatgttttatattaattcgaggttgtttgaagtgtccctacactaattctaggtcaacatatatataagctataacatttcccacatttttctaagaataactagaaattagatcaatcgacaaacagaataatcgtgaccatctgatttctatatatgaagtatcgcacagattgaatcaacaaaaaaccctacatgatgttatgtacctttgaaaccttggtcacgaaggactaaaagtaactatatatatgcattaaaaattaaagtatgatgtgaattagacttcaatattaattccaatagcatattgatggcttatataggtacaagtatgctacagagtggcaatatatatgtacacatggtctttttttttttgactggaaatactgccaggactttgcctcgcagtgtgattttataaaaagaaatttttttaaaaaattacaagaggccgagaagggaaacaaaagattacactgtttgtaaccaatcaaaaactatatgctttaggggatccttcattctgcacaaatgcagaagaacatcatctttaaataaagccctccaagaacttaatgagggaagttcatttcgaaagattttcccattcctttgcttccaaatgtgccaagcagcaatgaaggaaatttctaaaaaacacttctggctgaactgaatgcgggccgaaaccaccatctaaaaaaagttgagactagagttccacacaattcccaaatgctgccagcactgctgactgaaagggcagaagagaaaaagatgctctcttgtctctctgatattatttaggcataactcacaagtgaggtcatcgttctcctttgcacaatgccgtctatcaagcatatcctttgtgttgagtctgtccctaaataatagccaagcaaaaacttttatcttcattacgcatcttgttttcactggtggagaaaggggctttactcccggttgagagcccacctatagtcccggttatacaaccgggactacgaatccgggactaaagatgggtatctttagtcccgggtgaaataaccgggactaaaaatccatctttagccccggttggtaataccaaccgggactaaagatggtgggagcagtccggttgattttttttttgctcaaatcgatctacttccaaaatatcactaatcatatccccaaatcatccacaaatcaaagtagcatcacagatctggaagaaatgcatcacagattagaaggaaatgcatcacagattacaaatacatcacatcacaaaatctcaaacaaaaaatacatcacaaatcctaaaagaaatacatcacaactcaaatacatcacagatcagatccaatatcacatacatcacagatcaaatccaatgaatcacaaattcaaaaaaaatcacaaattaaaaaaaaatccggcagcagatgagagggcgccgccggcctcctggtctccgtcctctcggcctccgcgccagcttggcctccgccgcgcccgcccggctgccgccgcgccagcccggcctccgccccgcccgcccggctgctgccgcgccagcccggcctccgccccgcgccagctcggcctccgccgcgcacgccctcctgcccgccgcgacagccccacagccgcgccgcccgctcggcctccgccccgcacgccctcctgcccgccacgcccgccctcctgcccgcccgcccgcccggccgccgcgcccacccgcccgggcgccgccgctcccgctcagccgcagctatagaagaatacagagaggggaaggggaggaacgggaggaatacagagaggggaaggggaggggaaggggaggaacgaacagaggggaaggggagaggaagggatggaggagttaatgagaggggaggagatcgagaggtctgtgcgcggatattatcgagatggcagcggctcgggttactctttactcccggttggt

SEQ ID NO: 59367 - DNA, 5128 bp, Oryza sativa
tataccaaccggtagtaaaaataattgggatctgttttaaacctgacaacttcttgaaccgggactaaaaatgatctttagtcccggttagtgttaccaaccgggactaaagatcaaaaagtgcccttcaacttttaaaccgggacaaaagatgctttttagtcccggtttttattagaaccgggactattgtggaatttggccgaccaaccaaagatagtttctccaccagtgtttccagatccaaacaaaaggccttggcaattgcacattcgagaaagtgagcttataaaacctcttagctgtgtatttgtcagagttccagatgaagaccaatcatcacccttgtcattctgcaaagagagagagaggacaattccgcttctagaacgatgaactctccataagcttgggtgttcggaggtagcaagaagtaatcctcaagaggagtagagcatatttgattaacagagagggatctttctaaagcaaccatacacaaagatgggaattcagtgcaccttatcttatcagtccaaacatcatcccagaaaagagctgatgatcctgtcctgatgtagcattttgaaattcccctgaagacatcagacagagccactatatccctccaccaaaaagagcctttattccaaaccaaatgagacactttggagtcataataagaattccagatcagttgaacccatggcagatcctgccctttgtaaaatttgaccaggtgtttaaaataacgtggtcccttatttggttctatgaaatgttgcttcgtatatatgctatggttatgtatatttattcctcttgaaccatatatgctgctgattgtatgtccagtggacagtggtgctctttatgtggtagatgagttttagtacgctcttttaaagtccccacattaagcatcaaaggcttcctttggagcaaattgtttcttggagatctttcaggtggctacttggatcctgtggaaacaaaagaaatgatcccatcttccaaaatgtgcaaccctctctctctctctctttggaaattcttcttgaaagaggaattaagtctacatttactcagacttaaaatagacaaatacaatacattgacctttctttcaatcatggattgacaacttgtaactcctctggttgttttttctatacttaactttgccacccctcttgtttttttttttgaaacttaacttgtaactcctcttgtaaagttgtgtttctgtattttaaattaaaatcactgtgggggcttccccactctttcctggtaaaaaaatggtccatatttcagctggaaattccaacattgatataaaatatctacaaattatcacgttaattaaaagataattgatatatcttacagatcaaatcatgtctataaaaaaatataagaattaaaatataaccatgtatatataaagtataaaataactgatattttgattccatttccacctagtacattgattgcttctcgactctatcagctagatgaatgtcagaccctttgttgtgtcagtatctctcttatatatcttgcctttctccatggatgtattaattggtctgtcccatatagtcgaatgcaaatgtaggccatcgctttctttctctacggtcagtcgttctgggtaagcacaatcaagctcgatcaaaccaaaacaattaaccaaaacaatttgcatggctagccaattaactaaattgtttatggtgctactaaattattgttttgtcgatcaaaccaaaacaatcaagctcaaaccaaaacaatatggtccatgtgtgtttatgtgacatagcaccttacgtgccacttaactaaatggctcctatcgcaacacccacctcttatttaacagcttaattttttagggacaattactcattggaccctattctagactctaactactaatttgaccctacttttttaactttgcttacttgactctgcttttcaaaataagaactgccatttgacgctgttttcactgtaccgttaaggtttatttaggaaacaaaaaataaatcattttatagtctaaattgactaaaatgtccctaactaccaaatcaatcctatccctaaaattctcacccggtggtccactcatcccaggccttctcaagtctcaacgacgcggctagggttcggtggaatcggcgcatggtgggggctgcggcgcaggtggcacggcgctcggtggggctgcaatggcggcgcgtggagagggcttgggcgctcggtgggaggtgcaaaggtggcggtggtggcggcggcgcagggagagggcttcggtggcggcatgacgctcggtgggggcttcagcgaccgcggtggcgggagttgcggcggtgacacgcggcgagacggtggaggcagcgtgagctgcggaggtggcggcgtggcactcgtgggggcttcggtggcagtgcgcagagagggcttcgacgtcggcggctggcgttgcggtggcgacgacgcgcaggtgcggctgcgacaacgacgcgcgagtgctgctgctgcacggcggcacgtaggagctgcggcagccacaacatgtggatgtgggagatggccgtctacatgtgtttcttttcttgtgtacagcttgagtttgatcaatgctgtcaaaattttatcaaatcgaagacaatttgtcaaacctatgttaaatttatcaacccacgtcaaaacaaagcaagcaaaacgtcaaaatcccttatattatgggacggagggagtagtaagtatataaacagacaactaaactgtatcttgttaggaaaaaaacttttcaattagcaatcattgtaaataaggttgacttattgcatttaatgaatagctgtatgtaatttagttcgacacatgtggcaatatttgacaatatgaatataatttgttctcttttgcacttggtttaaatgaatatacccaatcatgcccaacattggtaaatattttaaattgtatattttaattaattacatgtgaaattcttgtattctctgtatttaaaaatgcgaaaaagagatgcattagctatccagctttaattattcaatgttttttttcctgtgttgaaactatgaggactgatagtgatataaataataatgattccattttcagatgaataaaaaattaagtttcgtgacaattaatgagagataaatatagaacctattatggcgttgtcaaaattaaacaaatctttttgtgagataaattgaataaactcttggtgcactgtaataactttatctattgtttgatttggatgtgcatcgatctagcattagacattagctaattatatactttgcattgcaaataaacagagtacgaatttaaaaaaatcacggattaaccctgctgcttggatcagacgaacctgcttatcaggctatcagcatgtcctacggattggaaccaaaaaaattaagacacaatcatacatatgggttaatcaattgctttgattgaaaatgttttgcataacctaatatatactctccagatcgagttactcaccacggatcgattatgcgttgtcaaagcagctacctaaggtgttgcatacttgcatatgcatccgtttggagcgatcgattggaatcatagacggcgtgcatcagatcaactgtagtagagccatctctgcactcgaagccgatcttgggtcgatatggccaccgttttgagtcttagaaaaagatgtcttcgttgttgaagccccgtgaaccattactgattggtagctagggtacgctggctaggtcatcatcgaccagattaattggatgggcttaaactggcccacaatgcgcctaattaaattttttaattaaaattattaacacaatctatggctgtgatggtccaatctaattaatggtcggatctttctaattaatgtggaagctcataaaaaatacccaataagtataggtatagaggtatagatagatagatggagacatggtgagcccccagtattaaactatagtcggcctaacatcgaaaacactcgcatgatagatatggtataaaaaacatactctaggcaaacataataaattttggatctgataatatcatatggatctgacatatacgtacgataaattgcatataaaatatttcgtacctttgtagacgcatatcggatgcatctacgaaattagtatatcagttaaaaaaccaatctaccaattaccttgttgcgtactcgttcgacatcatataatttgacatcttttggtacgtcgcgggtcttggcatttggatgatctagatagatcaatttttttacgatgatgattccgatcttgaccggggacgttctctggtcatgttagatctcccatgtccaaagtcgttgaggtgtccctcgtcgcaaaatcctcatcgatgatgactagacggagcttgagatgcgagggtcctgatccattggagaacagacttcgttcgggtcacatcaccccatagccgaagtcgtcgagtagtttgttgtcgaagaatccatctcttgaactcatctcaaccggaatcttgaagcaccaaaatccccctacttggcgcgccactgtcgacatttgatatcgtgactacggtatttagacagtatgggtatcattggtactagggtatatacgagatttaggttaaacagatggagacaagaatttttatacaggttcgagccccttatcttacaggtaatagccctactcctgctggccgaagccggtgttgcttttattcatcataatcacacaaatataatgtatagtataacctatctaaccgtcgtcgacttggcagctggatcatcaacactagtcgacggtggggtagtctcccacctcgaatacgctcttgatgagatcagagatagcgctagatctctttttactgcctccgcagacaccatattgggtttttctaggcttaactctaatatcgatatctggcgatgtgtattgatttgtcttggccttgtgtatcgtgtatctctatgttgtgtgtcccctctcctcctaggggctttgtatttataccgtagatatccccttgtccacataga

SEQ ID NO: 59368 - DNA, 9959 bp, Oryza sativa
agaacgcttcactctacgtctctacgttcgacttgaatgcttggtttgcatgcccgttcgcatggattcggtttaattgtatagaaagcgaagaaaccatactgcgccaaattccttaatttgtcttatcaaaaagttttacgcgccgaattttagctgttcctatattttcaatattataattcgatatcagaagtttatcataacagtgatgcttgataccttttgctatagctgctcatcctgaattgaacatatgatggatgaggagcctcatttcttgatgatctagctgattttactgctttactagttacaagagttctaaagaattcctctgttcttatatcagctcatcctaagataagctattaatgacaggtttgatctataaattttgtgtaaacaatgctggttttatctattgttggactgaatatatgaatttctattgaataaaagactgaaagtactaagcaggattttgtgaaagagcagagtaaaggtagtatataagtactacaaataacttaacatcaatgattacgattatattggttgagatttttcgatgtgttcaattttagtatgatgaagctattgcaatgcaagtatgccctgtgatattactttttccagaaaattctttagatcctttacgtagtttcatactctttgattatcattcttctttgctacgacatttcatcaagctgttcattatcaattttgtcaatatacagaattaatactgtgtcgaaactagatttcggcaataataaaagggggtggctatcaagctggagaagtgtatgggtttggagacaaaggatttatacaggttcaggccttcttattcaagaagtaataccctactcctgtccggggatgaatccgccgagtgtcttattaattgtatgatttggagaaaatcaacatgtgcccctagaggcatccggacctcccttatatatgggaaggagtccgtgttacaaaagataatctatatccctaacgaaatatgcagatacaaataaaatacagtcgtaaccgactaagtctcaaggtatttccttgatgtacaagttgagaaacaaacccgagacacaaataagatattctatctatattcggtatcctgtactcagtccaaataccattgccgtgtagatatgggatatccataatctccacaaatacgtttgtgctttcttcatgataaagtgtactggcatcttctcgcttccaaggtgatatcaaagcttagcaaaaaaaaaaaaaaaacttggttgccacagaattggtaagttatgatccacagcttcaccagtgtaaagggttattatacttccatttagtcctattgcttttgggccaataaaaaaagatgagtaggtagagagaagatggatcgatcgagatggcatgccaggaaactatgtcgtcgtcgtcgtccttagcagcctggctgcactagtgctgctgctgccgccgttgtttgctgctgtggatgatgggatgaggagcggcggcaagtgcaccaacagctgcggcaacgtcggcttcgagtacccgttcggcgtggaggacgggtgctaccgcggcggcggcttcaacctcacctgcaaccacacgtaccagtcgcccaggctgttcctcggcgatggcagcgtgcaggtgctcgacatctccgtgccacacgggtgggcgctgatcaacaacaccggcatggtgttcaactccaccgagacgcgggtcgtcctcaacagaacatgggatcagctggtgggaggcccctactccttatcgggctcaaacaagatagctctggtaggctgcaatgccagggttgatcttcgcgcccgggtaaaagtaaaacacggcggccgcggcggcgacgacgatactggaagtaatctgatcagctcatgcactgccgtctgcccattagacctcgaggacatgactccggttttcgccatcggttctggcggtagcagcgcagcgtgctccggggttggctgctgccaagcagacatcaacttagacatcccctcttcgtacacaatccagatccacaacttgcaggagctgggaggctccatcagtccaacggatctagtgttcatatcgaaagaggagttcagctacaccaatgacatggctttcggcaacaacatcccacaggcgctcccagccctgctagattggtatataagcagtgacccatcagagtgtacgtacgaatcagcccccgattgtctcagcgccaacagcttctgccacgcttacgaccttgggtacaagtgccactgctccgatggttaccaaggaaatccatacattcgcggtggatgccatggtaagtactagtactagtaattaataggagtaatagtttgcatgccgctttatatatactacttattaatgtctttttgttactagatatcgatgaatgcaagtccccccaagattattcatgttacggcaactgcaacaacacgccaggatcgcacatttgcgactgtcctcgtggctacgagcgcaatgcttccacaccaaatggatgcaaaggtacctaattaatggattaactctcgttcatcggattaaaaatacatatatatgtatataataaacttactagccagtactacaacggtttatatctaattactattacaaacttgttactagtacgtactgtagctagctagccatctatcaattaattgcttaatttacgctgacacatgttgatcgttgcagcacgtgtgttcgctcaattagtatatgtcaataaattgaggttgttaatttcattactagctacccctgcagtgttgaaacaagaaatagcgcgtacatagcacaaaactaattaaaaagttctccctggtgtcattattatttgtaggggagcacacggtaaaattcccatgtacgttttttcctatgttgatcccacactgaaagctactccgtcattctaacattttccatgttcatattgttgttaatgaatttagacatatatatctatctagattcattaagatcaatatgaatgtggaaaatgctagaatgacttacattgtgaaatggaggaagtagctagcttgttggaaaattaattactgcgtgtttcggcaatataggcacccgcggtgtttttacatattattaattattccctaatttacacagctcacaacaagaaaagcaaattaactaataggaaaatacatatacttttctagcatgtgatcttattgatctttccatgctgtatacaattaaccagacatcgatgagtgtgggcaccgcgaaacttaccagtgctatggagagtgcattaatttccctggaggtttcgattgcctctgctaccatggaactgacggggatcccagaaaagaagggggatgccttccggtgaagcatcatttgtcaggtaataagagatatacaaaatcgtaatatatgattaatgtagcatttctatactcaccgttaaaatcttcattgataatcattgttgatagtttccttaacttgtttgctagctcgagacttaggtctattcattgggcttggggttggcagtggcacaattcttttgctcattgcagttggtgctcccttcctatcaaggaaaatgaaggtacgcaagctgaaaaggatgagacagacatttttcaaccaaaaccacgggttgctattacagcgactgatctcacaaaatgcgcacattagtgagaggatgatcctaacattaccagtgctagaaaaggccacaaataattttgatagaactcgcgaggttggtggtggaggacatgggatcgtatacaagggaatattaaacttggaggttgttgccattaagaagtcgatgatcatagtagaaagagaaataaacgatttcataaatgaagtggcaattctctctcaaatcaaccatagaaacgtagtcaagcttataggatgttgcctagagaccgaagttccattattagtctatgaatttatttcaaatggatccctagatcaacattttcatgttgatgaaccaatttcgctttcatggaaggaccgaatgaggatagctgttgaagttgctagagctttaacttatttgcattcagctgctacagtaccggtattccatagggacattaaggcatgcaacatacttcttgacaattagttaatagcaaaggtatcggactttggagcttcacgatatgtccctatcaatcaaactgaagtgactaatgctgtccagggaacgatcggttacttagatcccgagtattattatacaggccatttaatggacaaaagtgacgtttttagctttggagttcttgtaatagaacttcttactcggaaaagacccacctataggactgatcagggtgatagtttagttttgcattttgcatcactactgagacaaggacagctggttgggatactggatcctcaagtcctgaccgagggaggtggagaagtcatggaagtagcattacttgctgggatgtgcactagaatgactggacaagatcgccctactatgagagaagtcgagatgggactggaaaacttgcgagttagtaagaaacttgcttcacatgatacagcatcaagtagccttgtatctcagatggcagagcatcgcatgatagcgacaggggacatggaggaatcaagcatacagtacagtatggaaaaatagatgctgctgttattgtcatcgatgttgtcttttaggccacaatttaataattaccgtgacatatggttattgtcctttgaacaattaatgtcatttttcgttgttttctctggtttttttatataatggcctgtattttgaaagtacaattaatgttgtgttgcttgtaatcgtgtttaatattaaatttcatgtagacgtgtttaatttagtctgtgaagccatttatgtgcaaaagtaatgactttgtcaacatctgtgttttgatgtatgtttgattgaactcagtacatgtttcatgaggaaaaggatgatgtcagcaatgtgcacgtgtcttgatgtaatctaaattagcgtagtggttagtaccgaaataaaattatatatgacgatgcaaaattatctattttttcatcttgaaatctataaaaaacattagtactgcatatagatgggcatatcacctggagatagtgtttatattgattcaattatatgctggataaggaaaataataaaaaaaaagtgactataacaattttcttatcctacaccattcaattatgattatataaaaaaagttatatttttctttagtttttggaagtcctgtcagccaccattctcctgctcgtgactactggtgttcatattatatattttgggtataatcttttattggtagacgttcttatattataaaatagagcaagtagacaacttgttgatttgggtttatggggataagagtggtgatggacaggcaaactagggtgtttggttgctggccaagtataccaagtatgtttgatcaagttatcggttctagccacatattataagtcatgccaaactttccttttaacatagccccacatttcataggcacagtataatatgtagcaaagaagctaaggtgtggcttcatttttcttggtcacaactttggtaacttagtcataaatgtttggctagcttaattaggtagtgttagacaaccaaccaatcagcctcatagattgtagaagcaatgtcgttgatgctgaggtcagatcacaagagggtaggagagatacgtgcatgggagagtgggctattacagggagtgtggtactatcacattgataatgtttgtttcactggtggagaaaccatctttactcccggtttataaccccctgtagtcccggttttctaaccgggactatgaatccgggacttaagatcgctatctttagtcccgggtgaaataaccgggagtaaagatcgatctttagtcagagggatctttagtcccggttaatgctaccaaccgggacaaaagagaggataggggcagtcatggttggtccattttctttttattttctcccaaatcaagtgggatgtatatactcagatcaaacaacaaatccccaaatcgagtgtcatgcatatacctaaatcaaaccccaaatccccaaattcaaagtaacaacacaaatcattcacatcacaaatacaaatcctaagttacttacacacaaatcaaatacatcacaaatcttaaaaaaattacacacaaatcaaatgcatcacagatcgattatacatctcagatccatgcaatgaatcacaaattctaaaaaagaaattatacgtctctcaatcacaaattataaaaaaagaaagaagagccagtgcgctgccgctccgtgcacggccccgccgcccgcaccgcgcgcagccccaccgcccgctgcgcgctgtgcctcgccaaccggccaccgcgtgagagcgtgcaaggccacctccgtcgccgcccggccgccgcgtgagggcgcgcgaggccctccgcggccgcccggccgccgccgcctgagaagtcgggtggagacgggagggggtggatccagaggaggttgagaagtggggaggagagggaaggagacggatcagaggaagagatgagaggaggaagaggaagagatgggatgagtgaggagaggaggaagaggaagagatggggtgagtgcggagaggaggaggtaaaggtcggaacttattaactgatcctcccgtgcgcctcggtcctctcgatctcgcaccgcgcatgtcgatcttttttcccgattggtaacaccaaccgggactaaaaatagatctttagtcccggttggtgtcaccaaccgtgactaaagataaaggaggagtctgacaccacctgccgtcttttaaactaggactaaaaatgatctttagtctcgattgatgttaccaacccagactaaagatcaaaaagtggctctaacctttagaactgggactaaagatcatctttagtcccggtttttagtggaaccgggactattgtggatttcggccgaccgaccaaagatggtttctccaccagtgttttcaatattttctatgtgtagtgcctggaagagatctatttgttaatacgtaatattggctcataaattttgaatatttaattattatgtattgtgcattccacgtctacgactagtagcgcatgcgttattattcaaaatatgtgtccttttggataaaaatgaacgtgaaattaatttcaaaatgtcacattccacatgttggatgtagataaaactttggagggtggtgtatgaacaaaaaaaaaagagtaatgctttacccagtaatactaataactactggagaagatcaatactgaagaagtgatctttgccggaatggcaaaaaccacattagtcctggttttaatagaaaccggaactaaaattaaaattgatctttagtcccggttcaaaaggttaggggcaccttttgatctttagtcccggttggtcccggttgatgttactaaccgggacgtttaatacagtgcaatgcggccctgtctttaccaacaagtaatcaagaattaaaaatatagagagtggagcaaagtacacgtcctcggtcaaccttggacgcatttttcactgccagcgttagcgcaagaacgacctttgtagggcttatctttcttagctttcagcttgggaagagcatcatagtttatcatctctgccttatctttcttagctttcagcttgagatgatcgtccctggcgtggggctggatgcgtcgaccgattgctggctcaccgccagcatgacgcccaataacagcagtgccaccaagcccaacctcgtgctcatcttctccatttgaaagtaggtcaccctcctgggattatgagcagctagctaccttaatttgtttctcgtatgacatgcaatcgatcacatggagtgacttttataggacacagtttgcctataatatcaatggtggagatggaatttagatgacataaggcttattttagtacaagctaatcttgccttttaaccgtatacgttcccgtaataatgttgctgcgtaaatatttttgcttaatttagccagctctattattgcaatcttgaggttaatttagtatatagagcggaatcacatggaaattaataacggcagataattaatgaggacaataatatctctccttttttttcctcttttctattcatttttatctatttgctatataaagagactagaaaggagactaacgacctatattgattcaatcattgggacttcattgggcgaagctatagctatccatcggggtccactgaccccgacgatttcttgtgtacgcttcttagcccacttaattttaccgtgtaggaccccggtcgatataaacactagaccccggtaaccatattttgttacagcccgattagcaattagaaacgacacgtttgacattagcaagcaacaaataggaattagctagttctaatgattatacgtcagcccaaatgctcaatatacattttggtaatcttagcggtgagtatttgtgcatttaatgtctactttgtttagattttaattatgtccgtttttaatataatttatagacatgtcagtgcgttgcaataatctcctatgggccaatggttgctcgtagcattatttagttttctgttgggtctgttattttttcctttttttgggtttcttttagggtggatgataaattctgtagataaatagtcgagcaaagcattatggagctattcttgaaaaaaaaaagatactcctattttaaaagatctaacaatgcatcaaacactaagagggtgtttagttcccaccagggtttcccttaccgccggtaaccgcgaggttaccaggcttaccgtagggatacggtaatataaataccgcggtaacctccttaaattcaaataaatttaaaaaataatttgtatttttgataaattttgcacggtttttcacggttttccactgttaccgcggtaaccgtgcttaccgccggggtgcggtaaccctggccccgacggtttgggaaaccctggttcccacataaaaattttacaccatatcacatcgaacgtttaaacacctttcatgaagtattaaatgtaggctaaaaataactaattgcacatattgcgactaatttgcgagacgaatcttttgagcctaattgctccatgttttgacaatgtggtgctacagtaaacatttgttaatgacggattaattaggcttaaaaaatttgtctcgcagtttacagccggaatctgtaatttgtttggttattatgctacatttaacacttcaaatatgtgtctgtatatccgatgggacacggcaaaattttacccctagatctaaacaaagtttaagttagtattgaccccgacgaccatttatcctggcttcgcccgtgcttcattcggactccgattaccgcaaacttatagtcttctttgcagtagctactttatgtgtaggttcctatcgtctattcgaataacgattcaaaagttgaaattttcaaacctcactttattttttggagtttgtaatgacatggggtattacactactagtttagattggaatccatattttcaacactttgtctgttttcacatatgtactctttctaaacatgctaaatataagttaacatgtttcccctgaatttgtgttgttttattttttctaacaagctattgatgcaaaaattgaatcaacacgcgaagacctgagagcttttcttaattctaatgcaggtcctaaaatttaggttcgtagtataccagatcatacaactaacctggatttttcatattttga

SEQ ID NO: 59369 - DNA, 3928 bp, Oryza sativa
aggccttgttcggttagataaggattcaatctgggtcataaatgataattgtagtaaaaaaattatgatagatagaacaagggaccgagatttatttcagaccggaaattaatttactcataataggaataataagaggtgtggaactaatctaaatatttttgttgtacctaatatgagtaaattggttcccgagccaaaataaatctcgatctctagttatacttattataaatttattgttatacctatcattttcagcctggaacgaattcttcgtaaccgaacaaggccttaattggaattgatgaatcatccatcactccatggctccatgcaactagctaggagctgctgttgtggtggtatactcctgcaaccaacacgtacttgtacaagttggttggtgtagtggaggagccactaccactcgtagtgctagtgcctgcaccaccactcaaaatgccaccaaatggactcgatatgaatgagttgaccaatacacctgtctctctttctctgacctcgattaagaattcttgctgtttgctttcgcttcttggctgctaaaaactgtgataatcctctcctaccatatttacttcgataacgaaccatcccactattttctagccagtaacaaatcaaaatattacacattgattataaatacttatgtgtataaatacatacatcaatatcaacttacttcaatacacaaataacaaatatatttaataaataaatataaatataatgatcatttaaaaataaccttaaaaaaattatatgatcatcattttgtaacggagagagtactatgtgtgtgtgtcaatccatcacatatatgagtaatacattcacgtacgactgttctttgatagctagtaaaaaaaataattcacgactgatacagctaccggtctccttaattgctgatgctgctgctctctcctagtccctagtacattcctcttgtgagggagggaataattaatattttttaggctttgacttatttagagcaagtatagtgaagcacagttagccggggaaataactgaccacgtcacccaaatctgaggtggaagagagagaaatcctaatagagaataggacgagcgattggtgagacgctcgcttgaagcagcagaaccgagataaaaagcttcttctcagcctgctgcatgcgactaagccagcagctccttctctcccatttgctactagtacatgcaagcattaactcttatagccaacctctacgccagttcactatctgcaatgaccttctcaaatgcttaaagtgacatggccaccctattgcgccagctgccgacgaaaccattaaccatgctcttataagttaaacattttaaaaaataataattaaatttataggaaaacatcattgtcggagcgagaatcctcacactccatcgatggctcggggcaccacgggagcaaagtgggagttgacggacaaaggtgacccgaggacaacagtagccttaagacaagctttcattacctcggaacccctacggccgctgcatatgggccatggccccaaggatagcgccaggaggtctctctgaacgaatttgcttcgttaaggagatttgatatccggtcctacgtgtactcccttagcctgtcattctgcattaattgtcgggtaatacagtttctatgaacatatcactggcgatgtgggggatatggccgtgcatgcttcgccttgcttgcccacgtcaccccggagtaaaagatgtgtgacgcgcatttgctccgtattcacctgatggacccctctttttaccaacgtcgtgggctgataggtggacccttcacatccggtcaccctgcttggagggacagcaataagaccaagcatatcaacccctatgggttggggcccttttttttatgcatgcatgggactacggactccccttgacgtataaaaggagcatccgtgccacatagaaagggatcggactcaagcaaagttagtttctagccacattacaatgaacaagggttcatcctctatcacttagacaacgaagaagagtcaatgctctctcacttaagacaaaccaaacatcctcttgtaaagttcattatccatagcaatatcacatgagtatgtgtattatgttttcgagcggcatctgtataaaccacttgtctccaacccacacgcaaaccgagtacgagctcggaacctgcacactaacagaattctcaagggagggtactttgccttcccactagaagagcttattgctttgacaatagcaatatttttaacagaaaacaaacatactatcaaaatgtattttatgctacatttaataaaaataatttgatgtcatagatagtgtttagtttttctataaatttgatcaagctaaaaaattaactaagaaaaaataagtcaaatatggaagggagggagtatgactaaggaggagaaagggaatgaaatcaaatccgattaatggtatgccggatagggccttccctggcccaatccacagcagaattcagcatggagcccaacctcccgtcccccattccccttctccatctcatctcactcccaacactctctctcctcgctgccgctgccgccgccgccgccgccgccgccgcacacacgcgccggaaatgaagaagatctttggagccaagaagagcaaggacccgcccccatccatccaggacgctaccgaacgagtattctcctcgtctaggccatttgctcgcacgccatctctcttagtttgaacatttcctctctatgtgtatgtgattgaagatcaacaagaggggggagagcgtggacgacaagatcaagaagctggacgaagagctcggccgttacaaggagcagatcaggaagacacgccctggaccctcccaggacgccattaaggcccgcgccatcaggcttctcaagcacaagcgcatgtactctactctactcttactcactattctactactagtagagtatttgctactactccactatgcaactctgatgaatgtacgttgcctgtttcaaggtacgaagaacagcgcaacatgctctacaaccagacctataatctcgaccaagtcgctttcgctgccgatggcctcaaagacgctcagcagaccgtacgtactactccacatatatagcccgccttgtttgttcctactgtctccatgtctatgaattattgccgaaccattcttttgtttgttaatttatcgattcctcagatgaatgccatgaaggccgccaataaagagctcaagggaatgatgaagacagtcaagattgaggacatcgatgtatgcttctctttctctttagttgctacttactacagctaccttaccaagatattccttcctcatgtgcatttctttatcaggtgctaccatttgagctgtccccatcctgtgttttgtatcatgcccattccttgaaaaaaacttgctgtcaaatcttttcttttttatatattgaaagggaaaaacctgcttatagatttttcataaccatgcaaacagaccaattgttctctcaaggacaattgctccagtgcagatattttattgggcattgcattcctagtttcagacgctatccttcattacatttcaagctaatctgcaggatttgcctattgtttagatcatcaacacattttacaccagtatatccattgatttacaagaaaaccatacaaaaaccacaattgtcaatcttttttaagtgcggttatcaaccgcccttgaaattgcttgttggactatcttgagtattatcatcttttttcgcgtaaaacgaatgccctgatccacctgtagaatatgcaagatgaaatgactgacctgatggatgtgagcaacgaaatacaagaat

SEQ ID NO: 59370 - DNA, 6554 bp, Oryza sativa
aattatttgccattcttacggatggctaaatgatttgttactggatccatatgtctatgtcatagacatatgagaatccacatgtcataaacagcgagtgataaataattaattgtcacatcttaaaattggcatggagttaaatgtcccttcggttgagcacgcatgtcgcactggattatcttagatccttccttcaatataatcgcccgtacttactactccctccgtcccataatataaggtattttgagtttttgcttataacatttaaccacttatcttattcaaaattttttaaaattattatttattttatttgtgacttcctttatcatctacagtattttaagcacaacttttcgttttttatatttgtaaaaaaaaaattaaataagacgaatggtcaaacgttacaaacaaaaactcaaaatcccttatattattaaacggagggagtactacagctaatatatatatatacgtgtgtgtagtacgtgcatcgtatcaatcgccactagctagcaaaactagaggtgtagctagtaatttcttgttgaacatcacaacatgcatgtattgccttcaacttgttgtgcatcatcgcatgcctttcttcttgtcatgccgtgcgtacctaccactatgatgcataaacatcgatcggcagatgttccctctattaatactcctatttcctccctcctaaaatgtttaacgccgttaatttttttaaaaatatttgaccgttcgtcttattaaaaaaatcaagtaattattatttcttttcctatcatttgatttattgttaaatatatttttatatatacatatagttttacatatttcacaaaaaattttaaataagacaaacggtcaaacatgttttaaaaagtcaacgccgtccacgagcgagtattaatcgattcatccatcggcggctggctaccgacaaatcaataactgatgtaagatctatagacatgcatcctccgtatgcagtactagtacgtaggaccaaattaaattgctttgctgcccttgccctgcccggactgtcctatgaacggaaccaaccttaatctcccgattacagtacaaatggagtatcccaatgtggccgtgttcagtttcaaactttttttttcttcgaactttttaacatttccatcacatcaaatatttgaagcctaattacgccatgatttaacaatgtggtgtaacagtaaacatatgctaatgacagattaattaggtttaatagatttgtttcgcagtttacaggtggaatctgtaatttgttttgttattagtctacgtttaatatttcaaatatgtgtccgtatacttaaaatttttttttgacacacgacctaaacacacagcctacattattaatgtcctttcccgtgttgcaaaccccattccatttcattcatcgactaattgatggaacttacttactctctccgtcttatattataacaacctataattagatagaatatttacatgttacaaagattttgattagaaaatttattcatattcattgtaccatctaatatcatatttgatcatagattattatattatgggacagccgaagtagtactccctccctccgtttcaaaatgtttgacaccgttgattttttagcatatgtttgaccgttcgtcttattcaaaaacttttgtgaaatatgtaaaattatatgcctacatcaaaatatatttaacaatgaatcaaatgataggaaaagaattaataattacttaaattttttgaataagacgaacggtcaaacatgtgctaaaaagtcaatggcgtcaaacattggagtacttatttttgttttgttttgcagcttagctgttgttttagtagagcatttgttggttggtcgttcccagcatttgtgcattgcaggtagcacaagtagtacaacctccgtctcaaaataagtgcagtcttgagtttccgcgctcaactttaataatccgtcttatttgaattttttttataattagcatttttgttactatgagataataaaatatgaatagtactgtactcatgacttatatttttaatttttttaaaaaattttcaaataagatgaacgattaaaattggacgcggaaaatcatggctgcacttatttttgttacggagggagcagtagagtacaggcagggcagggaagggcgttggtggttcatctcctctcctctgcttgtggcgcgctcattgaatattgatgctgctgcatgctacctgtatttctgtactactatctacgactacccccattaacaaactaaaatgacagctccgcactgccccaacatcattttcttgtactccatacgtctcataatataattttgagtttttactttgtaatgtttgaccactcgtcttattcaaatttttctttataaatataaaaaacgaaaagttgtgcttaaagtacgtagatgacaaattaagtcacaaataaaataaataataattttaaaattttttgaataagacgagtggtcaaatgttataagcaaaaactcaaaatctcttatattatggaacggagggagtagtattcaattcagatcagttgatttgagccgccgtcgacgatccggccggccgcttgcttcttccatattgatcgaggagacatcacatggatcatcatccaattccagcagatgagaatgagatgactagtactagtccccagatgcagatgaggagaaacaagctctcctcccacttccaaggagatatcgatgatgatggtggtgttggtgttgtggacatccgggggtcgccgatggggtcggcggagctggcgcgcaccggcgggtgggtggcggcggtcttcatcttcgggaacgagatggcggagaggatggcctactacggcctgtccctcaacatggtcatcttcatgttcaacgtcatgcaccgccccttcgccgcctccgccaacgccgtgaacaacttcctcggcatctcccaggcctcctccctcctcggcggcttcctcgccgacgcctacctcgggcgctactggaccatcgccgccttcaccaccctctatctcctgggcctcgtggccctcaccctctgcgccaccatgcccgccctccaggccccgggccaggacgagtgcgacggcttcgccaagctgctgggcaagtgccagcagccgcacccctggcagatggcctacctctacgccgcgctctacaccaccgccttgggcgccgccgggatccgcccctgcgtctcctccttcggggcggaccagttcgaggagcggagcccggtgctggaccgcttcttcaacctcttctacctggccgtcaccgtgggcgccatcgcggccttcacgctgctggtgtacgtgcagaggaaccacgggtgggcggcggcgttcggggcgctggcgctggccatggccgcatccaacgcgctcttcttcatggggacgccgctgtaccgccaccgcgtgccggggggaagcccgctgacgagggtggcgcaggtgctagtggcggcctacaggaagcgtcacatcaagcacaccacggaactgttgtacgaggtgggcggggccaagtcggcggtgcgcgggagcggcaagatcgagcacacggaggagctgaggtggctggacaaggcggcggtgagggtggagggccaagaagaaatcaataacccatggcgtctttgcactgtgacccaggtggaggaggtgaagatcctggtgcggctggcgccggtgtcggcgtgcacggtgatgctgagcgtggtgctgacggagttcctgacgctgtcggtgcagcaggcgtacaccctcaacaccaggggcctccccgtggcgtgcatgcccgtcttcccctgcctcgccatcctcctcctcctcgccctctactacagggccttcgccccgctcgcccgccgactcaccggccacccgcacggcgcctcccagctgcagcgcctcggccttggcctcctcctctccaccctctccgtcgcttgggctggcctcttcgagcgctaccgccgcgcctacgccatccgcaatggcttcctcccgctcttcctcactcccatgccgggcctcagcgcctactggctcctcatccagtactgcctcatcggtctcgccgaggtcttctgcctcgtcgccctcctcgagttcctctaccaggaggcccccgacgccatgcgcagcctcgcctccgcctacgccgccctcgccggcggccttggctgcttcttagccaccgccatcaacaccgccgtcgactccatcaccggcgacatcgacgccggacgcccctcctggctcgcgcagaacatcaacgtcggcaagttcgactacttctactggctcctcgccgtgctcagcaccatcaacctcatcgtcttcatctacttcgccaaagcctacaagtacaggatcaagccccccaccaccccacataactagttcatagtatttctacaccactacagtctagtactagtagtatctgctaagtgacattatattgatcaatcaaacaaattaagggcatccaatatcttcttttttattgatctactcctacatagtgctacctaaactattggagtacgccgatgagttttgcagcatatggcacacgctagcttcaagcgtggtaatgatatatttatcaaccctgctatacgtacgactcctccgtccgaccagtgtgtacgactggaacggctgagcacgtcgctacgcgcagcttctgcctgaatttcgtcaagctaaatccaaagcttgctatcttaatattctgtttttcgcgcatatacacacacaaaaaaaagtacagtgacatcaaaaaccataaagcacgaagtatactgtactgtccaatcattgcataaaaataaacatgctaatgtcttgtttaatctgtcgattgaaattagacttagcatttcgaagcgaagggccaacaagtttgtaggttctgcacgcctacagcccacgaagatcgacgttccgcacgttaacgttgctgcgtactccgtagtcggacaaaagtcggacgatccagtcgtgtgtgtagcattttcgtatatttatgctatatcaactttgcaattgcagttcctcataattgcattattacttgtaaagataataatgaggaggcacttttccacaaatcaggtaagctaattaaaaagtaatccagacttagacattttttgatttttttatcttgcaactgtaactgcggcaattcgtagatacttgatgtataaattattctgagtatactctgttcagcgattcctagttattattagctgtatattgtcagtgggaggctagctcttgcccttttattatgatgggaatatatatccgttaatcagctaaagtcattagcagaaggttctggcgctttaggtcttgctgttacagaacgtacggacacttggctgctgatcgaagcatgtcgatcgtgatgttgcgtagtatccgatcgatcaggtataaggaaatttattgtgtttattccgaattttagttagttttaaattcatatatggactctatacgctacttctaatattccttattttttaatttcgaatttctattttttttcttaattgtatctctatatggactctatactctacttctaatactccttacttttaattccgaatttcagttatttcctaattgtatttctatatggactctagtctcctattctaatattccttattttttaattccgaattttagttatttctaaattgtatttctatatgaactctgccttttctttttctctgattaatgtgagaatttctaggccatgagggcgaacgtggaggctctttttctatttctttaataatataatagatagatagatttctatacttaatttcaagatgaaaaataaaccatggcataaaagtcttgaccacaaaaaacactagagatcgagatggtcgactagcaccatgaatatgcaccgaatcccgtcttaaaccgtccctctttcaccaattaattagtactaaatatgcggccaggaaagttgagatggccgagttggtccaaggcgccagattaaggttctggtccgaaagggcgtgggttcaaatcccactcttaacatcccctttttttgggttttctagtagtctactaggtcaagtatcacaataataataatgtacttactactttacttaattagataaagagttcatcgtatttcaccaagtggtcgtgccggagtggttatcgggcatgactagaaatcatgtgggctctgcccgcgcaggttcgaatcctgccgaccacgttttcctttttcggttcctccaatctcagactgtagattgaacttggggaccccagctgatttagttgcattttgcccttctatttgaaattggcatgcttcattaatcacaaaaaaacttcaactcaaatacctgttgatctgtgtgtgtgggggggggggggg

SEQ ID NO: 59371 - DNA, 4380 bp, Oryza sativa
tgagtccgagatcccaggcacattcctctcagtttcaatctataccgtgatatcccatacatcttggtgaaaaaaattgatgagccagattgaagatcattctatttttatatgattttaatttttgggtttgtacttttctatctaagtccctataatttttatatttacatttgagtccctataatcttgcaataagatacttgaggtctttttttaagaaaaaataataaaagggagagaacaagggtataaaggtgcataaaaagaaaaagaaaaactacaaaaaagaaagggaaaaaagaaaaaaaaagaaaaacaataacaataaaattttgtttcccttaagtggcgaaaaaaaaccgtagatccgattcctataaaaggcaaaaaaaaaagtggtgaaaaataaaggccagatccgattcctttaaaaacggaaaaataaagtctgattcctataaaggcgaaaaaatctgaaaaaacatctaaaaaaattctccctaagaaagtggagaaaaaaatggttcgtaaaaaaatgcacgcgagaaaaaaatggaaagggcgaaacagatttcgatttctaatcagtatatatctcttctctatctctaatctaatctaactatttaaaaaaagaaaatgcacgagaaaaataaaaacggttcaaaaaaatacgtgagaaaaaagcgcaaaaaaatgctaaaaaggttttccatcttccattaaaaaaacgtgcaagaaatattatttccatcgtcggtaaattttttaaaaaaacatgcaaggaaaaaaatgtaagaaaaaatgcgccatttctaaaaaattattgggttaaagtctcacatgctaaccatatttgttactgcacaaaagtagaagtgttaccacataataggtgcatgttaccacttccaagtagttatgttactgcacgataatcgtagttttactatgtcagttttacgagatgaaaatcgaataggtgggctataggtaaaggctgtaggtggcttttagtgaggtctgattgatgtacgagtgttttgaacaattttatacatttggtaaaaccatgttactgcatgtatatacccatgttactgcaaattacatattctgttactgcatatggagtgctaaagttcaaaatgccaatatttgaaaagcaatatctcacaagatatgtattatttttaaaaccgttttcacaatgatgctatagtgttactgcatgtggaggatatatgggttaatgtctcacatgctaaatatatttgttacaacacaaaagtggagtgttactgcaaatgtaagtacacattaccacatgtttatgcagtaacactatccaaaaaaaaaacaataaaacacaattactgcactcttacagtaacaatgcggtgggattgtagtaacgtgcaactgacagtagtaacaagtaatgctatagcattactacttgtgaagagtcaaattctaaaaaagccaagatttgaagaacaatatctctcacgtgatgtactattttttaaaatagtttgcaccatgatgctagaaaaaaagcgcttatcaaaagtagatccatcatgactatattttaacattatttaagtgctgttactacacataaaacgtaatgttactgcacgttgactgtcgcgttactgcaccgttccgcgagacaaagcttaaaagaggtgggtggtgagaggagttaacaagtggtttgaccgcgtttgactgacgtgagatgcctttgaccgacctttgactgatgtgggagatgggtttagccctcgagagagggggtatagaatagctattctatgagtaaatcccttgtatacccatgaaaacttgcccaatctcctctatacccctcaattttactcgatcctctctgtacccctgaattttcgctttgatcccttccatgcccctcccgttaggttttcttcatttcccagttatgtgtaattgcaaatgtcgataatacccttgtagatggaggagcaacagcaggtactaggtagattgaaaaaaaattaaaaaatgttgactgcacagtatgtgtatttatgagactaataatgagtttagaacttttattgtggtattggaaaaaatgcaatacatgaaacttttcgttttgaaaaaaataatagggttggaaaatcaaaaaaattcctcagtacaaaattttggtacagtcaacaggaagcggaacttattgcggacaaaggagaaaatccattgcaaaaaatttggagcatctatacaaaaatattagcaccattaatagcaggaaggaaatgaaaagagtatccatatagaaatttgtgaaacaaaataatccggatcagtaagagcatcaagagcatacatcatcaatcaaaacagtagcaaccatacaaagcactttatcaattttattttcatcatccatacagagcacttcatatcaatctcatttccatcatccatacaggacagttcatatcatactcaatagtgtaggaaccaaaccaactttgcactccatacacaaatgttgcaaatgacaaatcaagttaactgggcagtacatcatgattataatgtcataagatccataacagtacatcactgcatcatgagaaggggatggtggcctcaactgtttcgcttaccgacaccaatgaacaacccactcctctgaacaagaaatcaatcactcatcaactgcaaatgttaaatacgcaagaagaaatttacattgctgctactcgtacgcggtgttgggtcgcgcaacgatgatagggtggtggactttggctgcacgacggcaggacgttggacagcggcgcccgcgacgggagggcggccggcggtggcctactgcgcgacgggacgggtggtggccggtggcgccccaccgcgcgactggagggcgggggccggcggtgcccctaccgcgcgacgggaggatgggggccggcggcgccccaccgcgcgacgggagagccttggacgccggtgcacgcgatgggaggccggtggccggcggcgcgctcaacgggagggcggtggccggcggcgtgcgcgacaggagggcggtggctggcggcggcgctcgcgattggagaccggcggcgcggcctgcgcgtggagaggataggggagaagagaaggtactggatctatttagctagggttcacactgccaggggtattttggtattttttgaaaatactgacaatgtaacacacaggttacgttacaaatcaaacggaaacctaacgggaggggtatagaagggatcaaagcgaaaatttgggggtacagaggggatcgagtaaaattgggaggtatagaggagattagggaagttttcataggtacacaagggatttactcctattctatacaagaccatcagggcaaaaccagctaattcgcacataccagagaacacaaggaaacagacacatatccgcacggcaatttgcaattaacagtctttcttcacttgtctgcacaaagagaaattggttttgtctttaaaagggaaaaactgaattaacctgcaggcttttcaaaatggcaactccctgcccttttatttcttcaagggtaaagaagagcgagcttgaatgatagaggataaacaaaacccaatttcttttgcagcaatacataatagctgcataaagtcacatccaattaacactgatgttccctccaagggtacaatgcaatttttcagtaacacaagggtttcaattgcaggaacaatgatgttgttcatagcacaaatgtctattaatttccaaccaaactgtgactaaggtgcaccctttgcctatttagtcttcaccttttcaccttgaaatgctgcacaaatcttcttccagctccttatggcgatcatagttggtataacaacccacgagctgtttgcaccaatgaaataagcccagaagtagaacgggctagtccagaagttgaagccatccaagtaggctgtaataaagtacaccaggcatccatagagctgaccaagacagacagtgaactggaggatatggctgtaggacttgcccgatgcgatggcatagctgcaagcagcaaactttttgtcaggtcaggtggaaactataaaccacaaaaggctatattatactcatatcaactgtctagggggcaaaagaaactcctatcaactagtacatggaatgcaggatgtacaatagtgaatagtctggcttaataaccagttacatattgatattgacgcttgcagacaggtcaatccaatgtgtaaactaacaaaaaggagaacacaaatattctgaggatagattttataggcatcaaacacatacaattcctatagc

SEQ ID NO: 59372 - DNA, 1376 bp, Oryza sativa
cacccaatttaccatttaaatttagtttttaattttattttcaacagcaattacattttagtccctatgttttctgtaatttagtggaaacagttcatcagttcttcacattattatgtaatggtcctatagaccactgatgttatgtgttaattaacataggtgtttattcaaataccctgtttcactaaatttatttgttgtcttaataacatgccttttgcatattatttcaagacatgctctactttctcgctttattaatttacaaaattctataaattttgtactttgatttagcaaattctcttaattatgtacaacataattaatggaggatttaatgcatgttccacttcacattttgacttggaaattaatcacatgtcgatggagtcctatactttggtcatatcgaccataacttaggcagcgagtatctcgcccatcatcaagtggtctacattttgagatgattacccgatggagtcctacaaattgaccgcactggtcataacctaggcagcgagcatttcgcccatctcacagaggtctacatctcacgatgattacccacatgtgttatttttcgacaatatgttttgaaaaatgagattatttgaaatttggttgaacacaaggtagtggagtcctaaacattggctgcggtatattcaccagaatatatttgcctggagactgtgttttaggcaacaagtataacttgcccactattaagagatctactccactgtttaattacttggagattatccacattgtgccacctaatttcgaattctaactcaaaattgccaggtctattacctgcatttttttcgaaacattacaaaatatgaagttttacattacgcattgagattacaatcttaatatcatatttttattaatttacctctgtaaattgataatgttaaccatgattatagggacatggcaacaaaagagttcgacgaactcgccctcaatgggactaactatcccatctgggcttctgatatcaaaatcatgggcttctgatatcaaaatcaattttgcctcttgggggattttaaatacaattgaggaacccaatgatggggacccggcagttgagcccaggaagctcaatacaaccctttttcttttgacactctacattcacaaggatctcaaacatgaatacatgttagagacgagccctctcaacctttggaaagctctaaaagagcgttatgatcaacaaaaggaactcatttggcctgaggctaattatgagtgggttcatttacgcctacaggactttaaaactgtggcagaatacaaccatgctgttcataacatttgttccaggttgaagttttgcgaacaagagc

SEQ ID NO: 59373 - DNA, 1970 bp, Oryza sativa
aacattggattctgctgtccacgacgatttatgtcttgtggcaaatgcaacatgcgattggcatgatgtaaaaaaaatgcattcacttggagcatgtatgatggatgcagatacatctaaataaatgaaagatgaatcctttcttgcaaagttaacgcatccacgtcatcaacaaaacttcaaccattcgatattttcatgagccaataagaaccatcagattccccaaatggataaagaacataaacatccttcatgaaacttataccaaaactagatccttccatacccttagaatcgattcttttatatttaccccctcctccctccccatctaccaaagcacgacccctcctctcctttgcgtgctgcgccacaccaccgcctccactccaaaccccctcgtcatcccagctgccgcatcttcctcctatcccccaccgcctccgaagttggctcctcatccccaccgtggccaaatcgaggccgccgctccatccaggccgcaccgcgttcctcatcagattcaagcaccccgcactgagctcgggggcaagccaccgcaagctcaggaatcgctggatccaaaccataccgacggtgaagatgggtggcggcgaggctgaggtaccacatgcatcctctttcactggctgagcagctcaacaattttcctctgggagcaacagagtgggatgatgcgacgccgccatcttccacttcttcctccctatccctgcacttttgcctgctcccacgcatcaggtatgggagtggagaaggtggcagcggcagggagacacccctggaatcgtggatgccaataaaaaattgcttctttccagtttagattgaaatgagcaaatagcaaaatggcatgcccgttacggtaccatcagctcatgagatagagaccctgtgaggtcataagcacatgacttcattgcaaggttagtgctgcctccttcaatgtgttacagtaaaaagttgctcaattgactcacggtgactgaacaatttggaatgaatatgcaactgtccaagtaagatgttgacctatagggatatggtgactcactgtgactgaacaatttggaatgaatatgcaactgtcaattgagatgttgacctatagggatgaattggaaagaagtacagcaagatgactgaatttactgcaaaactatgactgaattatagaagttcataaattaaggttgagtccatgggggcttagataggaggcatgattcgttttggcttgactatattttttatgctctgttaatgattctaactttcctttcgatttaccatctctttctgtttccagcaaacaaagttcctatttaagccttaatgttttgtttgcatatatgcagatccagcaaatgcttcagttaatacttggtttggtggaattcaattttgcatatatttgctgaaaggagttttagttctttattatcgattccccagttttttttcctatgaaagtaactcattttcaattagtacacgacaggagaactatatgcagaactatatgcacatgtggctttgtatgatttctggaaaccttcaacaaagaaagacactgaaacaagatgtacttagggcagtaaaacagtatgctgcggttggatatgctaataccagctttagtaatcttgaaaacactttcctggacaagcacgtcagctcatgaagttctaatatgagcctagcttgccaacatatttttttttctaattccagattgagttgcatttagataggagtatttgggctgtaaatactatttccacaattcccttctaatcatggctgttgccttcctttactaattacaagtccaaaacacagaatttaatctgtctggcaccaaaatacttttccattgcctattattccatttccgcttatgatatgaatttaaagtcagctctgtatgcgaacaaattttcagt

SEQ ID NO: 59374 - DNA, 12544 bp, Oryza sativa
caagaaaacaaaaggcactaggataacatccatttttggtcgctctagccggccggcaactgcagagacaagataggaatgcagtacgtatccatcattttttccctttttttaaaggaaagggaatacatatatatatatatatatatatatatattggtcagatgcaagaggatattatttcacgatcacattgacatgcatggcggtagtatccattcatgcatttaatggcaatgcagcgagcaagcagcatgatcgagtttctaataaaaaggagttgaaactatatatatggtataaggcaaagttattgcaagccttcctttcaaaaaaagaaaaaagaaaaacaaagggttgattaaactgatttgttgcaactcacaagtaacgtttctcagcgaagccatgttatagtccacaggtaaccatccggttttctgtgcaccattgattagatatgccttcatcccctctggataaatttcagtgatatcggtgcagttctgcataagtaaatctcggaggcaaataccaacgccatctttcgtcagttgcacgtcacaccacaagcttatgtggagcgaggaggcaaaagcgaaggcatattcactggaatcaggaaaaactcccgaaaatccacctttagcaataacaagaggagcattacctgcacacaaccaacaaattaaattttaatttcgggcggccatgcatatgctactgcaagtactgatgcatgggacgaaaaaattgactgtatgtaattcccgtcaagatttccaataaaaccgatcgaacgactcgctgcaagaactaacccaaactaaactagagctggttcagaaatcagaaattcagaattcaggtcagtcctgacatgaacagagccgggaaatactcctttcctctctctcctctatctctctctctatatatatatacacataacgattaagaggagctagatcgagcttgccgttcaaggttttgaaggtggttggcgccggggggagctcctccgcggcaacggcgacggtgacggcgacgatggttgagagtagcaggaggcagaagcagtaggaccgcaccatggggagggagccggtaatcctcgacaacatctcctccaagggccaaggctcgatcggagaaagaacagcacgcacgcacgcactttgtttggctgtaaagaggcgcatgaacgaacagaacggagcagtactgtggtctgcgtttttatagctgtctgtcagacacagtggccaaaaaaactccctaattgcgttctagtaatgtattatcagtaaacacaagcatctatcatgctaattaacaattactcaatcaacttgaaattaataaaacaacaggggttgtcggtggagtatatatgaatatgagtgggatatgaggattgaagggtgagcagtagagtgtgtttttctctgcaattaatagctagccattaattagtagtaggggtgctacaaatttatctgttttttttaacggatcggccgagtaagaggggtggatcgaggcttgaaggccagctagcaagagaatgatcagttttggtaggaggaatccgaatcttatctcatcagttcttgcttcggttgagcctttacctagctaagctacctctgtattctctgctgcgttaattagggaccatcgagcaatgctatgctcgctccggcgagtacgggggaggccggtgccattaaagctgttgttcttcaagtacagactacagagtggcgactggcgagccgctcactagtgaagaactgatttttaccaccggttcggaaccggttatagcaactggttgtagcaaatcaggactaaaatctcgattttagtaccagccatttaaccggtactaaagatgcatataaagtaaaaaaaaaatttgtaggatgcgggattcaaactcaagatctctcacctcagccctcacgcgtattactatcccacctagtacacatatctaacttggatagagatactttatttttaaactaatcctgcagacatctttcataccacttggtaacaccaatcggtactaaaaatatctttagtcccggttggtgttaccaaccagtattaataacaaccgggactaaagatcctccagcattagtctcggttggtgttaacaaccaggactaaagatgtatttttaataccggttggtataacatcaatcggaactaaagattcggttataaatctaatcgaatatttgtgttttgggtaccacgataaaagatcactggtggttggtctggagcttgttcaactccggcgagacagtgtcacccttcgtccttcgatgcacgcggttgtggtacaaatcgagatccactgtagaaactgaagagaacccctccggtaccatgtcggctcaactggccacctagtttgccccatcttctgctttttttaaacaaaacacaccaaacaatgcgatggtttgtattgatatagcatgaaaaaaaattacaagattacaaccctagaagattgtaaccaggaaaaacaaaataaacacgccacactggaagtttgcagcttctcacacaacctaggaaaagacactaccaccaagtcgatcgcaggcctacaagggtgtcgcaaaacgccccgccaaaaactgactccacacagttgattgttaacgagctttcagtcatcctcacgtacagaggttgggaagagggaaagggcaagagagaagaaaatccacttgtccctcgctccaacctgatgaggggggaatcatggcgctcgaagatgtcttcgttgccaactcgaggaaccctgacctaggctttcgacttcaacaccctcacccacttgtcgtcgccatcctagagctccacataccaagcaacttctactatccacagctccaccgcactggcgccccaccaccggtgagcgcagacccacctttgtcgggtctctcatgtggccatcgccgctcctacaatggttgccctcccactcaccgtcactgcaactggccaccaccaggtgcctctcccgctcacgtcgacctcccactgctgccgagctagtacagctggccgccgctagatgcctgttgatgaaaaatctgcgctcggccgatggtgctagatctgtgttagcgcgaaccaagtcgacgagcacaatggcctaagagatctacttagctccagtgtaggtccaaaacttgatgagatgtgggcgtgccagtcagtttgattctacaactgacaagatagataaatatgttgatcagcaaagagtcgatcggctgacaagccgatagagcgattccagccgatgtcgatagggttttatgcaatcggctatatgtccaatgtagataataatataaagacaatcggttgatcataatgtaatataacaataatataatccagtagaaattaatcggctaaaataagtgatccaatggttaaagcatacatcgattgaaggttcgatgtcattaaatccaaatgattaaataaacaatgaaacctttgttgccatcggctaaatccaacttgtatctaatccttgtgagccgatacaacgtccagataactcatcggttgaaaccacgatgaaacccttatgggcaatcaaaatgcaggctagagattatggttctaaacacgactagtgctgatgtagcgcaaagtttgaaaagaaacataatatctagacaatcaagcccttgactgatttttaagagttgtggataccttagctaatctaatctggcaaaacaatttagccgataccggcaaaaaccctaaagcagatcctaaccgatacaagtaaatcgagctaccaaactagattaactaagatatatgatatgtaggtaggcaaacatatcaaccgaatcaaagcaatccaagagattgaagcgatgcagccttaaacaacaccaatgtagccgatacgaagcaaagcaatccaaggaacatagcaggagaggcccccactgttaataaaactttattagtaagaaggcaggaatacaaagaaaattacaaagaggaaatccaactaatgactactaatttgtctctctcatttaatctaaacaataaaaggagtatatcatccttatggagctgcctccaggaagacaaagaaggaagcttattatcaaaaataaaaccatttctttacttccaaatattccaagaccctaacagaaacttttccatgaaacaaagaccatgatatcttcttttagcatccatcagcattaactccaaactgagagaggtattccaagatatgcccacattattccaacaattttgagcaaaagggcataggaaaacgaggtgaagcagagattcaattgaggtagatgaacaaagcacgcagttcaggtcacaatttggaggggcacaatgcttatggtctatcatatatttagtgttcaatctgcccattaaaagcaaccaaccaaaaactttaattttggaacttttccatagccaaatgaaatgctgacgcaatcttgtcttgattttgattacatggaaaatgctgaggttgtgcctgttgattgtcctgtctctctcctttagcaaattggagctgatatgtttggtgcttcactggaagaggtgatcccaggaggcggacaagcatgtttcctgctgaagatttaggctcttgcttgggggggggggtggggttggggttgtggagagtggaaagagaatgaaatatcaggtgcaatagcaccattcggtgtaataatgcaacttccattcctccttattggatctagctaggacgtatggcctagatcaaactcctcattcccactgcacattttgcaaaaaagccagtcgtctctattaaaagtattttctttagtccctgtagcttcctcttcttttgtctccttattctcgagacatatgtgtgagaggattgagagtcacacgtctcgccgtccgatggccatccttatctctttcaaccctatcctctggctccacttgttgccacaccagatcagccattcctacttgtcgccactgtcggatttgccctcctcgtgcatccttgaagacgtgtgttgcctcgcacttccttggcattggcagctcgccttgcccatcctctacgctggaggctctcacattggtgttgtaacaaatagcaaattaaactgaaactagtatatattttttatttttgttacaacatatagaaatcaaatttgaacatgcatattttagatagtgatatattttatattaaattatcttgttattttttttctaatttttttgttattattttagttggcatgcaaaaacctctcctctggagtggtgaaaagacttctggcctaagtgtagcatactactacaaattttgatacctctcagaatctcgagtatcaggaggttaccaaattacacgaaagtttttctacctctcggtactactcaaatgtcgaaaatttttctcttgagcatatatccaggtgtaaattacttgtgtacattttgaggtgaggagttgacaaataaaacaattttattgtacgtatttaggtggaaaagaaaaactgaataataaaatgtgccgaattttcttatgtatcacacatcataggtacaacatcgcgcttgggctgggctccgcattagattgcaatacctccaagactgcaaccggtgcgtcgtgcacgggtacatcaaaccggcgaatataatgctcgacgcgtcacgcaacgccaagctcggtgacttcgggctagctcgtctcgtcgaccacggagctgaacgccgaacgaccgtgggattacatcgatccggagttcgtcaacagccacaggccctgcgtcgagtcggacgtgtacagcttcggcgtggtgctactggagatcgcccgtacgtggccgacggccaactttgtcgtcgaggcgagcccccgcgctgctgagctttgtccgtggcatgtatgaccgtggcaacgtgctggacgcggcggatgagaggcgcaatggcgtgttcgacgagcggcagatgcagcgcgtgctggtgatcggcctctggtgagcgtgccacgacgcgacacgtcggccctcacgtctcgcaagctgtggaagctctgcgtgcggtcgacggggagctgccggtgctagctccggcgaggactggtgcagagcgttccttggtggaattacgtacgtgctgcttacggtgatctgtccgtcgaattctccacgccacatgcaacagcgtaccttacttccagtgattcaactaatctactagctgcagaagaatgaagaatcttaatgcacgcctcatggcatgtacaactctgttttcactggatgtctaggtttgaactgctgtgataaacgtcttacgtacttacgtgtgagagatgtccatttactcgcattgtgatcttctttaattttaaccttacgagtcattccatctataactgggactacctatacatttgtttaaaaaatttcttctaaaaatatcaaatataatatagtagaaatgtacaattatactgtaattatattgtaactcacatgtaactgtaatgtttttctagaaaaagaggggggcctctcccatttcattaataaaatgacagtagatttttatagagtcttgttacaaccatgtaactacaatgtaactcatacgtataacactggatagctctgcagttgatggtgcccttcagaagcagcaggaacaggaggaattgctcaagaacaagccaggcttcggctttctttgccaatatatatgaacagctggtcgatgaatggggcttcagggcccatgatcccaaccattttcttaccaaagcattctgatgctaccttcctcctaaaatttataacattgtttagttcatatttacactaaccaaaatcataaaaaagaaacaaagggagtctattctgccgaaaaaggaaagaacttgactcctctgttcctcctgcaaaaagaatgttagctcaagtggaatagtaccctaccttgcaatatgtttgaggaagaaatcatacagccaatgcctctacctgtcctgccaccagttctaccagaaaacccattcgaaagagaaactggaagtttgttcctgaaagtaatcctcctactttgatcaaggcaaagaagaagtattagagttagattagacttgtatagcctagatatttgttgtatccgtatatgtctcttatttaagagtttgttgtaatatctactgtattggatatataaatataaatcgccctccacattgggttggtgtggcgtctcataattctctacatggtatcagataccggtttccctctcctttcctaattcgccggcttctctccacgcgttgcccgtgatctcgcgacttctgctcctgccgcgatttgtttttccctcgacgagattttcgtcgccctcgacgcgtcccacccagcgtcgtgttttttcgttgtccccaccccacgccgcgccgtgccctatcaacgcgtttttgccgctcccacgccgcgcccagtccaccgcaccgtgccctgcccactctgctcgcgccgcgccttgccctctccacgccacgccgcgccgcgctctgctcgcgccgcacccctgcccgctccttgccgcgccgcatcctgctctacgcgtcgcgtcgtgactccctcttctctaagccatgtctaccgagtcttcttcctcctccacaacctcgggaacaatggcatctacgtcttccggttccttttcaacctctgccgctagcagtggggagtctgccagtgcaatctttgtcaatccttatgccaccgtcaacgtaaagactcatattccaatcaccctggagttcaagcaccccaatttcaacaagtggaaggctttcttcaccgcaatgtgtggcaaatttggtcttcttcctcacatcgatggtactgctcctcctcgacccgacgagtcggcttgggctcaagccgattgctgcgttcggggttggctcttcggctctgtttccgatgcaatcctcgatgtcgccatggaacctgaccaaacagctcgcgatctctgggtcgccatcgacgaactctttcaagcaaacaaggaaccccgcgccatctatctgagtcatgaattccactcacacacacagggtaatttgtccattgctgactactgccagaaggtgaagactgccgccgatgctctccgcgacgtcggccatcctgtcactgaatcgcagcttgtcctcaacctcctcagcggcctcaatccgcatttctccagcactgccgacaacatcgccggcgcccctgtcctgccatcctttgcatcggcgcgcaacactctgttgctcaaggaactacgcatcgccaacgacaccaaagttcagaatgagacagccatggtagcggctgcctctcctgccaacaacagcacctccggcacatgtgctgcctcctcgtcgcaacctcgcggtggtagcggtggcggtggtggctccaacaatggtggacggcgcaaccaacgccgcaacagcggccggaacaacggtggtggcggcaatggaggtcgacagaactacggtggtggtggctatgggaactctggaggcggcggtggctatggaaattctggaggtggctatcctccgcaccaagctaggcctcggcctggcggcccgtgggtctgcttcaatccatggcccgtgcaacaacaggctccatggcggcctactggaaccggcgctggcttgcttgggccctatcctcaggctcacactgctttcaccggcccatatgtttctccaccaactctaggctggcctcctgtgcagtcagtgcagcccacttgggatcaacaaggtctggttgctgcccttaatcagctgtctgtaaacagtccgaatccctgggtgcttgacactggtgctacatcacatatgtcctccaccgacggtattctcgtcactcgcctccctaattctcatactttcattactgttggtaatggtcatactattcccgttctatgtcgtggcacttcttttctacctataggaaccactaagtttgctctcaaaaacattcttgtcgccccttctttggttcgaaatttactttcagtttgacaattcactcgagacaataaatgttctattgagtttgatgagtttggtttttctgttaaggaccttcggacccggcgcgtgattcttcgctgcaatagtcgcggtgatctctacacttcacctactgccgtccctagcattgctgctcacagcttccttgccgaatcctctacattgtggcatcgtcgacttggtcatcctagctcagctgctattcagactcttcacaaattagctattcttccttgtaacaagatagatcataagttgtgtcatgcctgtcagttagggaaacacactcgtttaccgttctctcggtctcagtctagtacttcttctccttttgagcttgttcactgtgatgtgtggacctctcctgtcttgagtacttctggctttaagtattacttagttgtgcttgatgattttagtcatttttgttggacttttcctcttcgccacaaatctgatgtccatcagcatattgttgagtttgttgcctttgctaaaacccagtttggccttcccattaaatgttttcaggcggataatggcaccgaattttttaaccagaacacaacctcctttttagccatcctcggtaccatccttcgcctatcttgtccatacacttccccacaaaatggtaaagccgaacgcatgcttcgcaccatcaacaattctattcgcactcttctcatccaagcatcaatgcctccgtcttactgggccgaagcactagccactgccacatatttactaaactgacgaccatccacttcagtccacaactccattccttttcaaattttgcatcacaaagttcctgactattctcatcttcgggttttcagttgtctttgctatcctaatcttagtgccacgactcctcataaactctctcctcggtcagctgcctatgttttgacatctcacaaaggctatcggtgtttggacatctctactcgtcgtgtcttcatatctcgtcatgtggtttttgatgaacaaaccttcccgtttgcggctactgccccggctgcctcttcttttgattttcttctacagggatcacccaccgcggtcgctccatcctctttggatgttgagcatccatgccctctcccggctcccattcttaagtcgccggccactgatgatttggccgaccctgatttatatcagctggtccgtcacagaagaccgatgccatcatcatgtgctttggatccggttgtctcggtggagcacgtttcctctggtgccgatgctggtactacgggcaggagtgctgacacatcttccccaaccgaacaatcatcatcgcatgctgcacaaccaactgttttgcgtgatgttctttctgctcagcagattgtttctccgtatcggcatacttatgtgcgtcgagctccacctgttgctgttcatgggccaatccgtactactagggctttccgagctcaacaagcacaagatcagcagcgacactctatggtaactcgttctcaaagtggtacacttcgtcctgttcagcggtttaattatacagctgtgcatactgctgtttcgccggtcccttctaattaccgcagtgctttggctgatccaaactggcgagcagcaatggtcgacgagtacaaggctcttgttgataacaatacatggcgtttggtccctcgtcctcctggtgctaatatcgttacaggcaaatggattttcaagcataaatatcattccgatgggactcttgctcgacataaggcacgatgggttgttcggggttattctcaacaacatggcattgattatgatgagacgtttagcctggttgttaagccagctactattcgtgttgttctcagtattgcagcttctcggtcgtggcctattcatcaacttgatgttaagaacgcttttctacatggcaatcttgaggagactatgtattgtcagcaaccatctggcttcgttgatccttctacgcccaatgcagtatgtttgttacagaaatcgctctatggattaaagcaagctcctcgagcctggtaccagcgttttgctacatatattcgtcagttgggtttcgtctcttctgtttcagacacttctctctttatttataaagatggagaaaatattgcatattgttgctatacgttgatgacatccttcttactgcttcatcatctgcacttcttcagcacattactgctcgtctacattcggagtttgccatgactgatcttggtgacttgcatttctttccgggcatttctgtcactcaatctccagatggtttattcctttctcagcgacagtatgcggttgatttattgcgacgagctggtatgtctgaatgtcatccaactacgactcctgttgattctcgctgtaagttatctgcgacagatggagctcctatttcagatcctacggagtacaggagtcttgctggtgctcttcagtatcttactctcacacggcctgagatcgcttatgcagtacaacaggtgtgtttgtttatgcatgatcctcgtgagcctcatcttgctcttgtcaaacggattttacgttacatcaagggcacactacatattggtcttcacattggaatttcgcatcttgactcactgactgcttattctgatgctgagtgggctggttgtcctgattctcgttgttccacttcgggatattgtgtttttcttggtgacaacctagtttcttggtcttccaagctacaaactacagtctctcgctcaagtgctgaagctgaatatcgtgcagtagcacatgttgttgctgagtgttgttggcttcgtcaactacttctcgaactacatatatctcttgcttcgtctactgttgtttattgtgacaatgttagcgctgtctatatgaccgctaatccgatgcatcatcgtcaaacgaagcatattgagattgatattcattttgttcgagagaaggttgctttaggacaggttcgtgttttacacgttccgtcttctcatcagtttgctgatatcatgaccaaaggtttgccagttcagttagtcactgaatttcggtccagtctttgcgtccgtgatactacttctcccgctttgactgcgggcgggtattagagttagattagatttgtatagcctagatatttgttgtatccgtatatgtctcttatttaagggtttgttgtaatatctactgtattggatatataaatataaatcgccctccacattgggtcagtgtggcgtctcataattctctacaagaagttgcgggaggggtttgtaaactctcaagaaaacatctcctcgttatttgcatgtcatccaaattattatga

SEQ ID NO: 59375 - DNA, 1457 bp, Oryza sativa
agtctctctctctctctgccaaggacctaggtaggtcaatgcctcagccagatcccatagccataaacccttgttttgttaaagggcattcacaatgggccgacgtggcattcagcctcaacccaaaaaagcgaagactagtattcctttgcctcgtcgtccaaccgcgcgccctcctcagctcagtgggacccacaccaccgctagaggagagaggagagggggcgaagcagccgaactccaggggaggagggcgccgaccgccgcctcgcatccgcccgtcgccgtctcccgctccaagtcgtctgcccgccgccgacatgccgccgccgccctgctgctccgagcagccccgccgctcgggggggagaggagggggtggtgcgccggcgagcgcatcccgccgctcggcgctgtcgccccgccgtcgctccaccactgcttggtccggcgccgtcgccgtctccgcgcgccaggctctctgcggtgggggaaaggaagagaggggggagagagaggggaaagtgaaagagaagtgaaaatgtggtagtccaccatacctacttgtatcgtggtcttgtagattttgcactgtggaacatatggcttaacatagttgttggtctaggtgacataccaggaacaccaaagtgtggagagtggcttgtgggggtgggggcccaccaccttcattccattacacggtcgaatcgaggccccactgtaagtagaaagaaacacaagaagaagaagaagggttaccggcgggcggcggcggccatggccatgcaatggagcatcgacctcgacagggctctccgctcccgccaccccaccccggtcagtactggtacagctacccctcagcaatctcagtcaatctaatctccctagcatgcagccacgccatcgacgctagctattgcccctcgtctccgggacctcggacctagcttcttcgccccccgccttgggcctccgaaccgcgcctgttcgcccacaccatcctcgtccgcctcctcgccacccacttcaccaccgcccacaacgcccgcatcctccgcgccctcctcctccttcgccgcagcatgtgtgcaggaacccaggccgcctaccacgctgcctgcccccaggccagggcactcgcgctgcggatgttcgcccaccaaagccctgcatatccgctctctcattctctccaccttctcttcctccaatgcacggcgccactggtctatttctttctttaccatttaccactacaccagcgcaaagtttagacaccactaattattatgcttatcatttcgcaggtcaacgcggcattgtttgcggctggctgtttttaggctatcagtggatttctcttacattacacttgaagcacttccaaggttaataattgcttcaccaacaacacaagctcaaattatcatggcagcaattaagattttccc

SEQ ID NO: 59376 - DNA, 3045 bp, Oryza sativa
  unsure (1)..(3045): unsure at all n locations
cgagtaataagcttaattctttttatcaatgattcagccaaaccattttgtgtgtggacatatggaacaaagtgttgaacctgaattcccaatgccatacaataatcatcgaaagcatgggatgtaaattcggcagcattgtccatacggattgattgaatcctatgttcagggtaatttgccttcagccttataatttgagacattaatttggcaaaggcatggtttcgtgtcgatagaagacacacatgagaccatctagtagatgcatcaatcagaaccataaagtacctaaacggtccagatcttggcacaatagggccatagatatctccttgatggcgtacaagaaataaaggggttcgcttttaatttgagaaaaaaaagggtctaaaaagattttcccgggtcacatacgaggagactacaaattgggggattggggaatttggcagtgaccaaatgatgaccaatagagttgccaataatttttctatcatcccgatactagggtgcccaagtcgatcatgccaagtgtgaantgcatcaacattttgaaaaaatactttgtacgtaacatgtgcaatgggcttaatgtatgtatagtacaatcccgatgtgagagatggaattttctcgcaaatgcattngccatatctgttttgttggnntaagagaagaaattcttctcgattatccatatgggtttcaatgtgaaacccattttgacggatatctctataacttagtagggtacgggttgaatcaagatacaataaagcatccttgattgtaatttgtgtacccattgggagtgtaataattgctcatcctgagccaactatcacagtatcgcgcccagtgatagtcaaaactttgccttctctctttttgagagtttgaaagtatttgatctccctaagtatagagtttgtggtaccactgtccacaagacataattcctctccaatcggagtgatatccttagacatctataatgaaagaagaattgcttgattaagaattctttatccaatatatatacatacataaaataattaaaacatcagatacatagtatgacgtttacaaatgttaatagtacatactctaatgactagcaagtcttataaccttataatataagggagtttgtactcatcgacttattacaaccattattgttttaacaaactataggatatcaatatactgtctcaaacacactgagattaaagcagctttatctctaagtgggacgcactgagattacagtaaatctccaagtgggtccgttgagcagtattcgatgagcatgtcatccattgcagaaaatgcagcggtatcctctgggagaagagcgaggttgttctctggttcaataggagcctagtgagaactttcaacatccggtctttcttttgtaagatgaagtgagcttcaaatcttagttcctcagaagactttttcgcctttagggatttctgatacaggagaacaagatgtttttgggatgtggcaatctttagtgacatgatagtcagatccacacctgttgcaatgcctgttgctattgcaacgaggttgtggtgccttacccttctcttttcctttctatcgaccattggatttgcaccttgttgttatgttgcgttttccagtcagattcttagggttattcgaggaatttcccttgaatcctttaagtgcgatactgttggtttagtatcttgtcctccggaaacatagttgatagagttttctctatctttctgctttcgttggctcttatcgcaaaatatcaacttggagcaaatgttgtgaacagcatgattgtattctgccacagtttaaaatcctgtaggcgtaaatgaatccagccataattagcctcatgccaaatgtgttccttttgctgatcataacgctctattagagctttccattggttgagagggatcgtctccaacatgtactcatgtttgagatctttatagatgtagagcctcagaaggaaaaaaggcaatatatagctttctgttctcaactggtggatcccaatcattgggttcctcaattgcatttgaaatcccgcaagaagaaagaaaaaaatattttgatatcggaagcccaaattgggtagttactcccatcgagggcgagttcgtcgaactctatagttgccatgtccctataatcatgattatcattattaattacagaggtaaattaataaaaacatgatattgtggttgtaatctcaatgcgtaatgtaagacttcatattttgtaatgtttcgaaaagatgtaggctatagacctgacaatttgagttagagatcgaaattagatggcacaatgtggataatctccaagtaattaaacagtggagtagatctcttaatagtgggcaagttatacttgctgcctaaaacacggtctccaggcaaatatattctggtgaatataccgcagccaatgtttaggactccactaccttgtgctcaaccaaatttcaaataatctcatttttcaaaacatattctcggaaaataacacatgtgggtaatcattgtgagatgtagacctctgtgagatgggcgggttactcgctgccaaagttatggtcgatatgaccaaagtataggactccatctacatgtgattaatttccgagtcaaagtttgtagtcgaacatgcattaaatcctccattaatcatgttgtacatagttgagagaatttgctaaatcaaaatacaaaatttatagaattttgtaaattaatgaagcgagaaagtagagtgtgtcttgaaatagtatgcaaaaggtatgttattaagacaacaaataaatttagtgaagcagggtatttaaataaacacctatgctaagtaacatataacatcagtggtttacaggaccagtacatagtaatttgtacaactgaactgcttgtactaaattatcaaagatatagggactaataagaaaatgctgctaaattagaaaataaaaactaaaaaaaataaagggtaaatgggtgg

SEQ ID NO: 59377 - DNA, 3489 bp, Oryza sativa
ccaccgctattgtgcggccggcccatcggcccgagggaaaagggcgcagggggcgagggggtgttacggttagaaccctaaccgttcccctcgcggtgtgcgccgccgccgccaccgattggccgcgcgtcctccacctcttctgccgccgccgccatttcgcggcctcctcctccaccactttggccgccgtttccaccgccgcctttctcatccaccgccgatcccatttccgccgccaccttctccccctgaaacgccgccaccgctgcctccatttccgccgccgcccaccaccgcctgcatccaccgccgtctctaccgcccgccgccgccatccaccgtccgccgccgccgcatcccccatgtcggccggcggtttgccggctagagttaggccgacggccccaactcctcatcggagtcggagaccggtcgagcccttacaccgttccccatcccgccatttgagagcgtgcgggagccatggggaacggcgagccatgtggagcggaggccgggacggcgagcagtggcttcaccggcatgacggcgagacgacgatgggttgaagtaggccggctcccccgtgcgcgctgccatggtttcgttccggccggactccggtgccacgggagtgggggagcggcgttggcgtggcgtcggcgacgtcgtggcgcgggtgatggcggggttggagtagcagcaatggtgatgcggcgccgagggttgtggcggcggccactaaccctaggcccgcgcctggcatggtgatggtggcagtggtggcgactcctcgttgtacgatggaggaggtggtgcagatggcgggctcggtcatggcgaggaataccaagaacggcgtcgatcggccaagaacggcgtcgataagtaactgaaggtagacatctcgtacctttcctgttgattctttcgcttttccttgagatcaaaagcgatgtagtttcttctttcacttcgcgatctccttcgcgagagcgaaagtgctgataacatgttgaaagtgaataagattgattgagcgagagggattgagcgagagagaattgcacacaagaatgtagggaatgaatgagcggtatctttattgatcgatgcggtataatatatagatagggaaggggtggcaaccggagacgcgatggttgggaaccatcacgtccgttgccaaggagcgcctagggaaggcgcggttgccttcggttgcgatccatccttttatatggatgagatcaccctgttgtttcataacatgatcaatggatctgacaggaaccgaaaaggagaggatggtcatctggtcaagcgatgcaacaaaatttataactccgtatttttgttactgttctggtatggttcacagttggcagcgttaccggaagcttttgttggtggctatcctcgtggatccacatttggcttcaggatcagcgtctaaagtttaataaatattagtattaggatcgttacatattaaatttgtgaatatgaaccttaaggttaaccaattttgtggtttttatcttcggtataatttcatgagctattatagccttcgacgaaaattgatgagtattgaccatttgaaaaaaaaacattaaagctgagttcttatctccacttctctaacccacatctctcgttttccgcgcgcacgcttttcaaactgctaaacagtgtattttttacaaaaaaaatttatatatgaaagttactttaaaaaattatattaatccattttccaaatttattttagctaatacattgaacacagcctaatagtgttctcctgcccaacattttgtgagtactagtattgggatcattgcacaagaaattcatgaatattaacattaggaaaacagaattcataacttttataaaaaacatgaatatttttctcatgcacaaaatttggtgagcattaaaattggaatcgccatgcacaaaattcatgaatattaacgttatggaaaaaaactcatgatttttattctttagcctgtaatttcgtgagttatagcctttggccaaaatttataagtaataaactttggaaaaaaaacatgtgtggttatttatttctcacccaaaattttacgactatttgccttgggcccatacgaaacaaaattcatgaataataaccttagggcaaagaaatacatgatttttagccccctgcgtattatttcatgagttatagctcatgaattataaaaatcatcgatcatatttttaatgctcgtgaaaattttaatattaaccttttaaaaaacacggaattattttaggcctatggaaaataatattaacgctacaacatcaaattttatgatttttttatccttcaccttataatttcatgagttatatccctcaagcaaaatttattagtataaacctttgaaaaaaaatacatgaatatttatttatgacccaaaatttcttgatatttatctcaggcccatttcttgaatattaaccttattataaaaaaaattccatgaattttagtcggcctataatttcgtgaattatagaatttagcaaaaattgacgagtattaaccttttgggaaaaaagaaacgcatgaatattgctctctgttccaaaatttcacaagtattatcattagggtcgtcgcactaaggagtaaaattttcatgatttctagcctttgcactataactttgtgagttatagccttctactcaaattaaagagtattaaccttttggggaaaccatacgcatatttatctccagcgcaaaatttcatgagtatttgccttgggtcagttcaaaaaagtttcattaatatgaacgtcatgacaaaaaaatcaagatttttatccatcggcatatagttttatgagttatagccttgggagaatatatggcacggatatttattcccggccaaaaatttcttgagtatttgccttgggcccaatcgaaacaaaaaaattcatgaatactaacatttatcccgaactgacccaaggcaaatactcatgaaattttgggctggagataaataccggaggttatagcctccagtatataatttcggtagttatagcctttagctaagactgatgggtattatccttgggggggaggggggatgaatcaattttttttccaaccaaaattttcatggtattagcattgtagtcactgcacacaaaattcgtgaacattaaccttttgagcaaaaggtttgtgatttttagcggtcatccaataattttgtgagttatagccgaaatagtttcgaagaaaaatatgtgagtattattaaccttttggaaaataaatgcatgaatatttttttctcaatccaaaattttatcagtacaactattgggatcgttcgacacaaaattcatgaatattattgttaggaccaaacatttcatgattttcatcgttcgatctataatttcatgacttatagccttcg

SEQ ID NO: 59378 - DNA, 5959 bp, Oryza sativa
  unsure (1)..(5959): unsure at all n locations
tgggggcgtggtgctggtgttgaaggtgggggaggagtgtccgnacgaggacggcccggcctcctcgtcgcccatggcaatcgccccgtgtgtcgcggtggatatttgatgaggacgcggctgcggcggcgtagggttggttgcatgccttccgatttgcacgggatgtttttggttagtgatcaaacggccggagagcgagatacgccgtcgcaacgacgaaccctagctagctagagttcagtgttttgggcctttagcccgtaggctcttgaacgaaacagaggttggagatggcgtataggtatagttggccataaggcccgaggcccgaaggcccagcccatggcacgcctttttggcccggcccaagcacggcacggcccgacttgggtcgggcccgtgctggcccggcccgaccgtcgggccgtgcctgggcctccccaccggcacgctgggctggcccggcacgatgggccgacaggccaggcccggtacataaagtatagggactaaaaatagacatataaatgtaacagtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggctcggcaaggcccgaggcgtgttgggccgtgcctgggccgtgagtgcggcacgtgggctggcacggcacggcccggtgcgtcggtcgggccgtgccggcccgacaagcctcggcccaggcacggccgggcctgggccgtgccgtgccgtgccgggcggcccacatggccaactatacgtataggctcattcttgaatgaagtctctttattatcttattatggctaaagtatcgtgaatgcccgaattataaatcggggcagcctaggctggggcgcccgatcaattcggagtaaaatcgggcgctgacgttagcgtccgatttacgtgcaaaactattttaaactgatttttctcttaaattacttatcaaaatcataatccgattgtaccattaaattcgttataattaaatcttcaaaacaagaccatatatggatatattccgatgaaaaaaaatattagcttattattgaattattttttagtgttgtacgatgttccactagttatatcggaattgtttcactaagtagatcgaaaatatttcactcgtttaaatcaggtgttgtttcaccttatataaaaacaatgtttcggcaaatagcgaaagaatgtttcagttcactgcaacatttgatccacacatagtgaaacatttttcggtggaacaaaaaataaaacgaattcccttaatagagggtttccaaaatatgttggtttttttgttgcaatggaatatttcagttcactgcaacattaaatctatacatagtgaaacattgtgagtgcactaggtgaaacattttttgtggaacaaaaataaaccaaatttacttaatagagagtttccaaaatatgtggttgatttgttgcaggggaccggcactgttgtaacataccgaaaattaaccattttctaactctgcaccatgctgagtcttatgttcttaataacttcttaaacctaggaaaatataattagagggaccttctaaaactaacttgcataaaatccttctctggtattcaatttcttttgtgtttttcatttaaaaatatatttggttaaattgaggtatttcttgatttggttttaatttaaaaccttccttcgactaaaattcttttattcaaatttagtttcaaaacccttactattttttatggattatgatccaagaaaccttcccaattttgccattgaacctaaaccaaagtaattctaattttatcgggattatttgttagcccatcctttgaccttaaacatatcctttgattcttgatccaaattcttccttttgatctagccggtgatctaatttctgtggcttgatttccttctcggcacaagaataatattattacaaacattgtgaataattgctcttgtgctaagataatatattatatccttgtcatccaaatcttctttaaattcaaattctatccaaatatcctattagcctcagacaattctttgaaacccatgccatatattttgaggctaaaaatcctatctatcttcctccatttatttcctctccctctcatttgagtgcatcaaataaattccgttatattctatctctcaaaatattgcactcaaactagaaaatatctcttttggaaattatatccaaatataatttcctttcaaaattccctattcagattccttccaaatactaatctcatccaatttctatcatacaaataacctacaaaatttagaattgatttctaaatttaattgggctaaaatccctttatctcttccttttggcccatcttcctcttcggcccagcccagccgagccgccccttcctcctccgtgggcgcttccaggcgccgccatgcgcccgctactgccgccgtgcacaactcagctaccgccgccgccatattgccttcgacgccaagcaatcgccgccaacgtcctgtcgtcgccgctaaggcatcgccgccgacgtcatctgccacctcacgccgccgacgtcagcctctggagcaaaccgacatctccaaccaatcacaagccacagccggcgccgtcgccttccttctccacgtcgccgccaccaagaccaactccatcttctcctctacaaccgaccttcacaaccgacgtctgaggcctataaatagaaggccagccctccccttttctccacatatgagccgagctcctcgagctctctctctcctgttatgtctagccaccaccggccactgccgatctccctcaccggagtgtttctggccaagcccttgcgccatcgggtttgcctcgacgaggcgaactcattttcctagtttccccttcctttccccttccgaaaccaaccatcacagccacctcctcttgttgccggagcaagctcttgccttcgccgttccggtctcctccctaaccctctctaccggaaaccaccctccctgagtgcgcgttgctcgggaacgcgtgttgccgccggcgtcacagtcttctatccaccggagagccggcgcccctcctctcccttctctctgtttgttcgtggagaaagagagaagaagcaggaaagaagaagaagaagaaaaagagagaaaaagaaaaagtctgacaggtgggcccctgtacagtactactttatattttctagatttaacttgaatcctattctttagaagcccatatctcctaaaccgtagatctgattctagtcaaacttggacctaaattcatctaaattcaaaccctaccttttgataccaaatttgctatttaaatattttatttgaatttccttgatttatttaaatgtcatatgcttttcaaatatctccttttactccaaaataccctttagccagtaaaaagccgccggttggaactttacgcctttcatggagacgtttgcggtctatcggccccgatgtcgaaccgttggtcgtaaagcccggcaaaacccaaacccaaggtcaaagtgctgctccgggtaccccacgcctcaatgcgtacaactgtcggagcttcactattccctcgacctccacagcacgtcgcacaattagctctcgggctctgtgtgatcttagctgctcagccgccactcacggttgtcggagtaacacttccgccccactaaattaacctgcacccacatcttattcctctagccgatatgctgtctgctgacaccggcgagagaagacaccaaatctagtcgttatgctgttcaacactagcatcgactagcacacaaccaaaccctagctgacaccttgctagttaaatcccagttgtcatccaaattccacacccaccagtatcgcctatccaccctactctcagtcacctactctctaactacctagaacctatacataaaatatagagcctagccaatatgctgtcctatccccaatcggcctaaatataaccaaaccctagatatatactacctaaacctgccaccaaccaatattagctacatactcgcttaaccagtcatatctcttactctccgaacaaccaagacccacacatgaaatataagtgacatttgttgcttgatcccctttctatcttagcctccaaccctttagaacccagaaatattagccaataatccctataccttttaaaggagatatttataccccaaacccagcctttctcgccctttatcgctttcttattattttgtgacttttattgaatttggttctttctcttctacgtagagtctgttatattttggatggcaacctgtggtatttcaaggatcggataatcaggttgcctatctcggatttatttgcgttggagcaaggcaagttattattcctctcctttgagcataataatcctatattctatatctccagtatcttgtgcattagccatacatgattttgaatgcataacctgaatatatagcaaaccagatatatgctagattttgcttagccatgcctagttagattgcataaaatataataaacttagattggaacagtactgtagaaatggttgatttccgggtggctagtactgttccaaccgacataaaattgccaagtacatgtgaagaacatacgagtacgaccgcaattctcgtatgggcatagacctagctgattaagttatctagcaaatgtggtacctttgtatagtggttcttcttaagtcctcgcgcaggaagcaaacttacgctgagcagggcgattgcaatatttaccgaggcgcaggtaaatatttgagataaattgtgatatcacaaactgtgtgtgtattgtgaaaacctggttgagatgacgggggtctctcaaccagttctcttcaaaaacctcgggaacgccagaattcctctcgctgctgataacgctacgttcagagcgcatggggactagagttcatggaacaggtaccactgatgttagtaaccgaaaagctttgccatgacaaggctaatgtgtttggcacgtcatggattgcgggtaaagcgtacatttactgcagtaaagtataaatgaatctattcgaatagccgtgctcacggatttgagcattgggactcatatggtatttggttagaaacttaattccaaactttattaaatattgttgcatttaaaacattctaggctttattcctctatattctttgatttctgcaagtaaacctagatctactcagatattaccatttcatgcattcattattgaatataatagcttgctgagtacgttgtactcacccttgcttcaaccccctttttcagagtccaattgatgttcttaccgaagctgggagttcaatcatataagttagttccattctaacttaatcctcaagtatagactagataaatggtttaagtctatagcaaaatagtagagttgagtcattctatagcttctgttgtattaattagccacaaatttgtaaacacccataaatattttgtaataacatatccttcggagtcatgtttaaatgtatgcaatgaggatccaaattgttaaacctgtatcaatctactgatccaaggcttgatacagttttaatatgtcggtttccaaatcattagttttgggacccgacaactgtggtgggccagacactgtggtgggccagcggcatgcaggcgcacggccgcgcgctgggagcggggccggggggagcgcccaattttgctccccccgcctggtcgcccggatagcagaatccccttataaatcacaacttata

SEQ ID NO: 59379 - DNA, 1212 bp, Oryza sativa
agggccccatccccaatgccccgcatctttgtactcttgtaaagatatttctaccctatctcttcatacttatcttacctcaattcttacaaaattgcaaaacaggcacagccaaaaaaggacagcatgcagttgatgttgcagtaagaaaacaacctacctccgagatatttcttcttccctccctgttcaccttctcttttctttgcacaatccactagaaagaatactttgtacaatttttaggtggcaagcaagcagaagcaggcaacctattgatgttgtacttgcaaccaagcacgcttccaatgacactaggacagtattccaaattgaaagaaccaccaccaccgacaaagcatcatatgatgcatctaatcaacctcaacccatcacaactcgaaatccccttttctaaaaggcagagtggaagatataagactgcaagctcggtttaacaaatcaaggcgactcatgaagagaaacacatacacagattaattgttcaactgcaattgcatagcaatgggttctcacgtcaatgccaatcacaagcaaaggtacatgaattactgttctaactgcggattgatgctcgagggactgctggcaatcctagctcatccacctgcaccagatagcaccaggcaacattcagtacaagcttaaaacaggtaaactacggaccaatctaattggttcatacaaaacatggttgttttagctgttgatcaacaatgcacctagtctatgcaagaatatttgaacttgggatagtgaacaacagacactgctaactcatgaataacaacttcttaagaaaaaaggaaaggaaaattcatcattcattcctctagtacatacatgggactagatagttctcgaatcatcatgacaaagcaagcatctgaataaaaataacaataatataaactaacctgctgcctgcttactgggactgctgcaggagcggtaggtgcagctggcaaattaagctctgcatcgaaatcggattccttgtctggttgaagatacgatgggactgcacttgactcaaactccatatcagcctccaaagcatccagttctgcaatgttcaagaaacaacgacagtagatagattattatctccagccctgcaatggtcccaggaagaatgaaggcatggcaacaagctaggcaatttatggcatgaatctatgttattacttc

SEQ ID NO: 59380 - DNA, 829 bp, Oryza sativa
aaaatctatatagaaaatgactgatcagttcattcatcatactcctatatccctatatagagttcatatattactcccaaaaaggaatgcatcacatcacattattggaatgcaactgagagggtgatatataattgtaagttttctagtgaagtgcaattgaaaaataagaagaaatatattactagagtatacaaaaaagagatgatgggtgcatgtattattattgattgtcacatagctttagtttttccttcacctgatccgtgcttagcttatacagttctctcctcctaccaaacgaacaaaaaattacaaactccctgactgattgcctgcagtaccgtatcatatccatccatccatgccttcgccatggctgcttttacttgcttgcttagcttccaagatcatgagattatatcataaacacaagatgtttaaaaaggagaggagaaatatgagagagatttacccatttcaaaaaaggcatctttgcactagagtagtatagcaaaagcagtgatggcctgaccctagctaagagcaaggcaatggtggtggtggcaagtgtgatgcatggctagctgatgagaggaggaagaagaaatggctatggctaaagtagcttagcttagctatggctgcccatgccatgccatggctcgttgctgccgccttgctgttgctgctgctgctgctggtgctggtgctgtggctgtccatggtgcggtggtggtggctcgtagccggccatgccggcggcggcgttcacgtggcccatgcacgacgagtcgaagccggcgaggaggatgtcgcggtgggagaa

SEQ ID NO: 59381 - DNA, 15833 bp, Oryza sativa
ttcggttttgatcttgatttggggttgtgcttctgtggatgtaatacactcgtccactgtattgggttattgttagaatcttgatattagtttttacagcacaaactgtgtatatgcgtgttggcggtatgtcagcatttcttttcctttttgtgcttgggtttttttctttcttttttttctgtgtttggttgtcttgatttaggagggctgttgggtattggtcggtcactcgatggagatgtcgtgttggaggctgctggatcggtaccagggtgccgctgaatcggcagattcagtagtagaataagagttgatgttaagctttttgtttggagtgtatgtttggatttaactgaaaccattgcaaaaggacctgccttgggacttggaggagatgcttggagttgtagctggttgatcataggttagtaaaaaacattaattattggatctagttttcctgaactgccattttgtctttttgatgactgtaggtcagtgtactagaatttggccgcgaacggcaaaagagtgtgcgtgcatgattatatttgtaagcaatccaacagttcagttgtgtgcgatgcatacgtgctgctgttggatcttaacagaaatccgtgactgccaaaaaaggcgaaaaccaacgcaggaatgaggagaacaaagtatccggtgttcggtttcattagcaatagtagcttgctgtcgcgggatcatttcatgttgccattttgctggtataaattagccattttgctggtataaattagcaaggcgcaaaggcgtcggagacagcgataacaatcacttgttttaataattttatttttactctgctcttgttttaatacgtcgagatccggtcgttcgttcgttgttatatcagtttttggctccattcagaacagcgtgggtaataagtactcccttccctccatcccctaatataaagtattttgacattttatttgcactgtttgaccactcgtcttattaaaaaaatttgtacaaatataaaaaacgaaagttgtgcttaaaatactttggatattaaagtaaatcaaaataataataatatttttttaataagacaaatgatcaaacaatataagtaaaattgtaagtaaaatgttaaaatctcttatattagagacggatggagtataataatactgtctccagctgactctgcttgcattcatgcagagccacatcactacagcagaggcggctcttcattcttgctaaaaggttttatgatgaggaaacttgctgcaaaggcatactcgttcaaggggaggctacctacaaattctgacctaacccgtactgattgtaactatgatctatatattaatagtaagttaatatcagatctacaccttaaaatataaattgatatgatgagtggagagaacaaagcagcaacatatactaaatatcgatgactttgcatgtcgacaccttattgggtccttttatatttgattgatgatgatgtttcatctattccatgccatgccatagaagtactaactagagtactcaactatttagagaaggaacattgagtttcttttgatatcatcatggcttgtgtagcttggtcttaaatcagccatgacatgaataacgaaaatataataatactattgaggtagctctcttccctctcttggtgaaaatctcttgggcgggagatggcggtgtccttagtgtcgtaacctttatggaaatgttgtttacgaagagttcgctatgtggttttggaggctcgccagcgatcggccacacatagcggcgaccatgctatgtggttttggaggctcgccagcgatcggccacacatagcggcgaccaatttaatttagtgctgggcttcctcctcaaggtcatacgtttgtgtttttagcgcgtgttttgggtgcgcttttttttcctcaatcttaacggtatttggatgacctcctgggaaaaagtaaaaagtaatactaatacaatatggtgttgtagaaatgtactacacaatccacaacactacaaaagatccacgacactacaaaagagtaaataacacattaggaaaagttattgtcggagtacatgactcctacaatggggaagcgtgaacccgccatgaaagattcggtcaaggggcgagtcaagcctgagtcaccctcaggaatcaaatgggcacaaaaaaaatatacaggttcgagcatatacaaattcgggttgtgcggatgcgtaacatcttacgcctgtgtgtatatggaccatacgtgatcaaaacaagattacaatgagatatggatcttgtgtgagctctaatctccaaggagtcaaaccatttatccgttaacatggatcctccttttatagactaaggaaagtccatagcgccaacaaaaatatagaagcggtttccgtgccaaagagttgggtatgcttggacttgttgatgtcccctacgacaagctggttggatgttacaactttgctctccagttgacacttagcgtaggagccaggtgatctctacccattcaccatggggcccaccagtcggcccttgcgaggtggcaaggttgaatgtgctagagtgatgtgggcacgacacgtcatgccccttctattcctctagcagacgtgggcatgcgggaggctgcatgcagcgttacgtcactgagatgtaggtggatgagctgttctccaaacggctcccttctacaacagaaatcatgatgttggattggagttaagcccctaggtccatctagagaggcggagaaaaccccaaagtgagcttagggcagtggggtgtgcttggagcccagcttggagcccctaaaccctatactgcaccccagggtaaccctcgctcctcggggcagtcgtctatccggaacttatttccatgcccagggaacttagtttccttgggccctcggtgacctctctccatgtttcttcataggtttccattgtactttggatgagtttcttgaagatgtcggtgatgaatgagtttatagtgatcacctacgtcagagtggctcgaagcagttgtctgccgcctcagcacattgaaaatgtagatcttgacgttcttcttgagatcttggatgtgtagatcttatacacctcttgaagatgttgatcttgtacttcttgaatatgtagatcttgtacatctcatgttataacatatatctttgggtgccctgacgactccggaggacggggacccctattctcattcctccaatggttttaaactagactaagactaacttaatatattcacttaacactacaaagtcttgtggtgtatgcatactatcaatcttctcctttgcacgggtatatgtgccttggccaccaccactactgcccttgatggtatccatactagcccaagggtgccttcatcaacacctgtttctagggttagggtgaaacctgcatttcatggcacaatatgcgtgttgcttcttgatatttctctcgtcagagtgtcgagattagggggtggaattgtcaagttagaagtgatatcttcttgttattgtttcccttagttgtctgagatagccacaaggataatcatgaaataattgatcaggttttgtggcaatagatagttcgtatcaatctgcgaagcaccgcatggtaaagaactagtcattgtgagaagagagcagcttgtcgacatcctccctactccatactccctccgtttcaaaatgtttgacaccgttgactttttagcacatgtttgaccgctcatcttattaaaaaaattgtgaaatatgtaaaactatatgtgtacatgaaagtatatttaacaatgaatcaaatgatatgaagaggataaataattatttaaattttttaaataagacgaatggtcaaacacgcattaaaaagtcaacggtgtcaaatattttgaaacggagggagtattatctcaatctcacatgtgagctatcgatccaaattgatgaagtttacagcagcagcagtaacagtttgtttttattcagggtatagtctatttatttattttcttttcgtatttttttgcagccagcaatgggtgcgccattggcagagctgttgcaaaagaagaacaaacccaacaagaacccaaaaaaaaggagagagagagagagagagaggaagaagcaaagcacgggcaccggtggaagcgaagcgaaagtgaaagcatagagagaagagaagagccatgccccatctcgccgcctcccccacctccgccgccgccgccgcccctgcctccgcccgcgttgccttcctgcgccctggccgcgtcccccgcccgccgctgcagacagcgcgtggccttcgcccggacttgggcaccctgcgcacggcggagcagcccacgttgtacgacctactcgggatctcctcggagggcaccctcgacgaggtccgcgcggcctacaggcggatggcgcgcaagtaccatccggacgtctcgccgcccgacgccgccgccgagaacacccgccgcttcatcgaggtgcaggaggcctacgagacgctctccgaccccagccgccgggccacctacgaccgcgccctcgcgcgcggcgtctgccggcttgccttctcctcctcccgccgcgtcgccccctactactaccaggtacgtttcgtctcctctcctctcctctctagtgattttgatttgaatttgtccccaaccttcaacacaagcccattcagtttctaacacacaagccccagccttacatgatgtttgatccagcagcctgacttaatatgtctgctccatcttctcccccattcaattcaatacttgattgcaattccttctatctttcttgtatcaccgtcgtctgcagcacataactcaatattgcgcctgcatgtgcttgtgtatttgtacagattttggcttcatatatatatatatatatatattattgctcaagttcgctggatcaattcatcataactctatgtaggatgcgagtagagatttaccttttgttcaggcactagcagtgccatacatacaaataaggaaatactacatacataggcattatctcttgcgtgatgcatatagggatgcaaaattcaccctgatgcaaattatatgcatgtaggtgatgaatagtgaatgaacaattatacttacaaacaaaattgaaaaaaagaagtctttttcgtgtgcctcatagttaaacttatccaggacataagttagagaggtcgtgtcttccgtgtaaggttgaaactgggagaagctttgcttgtttggctattctgttagctgatttctactttcactcggttcatgatgttgatccgcaagttggtaatttccatttggattgtcaaaccattgtttcatatgctgttttttccatgctaacttgccacccgtgtgactcaaaaccataggatcaggaagacaagtctggctggaggagaacttggggagaccaaattgaggagctgaagaggaggagcatgacgaaggattcagaggagaacctctcctggggagctcggatgcgaagaagaaccgaaacatcatcctctgagtaactgtgatcgtaatgcttccaaagtgtaaccctagtggtatatcttttgcatcagctaaattatcataagctgttaacaagtgcaaggttagaagggtgtgctgtgctggtattaagctgtgcattttgtatttactcctacaaaagatgatgcggcaaccctatgcacaaggaatgctaagcactcctctactatagatattagtggccattctagtggtggcatagttagaagcccgtatgggggtatttgtgtcagtatactgtatacccaacccaagctatgaatgaacgatgaagtgaccaagtatgatgtgtatatttgcgtaggaggctctgcgtttccttgtgtgctctagtgtaaatatgggatatgatatcatatgagcaacttgtcaaaataagcaaagctaaggtgtatcttcaattttgaccatctactatttgtgtgttgtgccttgagtatcagggattggactagactgaacgatgaattggtgacaaaatcgtagtaataacaaaagatagttgatgtcattttcacttagcaatgaaaggctgggagggactgggagactgcctgcctctagtagttgtgaatgaatcaaggggtggtccactcaatagttggagttgagtaaataatgtgcaccagtctacatctgctagtctatactagaatccattctgacacttgtggctggtggtaaccggtgagaatgtggttttcacagttggtattttcttaaaaaaatgagtgaacattttacaagtggtcactgattaaactttttcacaaatctggtatcatttttatataaactaaatgataccctgcttttgtgatggaaaagcagacggaatatatggatgaatatatattgagtattatacaaacaatgaatagatatgttgaaatattgtggaaataatgtgaggtgtgatgattagatatatttgcatgttgatttgttgaatttaataaattataggtgttgttacaagcttggatatatagaaggtatagatggcatcacgaaatttggtcagtgtttttatacttcttaaaaagaagggagtggtggttttggtgaatctgtcaccgcccccactcgcattgtaaattttgcaagttaacccctaaacttcttataatattaaaggagattaaatctaaatggatagtcacataaaaaattagaataatatgaatatttcctatagcaaaagaatgggtaacacattaatacattttcttttatctgtagcaaaaacggaaagccaaatgtcatagctggtctgggctggactaggctttgtgatggaacggcccatataaaagcctcagtcagctcgtgggcggcttttgggcgcgacccttgcttgttttggcgccaagcgaaccagatttggcgccaaaatccccccgcccgcgccgcttcttctccctccctcccgcccgcgaatccattcagactgcaaactctgagagagagagagagagagagagaggccatgcccacacagcacctgacctctcgccgccacgctgagctactccgccatctcctcctagatggcggcgccgccgtgaaggacctccgtctccgccgtgtcgtcccgctcacctccgcgccccttgacgactcctcccccgacccggccggccctgctgccaaatctggatctgcagagacgacgccgccggaggcccaagacggccgggagcgaaagccggtaagtcttcccgactcccttcatcttcatcttcatctcagacgcacaataaaattcgttctagcttagcttggtgttggtggccatctcatctcatctcatctcatatgtgttttatccgggcggggcggattaggtcgtccagcggtcgaagctcgtgcacgccccggcctccttcggctaccgccgcttactgcctttcctcaaccaactgaccaacaccaaccaaggtagtactacaacaaacaccattctcctcctcccaactaaattaaatggcccttgtttcttcttaccccattcccttcccttcccttgcgttcgtgtggttcagaatcagaatgccctagtggcaaggacaactccaagattgatgcatatgccgaatctgaatctgaagctcaacctgatcctgtgcattgctctatcagcaccaccaaggaagaaatcaacatttcctcttctcatctttcaagcaccaagatggtgagtactgtctttgatgtctccttttggtctcccttgttatgctatattcagccagatctattcccatctcctcttctcttcaaaataaccttgtattaaaaatgtatgcatgtatgtttcagtgcctttcccggtgtcagaggtccaggtttgttcaccaccccagctcatttagctacaagaggatgctgccatttgttacggagaacggtacgatcagatgcattctcacatgacgcaactgtctacttagttcagggtatcacatcgccaatttatctcatcatgtgctactgtctactttctcagagatcacttctcaggaaggtcacaggaccaaaattccaagactcgtacaagaaaagcaatcttcaacggatgagaatcttatcttgaccactggacagcatcactttgttatgtcaggagactctgctgaggaatgcaaaacagctcaagtcgaaagattagtagaagaaaacgaatcaaaatcagacaggattcatcctcttggtggaaggctgcttcagcctgctgtttctgaagccgctcatctagaactacaagtcagtacagttgaagggcaaaatctcacacaggaaagagtgctagcttcagatgcacaccttctatcttcagacaagggtgagtgcacattgaaatggaatgatgtcctgcctgctggacagcatcagcctgctgcctcagaagacttctctgaagaaagcaacaaagcaggagttgaagcagtattagaagagaggaaatcagttccagacggaaattctgtttttgatggcagacagcttcagacttttgtttcaaaagcttctcctccagaaggcacagctgaaatgcagaaggccacacaaaaacaagcagtgacttcagatggtgatgacgaccctctagactcctgcaagggtggatctcttgccaaagagcagcctctactgcatgctacagagttgtcagtaaaagataatgctgaaggtgatgaggtacatcaatgccaaagcccagagttgggaacttctgatgtttgttttggtggtcctaccaaggttgtaataccatcagtgaattcccacaatgcactagagcaatgtgattctatggcttctctagatgaaccgttgcttgatgtggagatgacatgcattcctttggacccttgtgctactggtgtgccctactcagtgaaggaaacgcctgctggtgttctgtgcacgtctgatcattgttccactggcacacccttaacagtggaagaaacctccagttccgtttctgttgtgcacattgagccaatgtcaagcaaagtcagcccagtacggcaaagaggttccccttgtttggaaaaacgaggcctttcccctaagaaactatctccaaagaaaggaatacttaagagacatacaagggggtgcaagggaatctgcatgtgcttggactgcagcacattccgtttacgtgctgaccgagcttttgagttctctaggaagcagatgcaagaggcagatgatataatagataacttactaaaggaggtgtcaagtcttaggaatctcatggagaaatctgctggccaagtaagtgtgatcactggcacttcacttttattttcttgtccttacaatgatcaaattttatagtacccttttccaagggaatgaaatgctatcatcttattttcctgcttgtcttttacattaatcgtgcaaattcatcaaatttaagcacttgagagtcaagatcaggctctgtacatatcaatacatggggtggtagaatgtgataaacttttagcaatcctttttgagagaacacaaacaaaatggggatatcttctcgtacatacgtggaatttcttgtttagatcgatgatgccttgtattactatcttgtccaaatatataagtagaagaagttggtagggattgctttgtgcagtgaacgtatatgtatcagaatacatgcatatgttcagtagacatgaatggcagaacgcgtttgatgccataatttatcatttctcaccaggaccaaaatttatgctatcgtaattaggttgtctctggctctgtcagttcttcctgcatattactgatggacactttcactgcttgaagtatgttgattgaaatatgaaattgagagaatcctgaaattgacaaaaaaacactttggttgagttgcagcaggagacaaagcaaacagcctgccagcgggcgtcacaggtggaggtggtggccagagagcgtcgtaggcagatgttgatggagctgaactcacattgcaggatccctgtgagtactgtagctacctgctctaccgataatcagcaatattcgctttaactaaaagtagtagcagtgggaattcatttgtttgactgtgactgactcagggaccaagggtgaaatttgcacaatatgttgaagagaggatggcgtcgtctccatcacctgattcacctagcaggagaagataaacaggggaggatgtgtcctgtctgatctatccagcttacctggttaatttttgtgtagtgcagtgcaatactcctacttggttaatgtgttgtagagggtgggtggtctgtttttggaggaacagcatgtcatgtgcatcctttgtttgacagaaaatggaaggaccatgtgcgtggcgtactagatatattaaatatttattattaccaccagtccagtgaaatagtagaatgatactatctatatacacagttttgagggaattccgctgtttttttttgtttctttttgtagaagtacaatataactagtaagtagtagtagcagcaaacatgcaaagcgtaatatatagaggagtgaatatgtatgaatgaatgaaagagaaagaagggagggctaggctagccggcgtagaggtggaggccgacggcgaccatgaagatggcgcagaaggcgaagaagaggagggcgtggacgaagatggaggcgacgctggtgcgcatgctgtggaactcggcgacgcggccgttgctcccggggatctggcacagcaaccccggcgtcagcagcacgaacaagaccaacgcgatcagcactggaccccaatcaccagaccccatcttcttcttcttctcaggcttactaattccttgtaggctactagctgttgctgagcagtgtgcactgcactttcacttcacttcactctggtatatatgctgtgctggctgctacaagtacaggtgcaagaagaacaaatcatctacaagtatatgcttattgctggacctggacgatcgatagatgcatgaatcaaatggccggcctgccctgacaagtacgcctgctagtactaaatcgtggagtaagaaattgttgaggccggcgctggacggcatatccaattgcaacttaggtacgtatggtatagggacaacaatctcaaggacagcttcgtatcctccaaggcaccagatagcaggcccagacataaaatataagggatgtgtagtattcattaagtaatctttcataaaaaagaaacatgagcaaaggccacccatccctcggtccctctctgggctgaaaatctgtgtgatatatatatgatcatcgatatacagtaattaaactaatggagtactccagtagtaagtatatgggtaggggattggattagctaaggtaggtaattaattaaattaataaagagactagtttagtgtactacagtaggtaactaagggcagcaggtggttgcagtagtgagggatggtctcatggttacaatggcggagtcgtttgcacctaagcgtttggcccgcttgctggcctccaggaaacttttgacggctcgcctcacatacgcatccgcctgcttcaccgtcatcgtcattctcgactcgtactcctgtgcgaagcttgacagcatgtagtcgccgttgaggaaggccgccagctgcaccagctcgcgctggaagttcgacagccatcctccgtcttctttctggtcgacgacgacgaggaagatggcggcgggatctccggcaatgtctccgggcaatccgtccttggctcgtccaggtccgtgaagaggtgctcgaaggtgcccgcccacgcattcctcctggtgaggaagtcggagctgaggttgaatatcttcttgatggtggccgggatggaggagtgctcgtactcggacgtgggcgttggccctcccggcggcctccccaccaccgtccctttcctgatccacggcgacaccatgatggtgggcaccctgacgccgaggcggtcgaacctgaagaagaagggcagcgggccacggatggcgtcggggctggggacgccgacattgggcggcgggacgtggtcgtagaagccgccgtgctcgtcgtaggtgatgatgagcagtgtgtggttccactgcgggcccgcccgcagcgcctcgtagacgtccttgaccagcctctggccgttggcgacgtcgtgcgccgggtggtcgtcgtcggcgggcgtgccggtgaggtcgaagtagcgtggctcgatgacggagagcgccgggaggaggcccctgcgggcgtggtcgcggaaggcggcgtcgtagcggcggaaggtgccgcgggcggcgttggcgacggtgcggaggcggcggtagaagagggtggtggggatggtcttgaagtagacccggtagtcgagggcgtcggcggcgagggagtcaaagatggtgcgctgcgggtagccgcggaggaggttccacttgtcgtgggcgacggcgccgtgggaggtggcggagtagaggaacagccggttgggctgcgtgggccccgggatggaggagaaccagcggtcgaacaccgcgaaggaggaggccagcgcggagaaggccgggagccgcgacggggtgaacccccgcatgacggcgtcggtcaggagcgcgctcacggagacggcgctgcggacgaagcccgacatgtctgagggggaggcggcggcgccagtagagtcattgggtcggaaccccagcagctgctcgaggacgtcctcgaaggcgtgggcggggtcgtcggggacgacgaggtcggcgtcgggggagacgcagtggaggagggagtcggctggacctggtcctggagccgggttgcactctgcgccggtgaggccgtcgatggggaggcccagcagccgctgcatccaccccagcatgtggtcgaacgaccggttctccagcgccaacaccaccacgttctttatcttggaatccccattggaattgggtgcctgtgccagcattaggaagagcagcaacagccgccgacccatggcgccggaatgcccgtgctgctggagatgccgtcggtgaggagagagcggccacattactagctagtggtgtggagtaccaagtacaacaagctagagaaaaagaaaataaaagatggcggtggatcgatcacttcactagtacagctgcatgcgctggcttcatttggcgccactcaccacctgctcgtgtcacccactgccaagtgctactgtcgatgtttctaccttctcgcttaataacaatcacgatttctgtattaagtaaatactctctctatcccatagtataagggatttcatatagatatgacgcattctaatagaatagatagagtgatgtatttctaatagaatagatctgtatagataaactattatagagtgatgtattttatgttattaattctagtacaatatatcttatttattctttatactccatctgtcccaaaatataaggaattttgagtggatgagacgtattctagtactataaatctggacatatttactgtctagatttgaaatattaaaatgcgccataatcaactaaaactccttatatttatagacagagagagtaactatttaaatggtacgtaagaaacaacacgagatgaactcataaaaatacttccccactgccgcttcctttagggagcaatgttgttctagccttgcatatggatgtggtggcgacagccgaatcgattatgtatgtactccggcgaagtttgttgtgttgtgccgtttgaagatgcagtggccctgtagttacgctgcatgtgacaggtacaaacaaactggccgacctacatatgtcaaacagattgcccgccgttgttggttcacgggcttattgagatgggattggaacagctgcccacccgttctctcgttaattgttgctcctattatgtacaagtattagctatctgcctatctctatctcagagactcagactgagttcctgcttctgttctttgtttcagagctggtacttagaaacctgagttttattctcagcccctgtttggatcccctcaaatttttcatcctgtcatatcgaacgtttgaacactgtatgaagtattaaatataggctaaaaaataactaattaccaaattacgactaatttatgagacaaatcttttaatcctaattgctccatgatttgataatgtggctacagtaaatatttgctaatgatggattaattaggcttaataaattcatctcacggtttacttacggattctgtaattagtttttttatcagtgtccgaacaccccatacgacaccctatataatattcgatgtgacacgccaaaactttacactcctgatctaaacaccctctgaatgtctgagacagtgcccactctgtgctataaactttgtgagtgagtttttacccagcgctccccccgtttgggctttcaatataagctgggtctctgacctctctaaaaaaaggtatgtattacaacttaattgataaaacaattacattacttatacaagtagttgtagaaaatactacatccatctaaaaatgacgaacgtcataaaaaagcaaagggaggatcatgtgttgtcattgataaaaaaaagtagattaaaaatgttcaatccgatttaccccatcaactatcgtaaaaagatagatataccctcctcaactatggtatgtacagggatgcacgtgggccgggttaacccatgtacccagcgacccagcccacgatacatggggtcaaaacctcgtgggcttatccatgaaatttcatgggtcatcatgggctgacccttctgttaggttacacatcacagtaccaggcaccagctgcgccgctgccgcctcacactccgcccgtccgctccagcgctctacccctccaccgcgtcgcccaatctttgttcaatattgagtgatataaatagctgtaattctaaaagagtgtcaaaatctaccaaattattaacttattttgtttgaataataagtacgttaatgatgcatgttttctagctgctcatttgatgcatcatgcttgctgatgatttagatgtgttgatggatagagttttctgtgcctggagaatcgttaatgggttgacccatagtggctccgtgggtcagcaagtcaggactcagcgtgggtcgcgagtgacccatggcctgtaattcattaccctgggtaacatgggttagaccgtgggttgacccagaaaggcccacgtgcatccctaaattattgatatgagatgactttacaccccttatatttttaaacatgacaaaataaccctttagccgaatgcaagaaagtttcacctcctatctggtgacgatcagtccacatggtagcggcgtggcagtcagttagctgtttcactcttctctcccccttcccctcttgctcttcacatgtcgcattacttccccacggttgggtgcaagttgtttcgctgccagatcgatcagtgccagcccagggcccgggcagggcgagcagtgcggctgcgccgaggtgccccatctcagtatgtatgtgtattgttgtttccatcactaacttaatcgctattatttccttgaaaacatatactacctcagtcccagaacataaaaagttttagagttggacacgattattaagaaaat

SEQ ID NO: 59382 - DNA, 5594 bp, Oryza sativa
attcctgcagccccagagcggctgcagcagcgggtggtggtggtcgtagggcatcgtcgtcggccacggcgccatctccggcttcacggcgtacccgcagttctgctgcaccagctgctgccgctgctgctgctgctgctgatgctggtgcggcgactgcatgacatcctggtgatgctgctgctgctgctgctcctgcagcgcggcgagctcctggtggtgcgccatgaccggcggcggcgagaagagcagctggtggtggtggtggtggtggtggtggtggtgccccggcgcggccatggcggcggggatgccgccgatggccttggcgctctcctcggtgagcgcgtcgcagaacgcccggtgcgtgatgaagctgtcacgcctgcatgcaatgcaagaaccgaaagacacacacatcaaaaaccacacggatcacaccaaaaccaaaaaacatcaaatttcaaaaggccaaaagccaaagatatcatatttcccccgtattcttgctcacttgtcattgttgcttctacactcctactacacctatagccatctcaaaaaaaaaaaggatagagagagatgctcaagctagaatgaactccatggaagtgacaacacagagagatagccatgcatgaacactcttgcagagtagagtggagtaggcaattaggcaggaggaatagtggctaggatgaacagcataggcaaagcctgggagagagagggagagagagagagatggaaaagccatccatccatccatgcaggagcaggatgcagacgactgcaaagagattcacatgtctctctttcttcctcctcctcctctctttcttcctccatggctcagcatcatcagctgccaccacagctagctagccatagctcatcatcatcaagctcagatctcccctccttcctttgtcctatgggcaaatagctttgctgcttgtttgtttcccaatctctcatttctctctctcatcacacggacgcaatgcaaacagacacgcgcatacgcacaagccagtagtactaccaccaacctagctaccactagtagcgtcgtcgtcatcgtcgtcgtcgtctccatcgggtcctgcaccgtgcgcattcatcagcccggatcaatccaaaggaggtttcagccatggatggcagtggcagcacaagccaagaaacaaaaagaagaagaggcaagaaacgactccaatctcgatctcgatgtcgatgtcgatcgatcgatatggcttcttttctttgcttgtttcgctgctgcagcgagcagctagctaagctacgtactagttgccactgttcacaaatcttttcggctagatgctcgcggcagggatgggcacatggttgttgctggttaatcaacaaccggtatatctatcgctgccctaattattggatgattacaggtgtgttaacactaacaaacgctcatcttataggctgcttcgattcctactcgtcactgtgccaactgaaagcgcaggcggcagcgagaacactggattactggcaaagtggcaatgagaaaggagcacggcaagccagccaaggcaggtatatctgagcagaaggcagtaggagtgcaagtgctgcaatcgatcgccatggatggatggaagcaagcaagatggaggaggagggaggaagaagaaggacctggagaagatggtgccgcaatcgcacttgtactcgcgggtgccgcagatcttggagtgggccttccagtcggagtggacggcgtacttcttggagcacttgtcgcacttccacttcttctcgccgtgcttgcggaagaagtgcttcttgatgccggtgaggtcgccgagggcgcgggaggggtcgtggtggacgcagctggcctccgggcagatgtacaccttcttcctcaccgcctccttgctcccccgctgcttcagcttccacggcaggttgtgcccccgccggtgcagctgcaggttctggtccctctggaaccccttcccgcagatctcgcacacgaacctgttcgtcgccatcagcgtcgccggcgacagcgccaccacctccgcttccgggtctatatataggttcgatcaattgctttcgcttaattgccgagaaaattaacggagcccggatcgatcgaggagctagctatacaagaacgcacctgggttgcccgggaggctgcgcttcctcttgttgctgttgttgccgttgttgccggaggatggcggcggcggcggcggcacggtggaggcggaggaggtcaggttggacatgctgctctcctgctgctgatctgctgcctcggcggcctcttccaccaagaacaatcctcctccctcctcctcctcctgctgctgctgctgctgaagatggtgatgaaacataggagcttcgatcttttcttgctacatagcatgcagcatctgcctcaccatggaagcaatgaattttgggaggctcaagtgaagtgatgaagaggatgcattaaaactgaagaatggaggcaggagacaggagggcatgtaggatgaagggagttcagagaatctcaaggaaggaacaaacaagaaggaggaggggagggggggacaaacaaggaggaaactagggtggtcaatgactctaaagcaattttcagattcttctttctttcccttcctcctcctccttctcctctctctctctacagtctacacacactcagagcagaagcagcagcatcaccaagtgtagaacacaacaaggatgctcaagagaagagagagagagaagcaagcagctggaagctagctagccaggcaagcagcagccatgagagagagggagagagagagatcaaaggattgggggagaggagcagtagcagtgtgttgcttggcaggcagcagctgaagtagccagaggggagagtggagaagcaaagctgagcaaatggaagaagagaagggcaccaaaaaccaaatcccttttcttcttcctcctctttatctgctcctgcctgctgatcctatactttactttcagggccctgtgtgagccagctaaaaagattaaaaagatttgtagagcagttcagactttcttcagactagcttcttcacttttcttgcttgcagaagaaacaaaaattgaacccctttttttttcacttgagtaattaccacagtgccaatagcttttttactacatgtgctctcactggttaattttgatcagtaagccaaggggttgtttatatcaatcttgaatagatatttcaattttaaaaaaaatcaagtcttgagaatgcatgactagtgtacatatcacaatatcacagtgagtgaactgttttatgcattctcaaggaagctgcatctgcatgaggcaagaacagtgtactggtagtagatgaaccagcactagctatagctagtagaattgtgtactacagagtagagatgaggagcaactgtttgggtttgtgcctgaatcacaaaatcacacaacactcctaacaatgctacactgatgttgagcttttctgtcttttcccttgtctccttacaagtgcagataccgtccgtccctgatgatcaactcttgcatttcttctttctttttatttatctaacctgttgtacacctacttggttggtacaccagagataagtatgcatcaatggaacaataagctagacaggtagattccaattttatcacatttgttttataaattccagggcctgcactcaatgtatatgatagcaacaatacatatgatatataatagtactcatacatgtacacaccaaccataatgctaattcacattcatgcatatgccaatatatttttttgtacattgccatgtgtgatttatcattcttatttttttcccatcctctctctctctctctctctctctctctctcttttgatgagtcaccctgggccccatgcatatcatggatggtcgtaattcaaaaatagtagaaatcctatcctgtcatggaccagttatttgtccatgggattatatcttcagagttgctttggttttgcaagacccacagctgatcttgctgcagtagtactatcagtttttaattaattagtagtttatttctttgtcatttgttcatgaaagatggagcattaaataaacactcctttttctcttttgttctcttgaggtggaagtacatcatagaatgatgagtttccaattgacctgatgagggggagaaagagaacctagggaagttcaaggattgtctgtgcatgggaatttaatgcgacctaattaagcaagcaaatgtgctcatctgatacatccatcccagctactactaggccctatttgaaagattagcccagagctaatgtttagttatgaattggtaagctaaacattagtctagaatggcatgtttggatccatgggctaattcaatgctaaaaggtggagagagagagagagtagaaagagaggagagagatagctgcttttttatggtccccacagaaaattagtctcattaacacctcctttgaggggctaatgttttgagggggaataattcactttggttccaaattagcccacatatttagatctttgggagctaatttagggctaaaaggtgggggctaataattagcccatgaaaccaaagaaggccctagctaatactccagtatcagccatgtttaacagaactcgagattctgataagtgtagaatatgaaaaaactaggtaccaaacttctagtttcttttatcattctctatatgttacaactagattttttaaaatctatgtgaaaatatagggtctaatggtaagagctttaaattctgagaaacagttagtgagaatccaaccggtgagaatctaaaaaagctaagaaaaccagcttgacttctagttaactttctaaattgtatgactacaacttttcgaaattatgaaaaaagatacagctgctaaaaactctctaatcaagcctattgactgttttgggagccagagattatgaaggaaagctacagcaaacagctgccagaaactctccaaacataagcttggtagcattagacaaaatagaaagattaattaaagcaatgattattgaggcttaactaagtgatgggtgttgcttgttcacaaggcaagtaacagtggcagtgcacagcaacagtgctagtactatactactgtactactagtaggagtagtagctggtaggatgagtaaccagatgggtgagtagtagaagtaggatgcagcaagctatacactgcacactgcactagggtgtttggcaatggcatcaaggattttggtagtactgctcctctcaaaaagatggagacgtattttccaaagttagctggtgactgcagcctaggagcttcatgtgacactcaaaagcatgcatactcttgtgcttgtgttgtgtagggtgccaccagcccaggtgtactttttactgcaggtaaaaaaacactttgcaggaacagaatcaagaaagagaattttgctattaatgtacagtgatgacactactaatcctgtaagattagtggtgagtac

SEQ ID NO: 59383 - DNA, 3645 bp, Oryza sativa
ccttaaaaatcatgctttgtgatctgatggtttgatcccctagactagagaacctccaaaagattcatggacatgcataagattgagactgaagcatttcgacagccccaagaagacatttgggaggcatcttaaagcttataggagcataaaaaagaatgatgtagggtctctggttaaaaaaaggatttggacatttgacagtccaatgcaaagcatgcacatgcaaccactggcttaaacatttttagggtctctggtgggggtcaccacatatcacaatgtgaagaatgagagggtggggcccacaatgtcagctatagttttcacctgaaagagataaaaaaaaaagttaccaagcctcttttttttatgcatgttgttgcatgctactgtttttagggtggtgccagttatgtgatgcaacatgctccattgaacagtgtagtaggagtatatttttgcgcacactttttttttagatatggtgcatttatgtgtagatggggaatcttgacagaagcaaatactaggctacatgggcctacagtacgtagtgcaccgagtggagaaatggagtgtatttttcacaaaaatattaggggtgtttagattagggttgtaaagttttagcgtgtcacatcgggtattatatagaatgttgtatggtatgttcgggcactaataaaaaaactaattacagaatccaactacgagacaaatttgttaagcctaattaatccatcattaataaatgtttactgtaacaccatattgtcaaatcatggagaaattaggcttaaaagattcgtctcgtaaattagtcgtgatctatataattagttattttttagcctatatttaatacttcatacaggtgttcaaacgttcgatgtgatatgctataaaattttagggtgggatctaaaatttagtagtcgtttttgcgtcaactcagatgttccttttttttcatagtttctagtatcattgttttgggagttccaacgataaactttcgtccatcactgacgcgccgagattgtgagtgaagaacatagggggcgggtaagaagattcagtctaattgtctcgtgacctgaaacttgtaattgcacaagtatttagaactttaacatagagaaaataataataataaatcttccaacctctgcacaatttctatatgcgggggcggagccagccagaagctaagcctatggctcaactttgttattttatcctaattccttataaatttatgactagatttcacaaaactatatatatacttcaaccaaactatcataaaactacagatttaaggtgatgtgtcgaaaaactacatattcagtgctgaagttacgaaataactacaaatttaagatggaagatcaaaaaacaatatgttttgtacaaagttaagtgcataactacaacatttgtaactctcaacatgatagtagtggcatctgtgttttgtgataactccaatactcaagctgtagttttttatacttggccttaaatgtatggtttggtgataaatcttatattaaatatgtagttttatgatacaacactttaaatctatagtgttgtgataatttagtcaaagtaccaatagttttgtaaaatttactctaaatttatatgctcctataaaatttatatgaaatttacatagagtttgattcctagggctagggcttaagcctttatatgaaatttatagcctgaattcgcccatgtttatatgcatgggccaattctattttttagataagtcgtaaaaacaatatatattaggttattaccaattataattcctcttatgtaatcaaatgtttccgctacttaaaaaaacattttcacaggtgggtaaaatccgtttgcagaggtaggtcgatggactgtctctaacaaaatgccagtggagaaactgctatatgtgcgaatcaacttttggatagggttttagactacatgaccatcattgttattataagaggattttcttatagctcatcagtaaaaatgaaacccatgtgtttgtgaaaatagtttctagtgtccctctatgaaatataagtcatgctgtatatccatacaatcagttaataaaatgttagtcctttacatatgtgcacaggatttaagatatactgctagatgataccctgcacgttgttgtgaaaatctttatgaaattaaaataagcaaatcattgagatgaaattagaagatattgtgtatattataagcatgtcacaacttgatatgaactaacaaaagatataagatcataatatgctgatataattaataatcgattgctagtccatttggttgtcaaaacagaactgagtgttgtctttttttacatgatgtttttaactgtttctttacatgatattaacatgacatatagcaacactggtctagaattgatgatggatgtggctgatcaacttctagattaaatagagataattatatatggctacgaggtaaattcaagcggtataatgtataaaactgaaataatctgtgaagaataatcaaatggtcaatagtaaaggtactttggggtgatctggagctctaaactttgatctaattgatgaaatttattgagctaatgtggtgcaataagagaagaggaaaacaattttaattgtatttagtgggaataaattatatagacatatatataggataaaatatatttaaatgactttctaccctttcaccctttgagaaaagcaaaggggagaggaagtctaaggatgacttctacaataattgatggctggtacagtgcagtgttactctgccgtttgcaccaaccgaataacagttccataaatcaaacggcttcaaagttcaaactaatataattatcgtgtaaaaaaatgcatacataccagctttccttgtctgagctgtaaaaaacaataatacattccttgatcttcaccacaaagtttgtgtctgtattcaaagcaaagtgtaaaaaaaagaatgtattgtgcacaacttgtgctaaatgaaagagagaacttttttttagagggagcttgcacaagcagtactaaacctgatagtatatacttaaataataatacctgtattttttaatttatttctttataaaatgtcacataggattccatccacttgataacatggtgcatttctatcaaattaatttatccgagataaaaaaaataaaagcaaaacaaataccgccgcccacccaacatacatacgtgtacgtaagccaagcttaattagccttccgtgtcttccaaacccctataattaattaagaaaaaaaacccaaagattcgccaggagcctagtgcgaaaagttaaccgctaattaattaaaaagttaatcctgattaatttatcttaatgcttgatctctcaggcaaactagcagctaggccggattagagattagattaggaactttttggagctatcatgtcgccggccggttgcatcagtgtggggcccacgcgtcatcccctcaatggtgataactaatgggattaattagccatggaaaataaatattaattaatcttaaccaatggtgattagcgtgaggaggagctgcctaatcaggggccactg

SEQ ID NO: 59384 - DNA, 14796 bp, Oryza sativa
ctggagcagagtggagcaggggttaacactggtgattagcagagatagagagagagagagagctgtggtcgctgtctgattctgctgtattatattcccctgatggcatccggacaagcgtcaagaggggacggacataccatgtgccacctcatcctcgtgatccatgggcataattgctaggtgcacacggcggggttctggttccggcctcgatgggtggctgacgggtggggccgtctcacaaaccgtgtgcggccaacgtgtcggctttgcggaattcttgctagtatttcttttttttttcaaaaaaagtttttattcaacacgcaaggaaaaaaacgatatagagatatgattgttgtaaacagctcaaacacgctggctacatgaaaccctagcggtctgagtttatacccgacagtcccataaacccttagttagcatacggactcgaacatgtgatctccccttcccgaattcaagtggttttaaccgctgggatgtcatttgacttgtgaatagtatctcatatgtcattttccccttgtaaattgagctttcgtacttaggtctcaggtagtaagtatttcccgaatatatttatcctatatcccaaaataactgatcactttattacttatgagtcaattatgagaaaaggtaaatgacctagatgccctatactaatagagatgtcactagtgggctgtagttgagggtataataaatatatataatttttaaattagaggttggaagaaattttggattggcaaacaatattcacttatttagggataatttttgaattttgaaatttgagatggattgacaaatagtactacttgttttcccgttgaaactggtagggtaaatactaacagtttgtgtcataaaactgctacaccttcacatgatgtcttgtcagaggttttgtttaaatctctcaccctttttgtggaacaataaaaaagcattactcctgaagcaatggaacactcccaaatcccaattcaccttttgatcagaagcacatgtacatgtacatttgtacacaagctgcctgtcttttttgctttggtccttttgggctaggctagaaaaagcactcatccaacacatgacttcctgatccatccaacacttttattttttttctgcagcaaatcatcattcagatggtttgcaaagctgccattctttagcatccaaagagatcagatgcaaaaaactttttcccagctactacaagacggccaaaaagaggaagcacacatgaacaccaatcattagcagataattggcacgggctttggctttttagtagtgccttcgctctgaatcgagtcaaacagcacaaccaaaataagagttgtttgcaaagtgtgagcatgccatcacacgagtgcaagaattgtgtatttagcaaccaatcaatcacaatcattctttcattcattcagacttaccaaaaatttcttcagaagatggtggttcttttcccctcttccttttccaacccatatcgacatcgatatcgatatgcttgaatttctattcatgtatgattttttttaaaaaatgcggtcaaggcgcgaattatgagccagaatataagcaaagtctgcatcaggacaaggacatgctcctccccatcttgcagtcgcagtttttgaatctggagaccctgaaaacacaccaacatggagaagaagaaaagctaaggattcagcaacagggacccctgaaaactggatcttctgatccacaaggcaaacaagaacacaacaaaattggcaggacgaatggttagtttgttagtacaagagatggacataagaagatgataggaggaggaggaggatattatgaaatgcataacaccttgatgataattgcttgcttggatttatttattttttgatgaacatgaggacaagccactgatcaggcttcacagaaaatcgaattcgtcgttgtcgccaagttgtaggtgttcttggatgcttggctccgtttctaactgagaatgtagggtggtgacagcaaccttagctgcaaatctgtccaaggaaaactgtggtttggtaggataatatactgatgatgccattgttctgtcaccggtacagattcaagaaagagatgtacagtacaatatgagctagatggcactgacaattggccaatctccagaggtttagagacccataatttcctaaaccctgctgctccaaatgactagccagggccaagtctatcaataataaaagctgctagctgtttgctcatagatttccttcatgataatctgagggggaaaataaagacatgaatggtcaaggctatgatttggacatgtaaataaatacacatactagaatagttaatctcggatttgattcagacatgtaaatacctgaaatatggcatttaaagtttcttattactgactgacaaggcatgaaaaagacatgtaactaacatcattattcttttgcattcgcccccggttcttctatctcgcgctgttcttcctatgtgcatttggctcaatcatatagagcagaatgacctgtttaaattaaccacagttaaataacagtacagtacactgtacaccatacaaacaggaagtatcctattagcaatttaacaggagcaggcttgtcccaggagaactgtagcagctgaaatgcagagaggccttggacttcagacatgaactgaaacggattcaggaggagttgctgtttgctgaggggagggtgtgtgccagtttgatgaagcagatgtcccagtggatctgtgtttgtcagccagcccctgtggaggattaattcaagtgcagtgcaagtgagaaagacaagaaataaaacggtgtcgggacagcgatcgccgatcaacgaatgtaggcgcagtcaaaattcagctcttttttgaaaactagaatgaaaacattctgaatattcagtttggtttggtcccatgagacaaaaacaggtcagcagaaaaaggtcaaaaaagagaaaaagtttgcacataccatatagttattgaagtagaactgatcaagacataaatggactctggaattttctgataagtggttaggtccaaaagcttgtagtactagataatgccgcgaagttcaggtcagcactcagcagacaaatcatgtcatatgaaacaatttatatccaggaagaaggacgcaagctcattgtttcctaatttctagcctttttcattttgagtggaggcataccatatcttcttcttcttttttccttgttcttttgtgtgaaagaaatgacaattcataatatagctagaaagcagaaagtgtcaaatgtcatgattctgaaggaggacaaaacaagaaggaagctgaggcagagattcatcatgaatataaatggtgagcaaaggcagaaatgactcaacaagtcatttcccttttccaaaagaactaggacaagaagagagcttttgctatgatcatcctaacatgcattggtctgttttaatgagtcaaatcgttgactgaataaaaacagcagaaatcttctctgacatctgctgctcaagatgacaaaagggtaacctgccacacacacacactagcagcaatcttgaaaggagccaagggatttattgtgtgaagcaggttttcttgaactgaaactgtttttgaagccaagcatgcatgtgagctacagaatggagatatttattttcctttgtccggtgaaatgaattcggttgtcagtgttgcatattttgtcgagggcagagttgaattgcaattactggccaccagcatgtaaacaaatggaaaaaaagaaagagagaaaaagagggagaaaaagaaatgcattttgcttacttgacgttcgccattgttaggggagcgagagagattcttgaatgataaaaaaaactgacctgctgatgccggaggattgtaggttgcaggggccatagttctcaatacctcgacggcgagaaggcagagaggggagcgccgccgccctggcggtgatgaggcgggcctcgccggccggcgtgctcaaatccggcggaggtgatcggaagaggcttcagggtagtaggacagtcagcggtggaaatgggcagtaatttcctattttattctttttcactcgttttgttttcctttgggttaatttgggttttcaagcttagggggtatttgaactttttttttttaacttcttcatatcctgtgtgattttcaatttgctagtcactaactaccatgaaaaaaaaataaggtagatgctattacgcataaagatgttattgttttcactttagagagataccgacgaatattacacacatgtggagaatttagtgaggttgagtatttattcttgattgatttccatttattgcgcgtactaataggaaaaagcgtttttttaagaaaaaaactaaaacaaatgagagtaaatttctttctttttttatccatattcttcaatttcagttttgagtagagtaaattttataaaaaatagatggaactaaattttataaaattttaaactattgtaaaattatatatacacttgacagagtatcacaaaatacatatttgacactaaatttgtaacaaaactatatcttttgttgctccaacaaaacattagtaccaaggtaaataaatcaaaacattaatgctaagggtttaaactctaaagtctataatttcaagataatttaatcattgaaactatagttttgcaatacttcatcttataaatgtatagtttcataacaaatttggtaaaaatctatgataactttgtgatatacatacaacgccttataaatttacaatagtttgatttgagatatctatagttttgcaaaatttacccttcctttttttctattatatctagttgcacagttcgggccggataaatactcaaggatttgctttatctccaacgcagacacaatgataatatcaaggaaagcgaccaagtagctaccctccacagctccatttctttggggccttccgttttcgcctgaattgacatgccaaggaacttgcttatccatctccagtgtcacccaacgcatacaggtcgttcaggtcttttctagtcggttgctttcaccactgacacaaatattcgagcaactgaccaccgagataacaagccaacacagccacgactctctcatatacggtggtaaaaccaggtaaaaaaaaaactgacagttccatcttaactacctctaatgaaaaggccatcggaatgaacggacggttgctaagatcaattcattttcatcaggagcaaaaagatttgactgtttagtgagatagtagacagtcgctgtcacttgggcatgtgatagcagcagtagagagggacatgtagttcaggtgattgcttcgcatggcaagcccggactgatgaaacggccatgtgagccctcccagcgatcatgtgaaatgtaactctgaaccgatgcaacaacacccgggattttgacagcaactaggcacggacagatccaaaccatgtttgagatgtagcaagcaacgatcacacgttccagctcataactggggccccttatcttctgcacttgtgccccacggcctccacggatagtttcacaagcaattctgaaccaaacgataggacggaatccagattccagagtgctatgtgcatgtaaagcttaaaccattgcactgatgaaaccagaggctgatgctggtgtcctgtgaaggacccatggttctggcagagatgtaacccaaaatcatcatgttgttcgacgactaaaacggcaatcttctagctgccatcgtcacatggcaatggagtaaagcttttgcctcaagaagcttgatgccctgaaagccccccaaaagagagattgatagattaatattccttttattttctacttctgataagcacactaaatgcttgacaaaaaaagcagatggagaaattgctttgtataatgcccatgttcatggcgaagcatctctcaatagacagcgcaacagaaagaaatgtgtaccgtaatgaatccacccgacaacagcggtacctcaaaaaagcagcccttgtacagacatgaatgacacatcaaatctccattgctttactaagtcatatggcgcttagcattttcataatcccaaacaaagagataaacaccaactttccaattcaaatctgcacataaattcaacattcaattattgcatgaaacaattacaagcctgcagtttttaagtgtacatgatatttggatgcatatttaacgtaagagtaagagcacactagtttttgagtttcctattatgcatttaatccaataatattgaaacaattgtgttttgacctttattttatggtaactaggtgtattcaacagtcacctttattgaggaacatacttaaaacctgtaaaagaagactacgtagttgattatgttatagaggaacaagcaacaaaacgatccacctaggaattagaagcccatgtgcaaaacactggggccctaaatttttaaaaacactgtagaaccaaagtataccttcacttaatatggattgatgaaatgaacaaataaactcctatttcataaccaaaatcatacatttcagaagacacgatcgatgaggactgatgaaataaacaaataatttcctgcttgtttataacatgaatttgaaacttagagaagaaaacaaattgtagggaaatgtgatggcacagtgaactcacgagctgatggatgcacacgggcatactcccttttgctgcactgttggcttcttgctgctgcaaactaatgaagattaggaattgtgatttgctgttgtatgcctgcgcgacaccaagccatcgagtagcgcgtgggcagcaatggaggagccaacgatacagtctttgggcctggtagtccttgtgggcctttttcttttttcatttattaggccttgtaatttgctggtaattaagtatagttgattagtactaatgatagatttatttggggacccctaatttttggggccctgaacacatgcactttgcaccggctaatgtatgaccctgcccttgaactcataaacctccaaaataacactccacaactcagacaaatacatgcacacaaaataaacagttgttactggcatcataattcatagagtcgcaaaagtatatgaacaaagaaaacttccagtatgtgcacgagtaaaaacagggaagcagcagcaatatgggaaagaaattgtcaccaaagttctaaaaagattcaatcacaatttacttttatcatgttgaacctactttactatctggtcatgagaaggaaagaggtactcttatagaagttgtattgatggcgtgttctacacccacccactcttgaatattttttgtggctatatacatgcaggcatgtgtgccatgtgctatttgtgtattttcatttctaaaaaatactaactttagtacgtgtatagtatatatgtcgatgttgattgattcgtgtaaaattgagtattgtagaatcttttttaaaaaatttgagggtaattattttttgatattgttaacctagaaacttataaagtttatagtataatttgccatccattggtacaatgctaataaaaatataagaccaaaagaaaaaaaatatgggctctgtctgaggatgtaatagttttggagttttcgtagaatacagtggtttccaaaaagtactatagtatttagtttgagaacagaaaatactgtagttttctcaacgctatggtttttccactcctggactccttttcttttgtaaaccaagaaagtgaagcgattccacagcagttttaaatattgcaaagtcttggggtataatactgtctgtaaggtagttttaaatccatctcttatatgtgagcaaatctgggtttacagattgaattagctaatgatcgttaatatgtgtaaaagctagggctacgagcctacgacacaatggtacattgatacataggagttaaaaaagctatgcatagagacatctgtcagtacacgttgatgcttcacatacccatcttctaattccatgcacccaagatatctaaatagaactagccaaacaattcttttttgaaaaaaaaaacagtaatgtggtaaatactgcagttgccaaaacaagaaactatggtttttgctacagtgtgaaaaatgtagtattcaaagactggcgtattcatggatgcaacaaacttggaagtattgcatagagtagttctttaaatctgtagcatcctaacagggcctacatttacaggccaaaaaacatgcatgttacaatgtcctagaattcctaatagctaagcacgagagaagttaaaaccatcgatctaatcaatcatcttctagaaaagaaaaaaaaagcaatcattgagtcacagatagtactgacatatatgttcgcatatcaacaatgacctggaacagtttagaataaacatttattttattatcccagtactacatatagggcctgttcactttgatgccaaaaaaaaccttaccaaattttaccattgccaaaattttggtaacttgccaaaattttggtaggatttcttatatagttgctaaaatttggcagcaaactaaatgtagccactttttttgtaactttaccaaaatttggtaaggttgaaaatggcatcaaagtgaacaggcccataaagtgtgtcccatgaatcatacgaatcatgtcaactttttcatgaaactactgactcaaggagtgcatttatgacaacactaggcctacatcttcaaaaccattcactaaatggaactaacctgtggattgaacagaagtgcattcatttgatagttaccaatcttcaaaatctgacagtaaatatttgccccaagttctgcaaaataagtcctgaatgaaatttattggtaactaaagcgcaataaaacaccacagacaatgttgttctcttttcgacataccacatcagcagttgcaacttgcaagatggagttacagcaataaaactggtgtgcggaatacaaaaaatgctgcacaatctcatgggcacgggttcatcactgaacaacatccaagtatgctgcaaaattcaaggaacatttatttaactaccaatgcatatatgtagtctacaggtatcaaaggcatagtagtagattcatacttctctctaattgccagaaccaaacaagaactcctgcaaaatcctggaggcctctgaaacttcatgctgagtgcttactgagctgggcactgcagcagtggtaggcaaactatttttctttggttctgaacatggatgtagattagcttgttttgatgagtctttttcatccaacagtggagctgatctatgtccattgtgcttgccaagttttttcccgtctgcgggttgaggtcttccaaagttctgatgtggaccaccagttggattcttatgcttctcagtggacacaacatcctgatgcaaaatgctagaatctggtctggctttattgaaaggaagaaactgtataccccttggtatacgaacaggtaccttttgagcatttcctgatatgccagcaaggtttttaaggatggaatgatgtttgataggaacagaggttgcaggttcaccactgtatactgttgaagttttctgacgacttgtttgctcttggcaatttgctttttcaggtactgatgacgcattagatttctttgcatctggtgtggacggaccttctgcagttggtatctgacaacgagtgcaaagcttgcttaattcacagcatttgctaatattaaaatttaaccaggctataacaccaataattaaataagagtgaatgatttgttaaattacgtaccacatgagaaaatttgcatttatcacctctgatgcacattccattttccataaaattgtggcaagggtactttgacaactcatgatcataagggcaatcatctcctttcaaacaagaaccacgtgcataatgcgtgcagggctgtcaaggcaaaaaaaaaatcaggataaaattcgcaaaacctcaaaaggacagatacaacaggaagtttagtaccaatacttggatcaagatttgggtacacttcagtttatgatttagcactatactgatacgtattcataacatgtgcagtgcgaacctgttctgtgcatgctttaaagttcaaattcaatattgatgtcacattttcatctaaaaaataggtggtatgcataggtgcgtacaaaatgagctcatgcttgcgtgtgggcagaccacatagaatatatccacacatattaaacagcatacatgcatcttattataatacattatgattactgcaagcatgtgataaacttctatgaaatggataccttagattttgtcaaaggtgtcgtatcatgggagaacttgcacaaattgccctgcaataaaaaaataagaaatattaggtactacatccgtttaaggttataagactttctagcattgcccacattcatataaatgttaatgaatctaggcacacatatatgtctagattcattaacatatatataaatgcgggcaatgctagaaagtcttataatatgaaacagaggaagtattttattaaagtaaatcctgtgaaaagcatttttacagtctttgtaacatatttatatagaaaacataacacatatacaaagaataaagtggacatgttacatgatgaaaacaatatgattatataaacagtgttcatcatggtctaagctctcaggcagcacaccagcgcctaatcagcaaatagacagacctaggcagggctaatcgttaccaggtgctatctagtggacactgaatcaaaatatgcatcctatgctactgatatggctaatcactaaattacacaaatataatcagtgtgtccagaaaatcgctacaatatgtttcaaggccagggcatgtgctgtgcagtttacaacagcaaagaatataattttttgtcgatccaaaagtgaagcagatgatgactaccatctgtctgatctgagagacagactcacctgctggcacttcccatgcaagtagaagtggcaaaccttcaccactttaggctttataactggttgaagtttcagtcttttcaccccttcggcttcccgttgcaatgctctcttaattcgtttagttttctgcatattaatagcattgaaagcaaatcttaatatttctaaaggtaaaaactatttgaatgcacagttcaaaaatgtttatacattggaaccaaatggtcctgagatcagaacataccgtcttcttagcttttctctcctctgtcaaggtgcgctttcttgtgtttccatgtttgagagcctgcaatattaatatagaacagactgaaaatccatacttacgtagctaagaagaaaatttaacacagacgaatcaattgtattgtatattgttcttaaaaatcttgcattgtaaattgactgtgattaacttgaagttacaaagaaagtcatgaagtgtgaacactcgaactgcattcattgtactcaagcaaggtatgtatgcgatgattaaaaaaagctactgaattcagttaatatgaaacatcaaacaagaattaatcaaaattgtgcataaacaatgaagcaacaaaacagcgtatgggtaccaaaaaaagagagaatatggcaagcttgtacgcatttgtggttgacaaagaagctataccttatcatcaggcaaaggtgtctcattccaatcgagaacttcatcataactgactgcttgcgccctggcaacatgcatttgagaatcacccttgctattacatagcatgttccgtgcagtgtcgccatttcctttttgaggtatcaaatgcaaattgctctttaagtcatggccacatgacccatcctcctctatccttctgctatcaaaatcctcttccaattccacatcatcttgaagctctgaattgccagaatcatctgcatctaaattctgcgtgtcgccctcaatctctccttcctcaaaaccaccaccaccatccagtgacccatgatctaaactgcacacagatctgtcattgccaatcccagctcccaattctttcacctcctcagctactctgtcatcactctgcagtttatctccagatactccacagctctgcgccgacattacacaggcactagcatcatcaatcaaccctgacaagttgttcatcatcgcatcgagttgcaattgctcattgtcattaccaaccatttcaatcaccaattcactatcctccccgtctaagcaagcctgcatcgacctcaaagcctcgtcatcccccatcagtccagccccagcccccaactcatcgccatcggcatcagcctccccggaagtgcctccggcgaaaacaacctcttctacaccctccacccgctcgaccccagcgactctaccctcctccgtcccctgcggcaccacgccgggatcggtggtagggttcacggcggcgtccggggacgccgaagtcgaaggcgtctcgtgcggagcatggtttcccagagccacctccacctctaagttcttcccccgatcgcctcccacgtctgcaggaggcggcgaatccccatggggaagcccgccggagccgccgggagggatggcggcggcggcggcaggctcgacctccgcgtcggggcgtgccgcgtgccgcggagggtgcaggtggaggcagtgcgagaagagccgggagagcgcgcggtaggaggcgctgtcgagatgggctctccggcgagagaggacatcggtggtgggcggcgcggcggcgagggaggcaggagccgccgcgggcgggacgggcgagggttcctccatggcggaagggactggatgagtgggtcggagctagggtttagggttcgcagctgtgagctgtgcgtcgcctcgccgcggctgctcgtcggcggcggcggcggcgacgtggcggcgagacgagaggaggaaaacccatcgcagggaaaggcagaggcggcggcaaacgagggcgcggccagaagcccagaatataggcctagtaattgggcctaatgggccttgctacagctggttgagtaaaggaaaaagaccacttagactctcttaatagttcaccgaatctaattcgtgacccttaactagaaaaccgggtaggacgactccccgaattattgaaaccagtgcaatttgactcctctagcggttttggagggcggtttcgctaacgtggcactgacgtagctttacaattaaaaaaatatctgtgggaccaatctatcattcacacacaaaatatattgtgggacccactgacatctggagcccacgtgtcatcctttccctttcttcttcctcctccctctctctctctcccttctctctctcttctctcccccttcggacgcacgcgaggagcgggagccagatcggcgacggcggcggccaggggctggaggggcgacggcggcgtgcgggcgagggctggagcggcgacggtggcgtgcaggcgacggccgcgccaccgcctgccccgtctccaagccggcccaccgctgctccccctccttaaagtcccagagctgcagcctctgctctcccccattggtcgtcgccgccggagcagtagcagcagcgccgccgccgcctgcaaggaagaacgagaggccggcgacctcagccggagcggcggcgaacctctgcagcaggcaggggtgctgcgacggcggcggcggccacagcgaagctgcgacaacattggactgaagtgtgcgctgatcgaaggcggccaccgtggcgtgctgctggtcctgcgagaacgcgaggtggggtggcatcgccatcatcttgaggtggggcaagcaagcgtcgcctgcttgctgctcctgctgatgttgcatttgcaatggcttgctgttgctgatgttgcaatggcttgttgccgttggtgttcgagcagtggaggagctcggcgaacgcgccgccgccgccgttgtaggcgttgccattgttgtcgcagggggcgttggcgagggagagcacggtccgccgttgccgatccggctcccgctcctcgcgtgcgtctgaaggggaagagagagagagggaggaggaagaaggaaggagaaaggatagacatgtaggccccacatatcggtgggtcccataatatattttgtgtgtgaatgctagatgggtcccatagatattttttttaattctaatgccacgtaagcgccacggggatgaagactagattagcaccgccacgtcagcaaaaccgacatcctaaaccgctggaggagtcaaattggactggtttcaataattcggggagtcgtcctacccagttttctagttaagggtcatgaatattcggtgaacaattaagggagtctaagtggactttttccttgagtaaaaacgggtggcctttttacgtcggaaaaaaatacgaacgattttgctaaacttttgtcgggtgagttttttctactatgatatttgacattttattggccgtagaatcgtgcgtcgagattagtgtaggaatcagcgacgtttctcactcatttccccacttcgggcctgtttggcacaactccagctccaactccactcctcctggagctggagctcagccaaacagcttcagctccaccaaaactg

SEQ ID NO: 59385 - DNA, 19210 bp, Oryza sativa
tccacaactctactccagactcaactcctgaagttatatttaggagttggagctgtaacaaacagggcccttccttatcgctctctctcaccctttcttttctaaataaaaatagataggcagccccctgtcgtcatgtagtcgatcttgggcaaattgctttcgaattccgatatataaacgtggaaatatttgcaaggcatgggggccctggtcaaccaggagctcggcggctcgcgcacggtgcaagttcaacagcagcagcagcagccggcgttggacttccaggagaacatcctcctcctcgtcggcgacctcaacgcgcgcgaatgccggccaaagaggaaaccatcgtgtacgaggcggatccggacgcactcaccgtggaccttgtcgacgatccgttggttaaagagttccgtgacaagttagtggatgaggtcctcaccatcgatgccggagatatggaggcactattcgaggaacaccaggagaatccggagctggagaggacgctgatgctgatctctcagtccgaccaagacgctgatgccgccgatggcgacaccccatgagactcttattacctttctttgacgtgatttgtctcggactttcattttttcggcccagcatgtgttgggctgtgattgtttcttttctttgacctttgtcaagttttctttcagccttagtaactcttctatttttttttctagatcacagccgaattccttccttggataccctacacgtactactactactacttctgcggccgtggataaggcggcggagacggaccaccacctggccacacgtgcctgcaggcgctgcgtcttgataattctgccaacggagaaaacccatgaggaggagtttatatttataggacgtgactaatactcgtagagactatactctatactgtattaactatagaccagggtttcccaaaccgccggggccggggttaccgcgcaccggcagtaagcacggttaccgcgcggtaaccgcggtaaccgtgtaaaaccgtacaaaaccgtgcaaaatttataaaaaaaattaaattattttttaaatttatttgaatttaaggatgttatcgcggtatttatattactatacccccgcggtaagcctggtaaccgcggtaaccgtgtggttaccggcggtaggggaaaccttgctagagactcatttcaaaccttgttgcctaactagtacaccaaatgtatacatgtgtacaaatttaatatttcagaaaagattatatgtacaaaatatatctattataaagtttctatgcgtaaacttttctacgtataaatatttatttttctagaccggagtaacacgctgataaattcattctaaatttaaacgtacaggtttcataggtacaaaaattacatttaaattactcgtacagggtatctgaaatttgtataagtatagatcggtgtaaaaatatgtatataatctctatattcttttaaaaaagtagtggtggtgataatgaatttgccaccccacctacctacttctattatgaattctgcaaattatctcttcaacttgctaatatttaaaacaatcaaaatctggatataaagccacatataaatcaaatggatagccacatgccacacattttctatagcaaaacgatgggtaacatgtttcatgggaattttttttgtttattttattttatagcaaatatgcccatgtgtttcaacgggagatggctcttttggttgaccatatcgtccatgtagaatgtagcatcgttagtttttactcttggttaaaaagacaataggcaattatgttcttaactctgttttcgttctatgattttgtccttgcttattaactaaaggtcaagtttgcctccatttcattaagatgacttagcggtgttgtaaatttagccctattattttctgaagaatttatgattttggtcttgatttgacaaaagtgtgttttgacacgattttttcccaacctgaattttcatattctgatcagctaattattaaattttcatattctgatacatgactactcattcatatttaaaatatatatatgaaaatagtactctgataagctagagtactataatttgatagtactccgaatatgagtgagtgtcggatcgccattgcagtgatcaaccttctcaccgttggccatgcacaacatgcagctgaattttcccttcagcgtgtgctagcatgtgtggtggactcgctccgcgctgacgaaccttgtcttgaggcacacccacacttgtttcgccgtcttcttctttgccacccgcatgaagagatcctttggaagcgcatggagcaagtgcgacctcaccttcttgtcaaatgccctaatcttccatcatcgcctgcagccctgcacccggatcacctagctggtataggtggttgcagtgaccagtgagctgcgggtagaggaaagcgctccccgtgctacgccgtgccgcgtctgccgtcgtgacgatagacatagctctgttatctttttttgaaacctaaggcggaacttagttccacttttatatttagaagaagagaattggcccagtctataaggaaaatcgggcccaaaaaccatacaactgcacggttaattacaaacccaccgctacacaactaacaatgacggcggagcccaatcgcaggacgtcgccacaaagctaaacacaaaagcgacacaacagcttccacatcgcagaagaggtgttatcgttgccgagctagccgccccagcgacccagcagcgccaaagcgaaagtcgccaaagccactgaagacgaaagtcgccaaagcgaaaagcggctccggcatccaacaatagacatcagccaagccaccgaggagccacttccttcacacggccagcaccagaactccttggaagagactgcaacatgtcatcgttgctaagcgtcgctgcaccccatcagcgagcagcttcgacttcatcagcagaaacaaccgaagagcatgtcgcccaccacaaaaaagaagcagacccaagaaggcgaagcctcaccgaacacaagatatgaaagcttttgaaccgaaaaggaccatcaacagtcatcgatgcattggaacttctccgaagcgacgcccctaaggaggatacgacgtgtgacgccgccgccgctcgtccaaaaatcggaacaaggttttcacctggagagatttgtgaggatatgaaagagtgccatgacaacgcctccaaggagggaaacgacacccacgggcgcgccattgtcgaaccggccaaaagcacggtaaggctttcgccagcatcttcacaacacccacacaagcacccccacatcgatggccgcagaatagttcatgacgtctcagaagcaatcataccttgattgtaaccaacggcaaagacgggcccttggccatcctcgaaatgccatccatccgccgcaaacttctacagcaagccggagcctccgccctccccatagcattccccatgaccagaaaagggtccggccaaggggggaaaccaaagagagggagaacactcggccgacaatgaggaagtcaccgtcacggacatcaagcaccattcctgcttcacgccagcacaagccgtcgtcccgccatttccacatccgcacatcgctgcccatcaacaacaacgagacccaccaccggcagaagccccctgccgagtaggaggctggctgccagcgagccgccgccgcgcttgccgtccacacgcagccgtcccaccgaccagctgccatctggcgtggaggcgacgaatctagccgcggacggccagatccagccaggtacaggggatgaccagctagggcgcgccgccgcagcattaccgaagccaacaccgacgcttgacagacgccgacgacaacgccgcgaccatgacgggagcgagccgccactgccgtcgcccgtccaccgcgacgccgcccctgcctgccggtttccgcgcctccccggcgccgaccactctcccccagcccggattggagaggcgacgcgagggagcgccgttgccgctgctccacctttcccgccgcctgcatctcccttccccgcctccttgggtgccgccgtcgtcccgggaggaggccggaccgccggatttggcgagggacgccaaatctggcgtcgtcgccgccgcccccgttccgcacccagccgccttcgcccagctgttccgcacccggtcgcctctgcgcgcctagcccgacgccccgacgccgacgccgatgccaccgcaccgtcgccgcccccaactggtcggggtcgtgggcaccgacccgcgccctcgagggagaaggaaggccccaccgccgacttcctcgcagccgcgcggtttccggcagtctgctcgggcggcggcgaggtggaggagggagcaaggcggcggtggggagaaagacggcggtggtcgccacccgtgtcgcccctgcccctggaacgacacgggggcagttctcatagctctgttatcgatcactggttgcctagaacctcaatcgaacaccttgcgggcagggactctagttgctcggcaatgccaaagaacaaagaacttaatttgtgacctatctttgtgactttgtgtgtcttctattgaatggaacaagttgggatacaatttgtgaggaatgtttcctttctttttgtagcaaagtctaaaaacagaatccggccagcacacatgcgtacactagcgcgattaacccaaacaattttgctatatatttgtcgataaattttctcctaaaaatttgacaaatataattacagtataatcgtagtgtaattacattgtaactacaatgtaacttatatgtaactttcaaaaatctctccgtaacatgttatttgggtaaaatggaggtcgtgggaacaaatcctttcacatatgtgtgtgctgtgattttttttctttctcaccagaacaaatctggtaatagatctaacgattcaaaattacatgaaatttacatacaagttacactattgttacatgcaagttgcagtgtaattacatataagttacaatataattacactataattatactataattacatctatcaaatttttagaaaaaaatttgtcgacaaatagaaatagatataggtgttctcaatccgaaaattcggaacgccacgcgcacacacgccctgatcgcgctcccggcatctagctggctccaatccgttgcacggccgttggcacccaccgagccctgacaccgccgccggcgaaacagcaagacgacacgcatgatcaggtccggtcagctaacgaaatgctgccagacgacacgcatgaggccttcgcgccgtacgaagcatgcatggtttctgttttctgtaaaaaaataaataaataaaagtcttctgcattttcctggtatatattccgatccgttccctggtttcttaacagtgtatccgactcggacttgttgatcgatcgtcttttttctcgacgtgcgcacgcacgtacacagaccgaatcggattatttgtgggcgagcagtgtctatatatttgctccggtggccgaagcgagcgagccgacaagccacagatcgatctctagctcgatttttcaacgagaacccctcgctgatcgaccgcacgccgcgcgcagtcgtcgtcgtacgtcgtcgtactcgatcgtcttcgacgacggcaatggccgacccgacgccgccgccaccgtgcgccgcgtgcgcgcaccaggggcggcccagctgcccggcgggctgcccgctggcgccctacttcccggccgaccggccggagcgcttcgagtacgctaacctcctctacggcgtggacggcatcctccgccgcctggaggcggccgggccggacccggggacccggcgcgccaccatggcgtccatcgtcttcgtgtcggacgcgagggccgccgaccccgtgcacggcgcctacggcgtgatacggaacctccagcaggagctcgccagcgtcaaggccgagatcgccgccatccggcagaagcagcagcaagcccagccgccgccgccgccggaggacggccactaactaagcctacgcaccgccatccgcatttatatatgcatgctgtggagacggttcaattagattatgtttttcttagtaactcattagattgctgcaatattaattatctgaattcagagtttagctccatgtttcggaaataactaggattagcacccccacacgttgccgtgcagtgggtgcgacggtatttccaaaggatgtcaaattactcctctatttactgtatgtcatatatgattatatttgtatttaaaagtgtcttataataatattattatgttgaagggcgtgtagaaaactttgcacacttctctgtctttatctctatatctaactctacgtgtggcgtttcggttcagaccagaagttccagattcagaccggaagtttcagattatttacttccctgcaaagtatgaatttcaaggaacgcctattcacctcctagatctatatctatatctatatctataataactaatataaatattcggatttttccggtcgtcgcatctcttttcgtccgtattttcgtccgtccgtcgtatttcaatctcaatcccaatccgactatgttagcgatggaaaaattgcaaaaaaaaaaaaaacaattcatcacagattcacaccaacggattctcaatcccacccacggattcgcagccaattcatcacagattaaaatccacaagaaaggagaaaaacgaaaagacgaaaaaccgcaaaaaagggcgccgccgctgggaaaccaggccaccaccacctcccctggatccaggacgccggatctgggataccgagccgccgccgcctgccaccgtcgagccctcccgcggccccatggcaagggagaggaggcgaggggcggagaggcgctgccgcccgttgccacccgcggaaggagagctccgggctcaagacgtcgactggagaggaggaggtgcggggtcgcaggtagagggagaaggagagaggaggcggagagaaagagtcgccggaggcggagaggcggagagaacgagagagaggagttgaggagcggcgggttggtcgcggctgggttggtgcggtgtggggatggatacggattaaacactgtgggccgcctccgttttttttttttgttgatttttctgggatagattcgcctcttgcgggcacgtatcactgttgccaccgcaaacgctaaaacaaaaatgttcgatttttagtctattagattgactttgagattcgtgttcatggaacataaaaaataaaaaaaaagctacgcacgatacaagaacgattttgctatatctcactcgaaagattttttcttatctctcactcgattttctcactcaaatttacagtgcattttattgtaagttacagtgtaatttatgaaacttaccctgtaacttttgtaagttacactgtaatttttgaatcttcgcatgtaaattttaaattttgtattggatttagtctttttcttgaggatatggtaatttagtgtccataatgtgtttcttaattgctttttgctttttattatatctatcggattttaatccaaagattaaaaatctgtgtgatacgatcataaaaatctttcgaaagatgtataggtactcccatacaagaatcgaccccgggaccttcgatctgggcccaactacttaaagaaagtttatttgctcagttgggataaaattagtttttctctctcaataattttaagcatctttctattttctattttcagaaatagcattagtaccattttaattatttattactgcttaataatttaattccaactaaattgaattaactaaaaatttgatttttctcatgatatggatttatttttcgactaaaaatataattatttatttgtcatgatataaatttagactaaaattaaataatattaatatgaaaatttctaaactataagagtgctcatttttttattactttactaagttaataacattaattttttccgttgcaacgcactattgaataataatttattatgagctactatatttctctctatcatttgagactttttttaacgagcaaaagtaccaaagcagtgtgaaaataacttcgcttaaaaacaaatatttttagttcaatacaccgtagcaaagcacgggcattttgctagtaatactaagatcctttcaacgcgtattgtctccttagcatcaataatactagaggctggggcgcgccaatggcgcgccgcctgtagacaggtcgatggaaagatgcgatgcacacgttctcttaactaagaaaagctaaaaagcatatggtaaaaagaaacaacaaatagtaccatagtagctgtagtataacaagccagctgtttgtacataaagtggttaattgttcactcagcttatggataacaaaaggagctgaggacaatgataagcagttataggtcacgtgcttacagagcaagtgaagttagatagaccgcaagcaaaggataatagagaattatagtagttgttccagtgtagataatagcagcgactactgaagatgcaggtaactttcacagagcatctatggtgagcgtgaggtgacttgtcctaaaaagtggaagatgcagattgtgtaagttgatgctgttggctgctgcaaagctaaccaccctgatgttaagttgttgagggtcgacctgcaatctgcactctaatgtttgctgtcttgcctcgaaccaagttcacaatgtatttctttgaaaactcggtcgcaaagtactgaaaaagaaaagtgacatttatatgctcagtatgggtataagaagatggaaatgttgtgtcaaaaattaccactctgtcctgttccatgaatgttctgttcatacgcacgacatagaacttgtttgattcttctagaaaatctgcaatctctttgatgtaactcttcaattcagctgtgagcttaatctggtggcagaaggaggtgtctgctaggttttcttttgttactgcctgctagtaaaaaatgacagaaaatgattacatatgaatagaaacatagatagaaagatttaaatcacttgtccagcatgtgcaattttgcaggaggcaatatagcacagtgttttttagccaatgtaagttggaggagtatctggctgatttaattgtatatcttctattacccggcgaaaacagaatagacatgttaatgggtagtgtaagttgaaaaaatgtgatgaggcaaactttgtacctgttccattcctcagaaatggaacgcttttgctaggagatgcatggtcaaatgtgcttgctctggttaattgacctgatggatcaaggggccttttgttcgctgatgagctgttggatggggtcttcactggacatctaataaggccttgtctgttcagtatcataacacacgctttagactgtgatggcatccagaaaagaatcgtttctccagtttctaatccagttgcctctacaaattatttccatcatgtcgtcatgtacagtgtgctagctacttccttgattttgatctttatcttcaagccatgggaagtttttaacttcagattatctccacgctgcatcttatatgctgtcgcaagtgtgattggcacaggatgtagaaagaaaatatcatatccgcactggtgctaacagcatattgtacatagaaagttttgtttgactttgagcttaccaagtagctttgatttgttgcattcagcctcattgatgcgaaaactgcggaagacatgattgtggctacaatatatatacacatgtagttagatgtatttgataaataaaaaaagttatgagaggctcagctagttattagagtttttattataatttttttattttcaaacagggtgagtattttgggatatgtagaaatgcaatgaagtatgtgatctataacttgatgtatgtaagtatttatgtgatgtaaatcttagttgtagctggaaagatatatatggtaagaacataatgtgctgggttaagtggctatactacggtaagatataagataattatgatgcaagaataggactaaatagctgtgaaaaagcttaataatttacagttgatgtaagtatttttttcagtatagtagctaaaggatttatgtgaaagagtattaattatttattgtaatttcgtgtaatggtattgttctaatgtattgaaaaagggaaatttttatattagaaatattaggaactgaatccgatattagcaagtcatgacacaaatataaaatataaagaattgaaaggggctaaagtacgagtatacatgtttcaataatgggcaagctaaaaagtataacatttatatctgaactgaaataatgattagtgagagaatatgtaatagaataggtgtatatttaggatgccaaatctacatagttaaatgatacaatcaattagtctacccctataataaaatggttatagaaaggtttttctgggtcagctaatatcaaagagggtttgtaggttagatcacttaagcataatcactgattagggctgtcaacagtacttagggttaatggtagatctatgatagtttgattgacatagaaaaagacaggaaattttatccccccgcgtcgcccacgcgcaggcgacacgggggtgaaccctaccgccgccgccgccgcccccctctcccccctccccctacctcgctgccgccggagctcaccgccggcaaagccggctggtgagctaggatggcggcggcggggccttctccgcggcggcgctccctcttcggcgtgatggaggtggtgttcgccggcgtcggtacgccggtgagaggtggcggcgaggtctcccggctaggcggcggcagatctggcgtcgccgtcgccggatctggcaagccctccgattttcggcggtggaggaggctgctgcgacgtgtgggcggcgacggctcgcgcagcggcgcgtgggcggagtcggtgctggcggcggccgctggctccggtggtcgaaggccagcgctgacggtggccgccgtctccggtggtcggcaaggtcggggctggccggggtctccatcccgccactactctcttcctcctccctctccacaaccaccctcttcttcccccccctcccctcattcccttattctctcttgtgatgtccctctcctctctgtgccgtcggcacaagcgaagcagaagtggaggtttccttcctcccttcctctcgccatcgctgctaccagttgatctctgctgccagttgtccaattgctctgctgctcgccccagcgctcctctctctctgcgctggtggtatcttggaggtggttgccgtagtcgtgaggttttgtcccgcgaaaccaggagttcctcgccggagacatggttgacaccgaggtcctgggttcccctgactccaactctcagctcctcttcaggccggccaggtctcctcccctccgtgatgcttctcccttctgttggccgtcttccagacctggccgtggagtctttcggtggttgaggagaagtgttcgtccttgaaggtggtccagtccgtctgaagtcagggctcttatgcctcgccagtgcttcatgtgccctgtgactatgtggacctatcttagtgccgagtttggagcggtgtgtttttcctcttcggtgctgagcttttgtgttaaggcggagtcgaagctgctgcatcgggtcagccgatgagctaggcaacgacaactcttaacacttttgctttggcttcttggaggtcctacaccttttgagggagtcctaggcgaaagccctgtctggtcttccaggatcggcgacatcgacgcctgcgggtgccgtttcctccttggaggtgttgtcttgtggactctttctccctttgggtgaaaacccagtccagttatgggcgggcgtgggcagcggcttctgtcgttgttcacctccttggaggcttcgtcttgaaggtcttgctcctctctcggttacttctgtggttcatagttttgtcacgggttttttttgtgtcttctgtgtaaggttttgccggttttcccttagcaaaccgtgcagttgtatggttttctggcccggtttcccttataaacagggtcaactctcttcttctaatatatccggtagatctcctaccgtctactgtttcaaaaagatagtttgattgacttgaggaagggtgtgacgctcgatgatctaaaaacatatattcggtatagagaaaatggggaatgaaaagaatagaaagagagcgaaatagtgtggtgatagtaaaggcatgtggtttggagatgagatctctaaaccctgcgaagtgagagtagcaagcgggggaagaaggatcgatggagcagcggtcaccgtcgatggcgttcctcgttggcgtcgcttttgtggctaaattcgtacacttgccctttacttggggctgcaaaccaagattgtctgcttgcagaagaattagtgaataaatccatatacacaaactatgtagaatacaccttcagatttcaagtgcattttgagaagaatcacacaattaatccatgtatatatgtgtaatcttattaaaagaggcaagaagcaggctgcttggactgccaatgattgtagtctgagcataggcagtaagaaaacatcaatttaatgggactgtaggtagcaagtaatacaccacaaattacatattaactgaaacctcggttatgttatggccaaactgaaaacataatacagcggctagaagtaagagtagaattgagtggaaaatttacccatatcatgaaatccaagggatgtacgcaaattgtctctctctgaattgatactaacaaaaaggtgtcaaaacagggaagaagcccatgagtaccagagcacttagtaagcccaattacaccaacatcgcaatgatctccaactgtccaaggctgaaaaagaaaagatatcacattatatgttaaaaaccaccaccatcaccaccacaaacaagtgagaactgtgtgccttgaaaaggaaaattacaacattacttgattaccaatagtcaggaaaaaaatatgtatttcaagggagagaaacactaacaacgtccatgaccaacaaaagcccatacattctgtgtaacttgataagctcaagcaatggagcaaagtcaccatccatgctgaacatactgcattttatcaacaagaagatcatctgagttggttacgctagccattgataccaaaataagtgatttttgaatgaagaaatttacttggaaatataacttgtctatgtgcgaaaaaaagaatattttccattgattaatgggacctgctagtgtaatcacaaacatagtttataactaaatcaattagtgcttaacattatgacatgtatgttacgactgggaagtgaaaaaaatacccatggatttttttttaagtcttacacttactggaggatgcgaagcaagcagagtttaatctcaatgacctccgattgtccaaggctgaaaaagataagagattacattatatggtataaaaacccctaagagcacaattcacattttcaggttaatcaagctaagccattaaatgaagcaaaaccaagcatcagcgcgcacctataacataaacacagatatacctcaaggatgcccgttgggataaaaatttggacgggtaaaacatcacaaaggagatcaaatggcagctacaattaggattgccaataaattaatactcacatgggaaatgagcaatgaaactacacccgcagtgatccagttgagcaccgtgaaattatttaggttacatgcagatgaaactgcagagcatgaaaacaaaaaatgaaaattaaatagcatatacaacatctgtaggaagttcaaaatatcatataacagcaaagaatcagctatagtacatgcagccaaagaagcaagctatagaaggggcatgatttaaaataatggtgttagtattagtacctaatggcacaacggttatcatgtaagtaaatcaatattcctgtcatgcttctgcttgcctctcacctgcaacctttctcaattgcttgtggaggattgaacttgtaacatgtactggtagccaagctgaataccagatcagagaacattttgtattaacaaatctgatgcatgaacattaactaatcaaaactgattgaatggctgaacatatatcgagaagggaatataacatcacatagcgtacggagataaataaaaacaactatgtaagcagcaatcaccaaatggcacatggaccagctgatatatcagtggagcatagaaaggaaagataagtggcacaaaggaaaaagtatattactatgaccacatctgagatgggtaacgtaaggaaagataagtataatgtaaaggcatccctttcccttttcctttccctttcctatgcattctctcaaatatccaatctaaaatcaaaaattgcaatccaagaacaagagaaaacagagattggcaggtcctagctcactcagctcttatttgcagtgtgcttctctacttagcagcttagacagaggcatgcccattatttgcatctgagtgctgtggttgtggaactccttacctcagtgccggttggcgggcgctgctagcctacacctcatcagtacagaaaaacaaaaacaaaatcaactccccacaacattacaaattgatgcgattatattacttcattttgccttcacttattagatcaccgaacatcagtttattgggaatccgtacctgcaaacattgccaaaaccactcaatacaacaggaaaacagtaggtaatgtcagtgctacaaatactatcacgtcattaacctgacaatacaactgaccattctcgatgatacatactgagcaatgaaacatgcagtaaaaatgtggaaccaccaactgttataaagtagtaatatctagagcattagcatgtagattagtatgactaatcactaacgagaacgatcaaacaacaatacacctgcgtgcaacaattgcaatcacaggctcgcagttaccacatgggcaacaaacacaatcgtaaattatcagcatcagtctatcactaacaccactaacaataacaaccactcaccaagaccatgccagagtggtcgcagaatgaggaaggtgaggccggcgtgggcgcggtggagagcgacccagccgcagaggcgcacgcagcggccggcatcaccggcgccgagctcgtcacacagctcgtccctcgtaggccactgcagcggctgcagcctctcgagcttcgcctcggccgcggggtcacggtgttggtggccgctagggttcggagcggagacggtgagcacgaggcctacgtggtggaggtggtggtggagagcagaaggaggcggaggaggtgcgaggcgggcagcctagggttgagcggctttaggcgggagaggaaggagagcggcgaggcgcagagaagagaggaagccattagattggacttggagacggtgggaaagcgagtagacgaagagaagggggcctgggttttcgaggaggaagacgagatggcatcggatccggcggccttgaggtcatggccatcagatccggccactccgatggcagcgagcgggtagaccagcaagttgaagacggcggttgtcagactcgtaagaagaatggaggaaatttcagaaagttcagagtttcagttaactgaagatgcaaaggagggagaaaacgtttcatcctgggtaatgaagatctaagagatgagacaaagccacgtgttcgagagagggatccgacggtgttaacgtcatgagaagccgctgtagctatcaaagcttgtcgttttgctctttacattcactgtaataattttagctgctgtaaacttacttaagctggcttttgctgtgggaagaagataagaagaatcacaatttctatttgtcttaggagtagctaacttagaaccctaggagatagtcttgcggcggccacccaaatcctaccaaaattcacaaatcgctactctgtttctccatttctggttcagggttctgacagaggtatcagagcacgagcgaatccttggctcttggatctctctggtgaaggttggtggaaggcggcggtgagatccaccgtaaaattcctgagctaggagggattcaatccggaggcgagtggtgcttcagatcggacagcaagggttgggttgccaccttcgtggtgtgcacctgtaaaatctccggcgcttctgatttgaggttggcggcggtagatccgactgcaggggtaataggggaggaatcttgaattctgaacctaacctgcaggggcgaaatggtgaccaagacgcgctcaaacgatgagattgtgggactggaggagatgaatgagtttcgctcagatgtggcatctctgaagaaggaagtagtagagcttaagggcttgaggtcataggtgaaggagatcaaggaccttctgctggagttgtgcaaacagaaggggaacgagggacaggagaatcctgtgggagatgctgcaacaaaagagaagagcacgggagaagcaggacccagtcgatctgtgcaggtaaccacgcctagtttgggagttcagttctctattgaaccaaatactatgagcctatctgcacctatgggtcaagaagctagaccacaggggggagtcagtagtgttcagacagatttggggcaggtgactactgtattatcaaaacctccaccattcataccatttgccccatttccaaaccagagggtacctttcttaaactcagctccttttcaaactcaaacaacagttgggggaagagtgcccaattcaaattttcaaacacaagggacagccactagctcaggcactgggcaacaaggggttcacatattagatcatagcagacctggtggtatggtttatcaaggagaaaatcaacattatgctgaagctgtaatcaagggacctcggttggaaataccactgttcacaggagaagatcccattgactggttgaagcaatgtgagaaattctacgagattactgggacaccatatgatcaatgggtcaatctggcaattgcacatctgcagggaagagcaatgaagtggtttagaggagtaggtattccttggcagttgattccttggccacaatggtgtcacatggtgagcactcgtttttcggctgcaaatgagcatgaggcagtggaactattccagaatgttaagcagtatggttcaactgtggaacaatatatagataaatttgaggagtatgtggatctagtcaggagggaccatccttacttacaggaacagtatctgaatagctgcttcattggtgggcttagaggggatatcaagcatgatgtgtgtgggcaaaaaccacaaggtctgttggagtcctattggtatgcaaagaactatgagaaggcagctaatgcaaggaaggtggcactgaatttcagcagaaacagaaatcagaacaccaatttcaacaatcctggcaggaacacaaataatagaccacaaaggggtgatggtgagaagaaagaagacagaaaatgctggttttgtaaggaaccatggtttcctagacaccaatgcaaggtgaagcaagctatcaatgctttactggtagagaatgaaccttgtactgaagaggaggaggatgaatcaaaagagaaggaacaagaggagctggccactgaccaaatagaggcacctaagcaggagggagcacatgaggagttaatgagtgtgtcatttagtgcagcttctggcacaactcggcctgatactttttcagtcctaatcatgatcaatgggaaacaagcagttggtctaattgatagtgggagtactgggactttcatgacccatgagtttgcagttaagtgcaagtgtcctatagcaacctcgactattaagaaggtgatagtagcaggaggaggagaattgaaatctaatcttgtagtcccagaagtggcatataaaattcaaggggtgaaatttgttaatgctttcagcttgatcaccttgaagggatatgatgtaatcttgggggcagactggatttttcggcatagtccaattactttggatctcaaacagagggaactgtctatcaccaaggaaggtaagctagttgaatttcaggatttcactaaacctgggaaacatttcttaattgatggtcataaaatggagaagctgataaaaaaaggagctgtggggtgtgtgttacaagtgaatgcgatgactgaagaagagaggaaggaggaggctgcagtgccagcagatgttcaggaagttttatcacagttcccaggagtgatgaaggagccaaaaggcttacctccaagaagagcttgtgaccatgtgataaacttgaaacctgggtcagaacctcccaaccagagaccctatagagtgccacattaccaaaaggaggccatggagaacatggtatcagatctgatccagtcgaaggagattaggttcagttacagcccttatgcctgtccagctgtaatggttagaaaaagggatggatcttggagaatgtgtgtagactaccgacagctgaatgccctaacagtgaagaacaagtttcctatgccaattatagatgacttgttggatgagttacatggggctagaatattttctaagctggacttaaggtcgggatatcatcagattagaatggctgaggaagatattcctaaaactgccttcaaaacacacatgggtcactatgagtaccaagtaatgccatttgggttaagtaatgcacctgccacttttcagtcactatgaaccaagttctagcaccttttttaagaaagtttgttcttgtgttttttgatgacatcttgatttatagcaaaacaagggaggaacatatcaagcatatcaaggcagtattgcaagtcctggagaagaaccagttggtggtacggctaagaagtgtgcttttggtctgagcagtgtggcttactt

SEQ ID NO: 59386 - DNA, 3740 bp, Oryza sativa
gatcggtcgctctctcttctcccagacctgccatacttgtctctatcatcccgataagatcgatcactaccatactttgagtggtaagatcttgatggtgatcgtgatctacgccctcgtgtgtgtctaaccggcggagagtatgatctagaccgcctgctccggcggtacttgataggtgatcttgaccgagatttcgatctacgggcagaaggtgatggcgacctataaaataggcatactagtcagtgtccatcttgcaatatgtataaagtaaaaaattgaagtattttttcttttttctttttgttcaaagtaggggcatgtctaaggttaaaaatgtgacaggtgaaaatttcatgctcccatgcagttaatgagtcatgttgctcatcgcaaaaaaaaaagtcatgttgctgaaagttgacatgccgagacatctcccattctcttatgaatgcttcactttgaatattgatacaagaaaaccacacatacatatatacaaaaaaaatgtgaaatatatatggaataacagaaccacattgttgaaaactaaagccaccacttcaaaataaagcacaactttctaatcgcatgtgccccatcaatcacctctagtacgaaaaaaaaaacatagcaagattttctgcacataagtaaatatattatctaatttcatttcctacaattgaagctgataagaaccatgagggatgagaacacagtctctgtcacctaaatcttacgagcaaatgaccataatttgttacaatatgaggagaaaaaaaaaatctaatcaacaaatactaaaagcataccgtagcagttcaggtaaaattaaagaagaatcaagcactaccttgacttccctctggcatccttctcttcgacagtttccccaccaaagccctccgctttcaacttcctgcttatctcagcagcccttgcagctgctgcttcagtggcggatttcatggtggctgcgcgcgcagcagcctgttgagctgctattgtctgctgcattatcagagcctgctggaattgcatctgttgcaactgaacagcttgctgcatcatcatgggcagattgctatttgccaaattagttttgggagggagggatttggccatctcaacattcaaggggcgaccaccaacatccatgttgttgagtgccagcgctgcagttgcttcttcttgtttggagtattctacataggcaatatgttttgagtctgtgatggtgcaatcaaccactttgccacagtatccaaatagctgcttaatatgatccaccgtaagaagtgggcttaggttgctaatctgaaccattttcttcagaacatcacctttatcagttttatctgttgaacctacaacaatggaacgtgcaacgtaagcaatgtatcctttggcaaaaaagaaacactgtttaagttcttcagtattacatattaggcccttcaaataccattgttttctcattttgtctcggctacaaatttaatgttttctagaaagatctaagatgactgaatagcgacaaatatgcacagtatcaaagctattttcagaagcactctcggtgacaaaagtatggagggtgtattaatgataaaaaaaactcagattcgtttaatctgctcagaaagtgtatgatttgttttcatccatagcaattatacaggcatttagctagcttcagcaaaacaacagaaatattgatgcaattaaactgaagttccatatagagtttgtagtagtaaagatgactaagatagtaaaaatcaagagcaacagcatagaaactgaaaccaatgcaaatatgcgaggcagactatacactcataaccctagagcatctagggacaagaaaacagcatcccttaaaggttgagggattacctgaagcctcccctcctgcagccttggaatcagcctgcatctgcgcagcatgtgcctgcagtgcctgtgcagccatgatggcctgagcagcagccatggcagcagcagatggtgccatgggcgcctggctgagcgcaccgacagatgtagtggcagccagcacggacatgagcagctgctgtggcgggtggttgagcttgctacagtctgtggccttggtgcacttgccgttgatgtgctcccggcaaatctccccaagcgaggcaccaacaccaggcagcacaaccccaccagaggcaccagtagacgcagcagggaggaggccgagaaggctggggaaggcagccgagagggcgccagcgtagtttggcatgttgggcatggtctggttgaccatgttggggtaggcggaggagacagccggaagcgtgggcgggaaggtggaggtgacgacggtggcggcagtgttggatgcgctgaagaagacggggaaggggctccccatgacgggcgacccgtcgaggtcgacgtggaccatgtagttaccgcgcttagggacgacgtaggtgacggcgtaggagccatcgccgttgtccttgactgcaccttcgaggtcgtcgccgccgacgccagctgccggggagacgcggacgcggacgcgcgcgccggcggttgggaccctgcgcgagtcccggtccttggagacgacggtgaaggtggcgggggcaccagcggaaccaccagcgatgccggggccggcggcggaggacttggaggggtcgactggaccgggaggggcatggggccggtcgtcgtcgtcgtcgtctgcgtcggagtaggcgtcccgagaggcttgggccggggaagaggggcggtggaggtcgtcgtcctggtcggggtcgtcggcggcggatgcggagagggccttgaaggtggcgtcgaaggcggccttggcggcggcggcggtctcggcctcggacttgagcttggcctcctcggcctggcgcacccagatgggcttgggagccgccatgcgaggagagggagatcgacggggctagggtttggtttcggcttggagcctggaggaggaggattcgattcgattcgattgtggggaggagaggggaggtgagcagcagcagcttctcaaatcccaaatctctcaacaagagggcaagggaaagggacttgtttctcgtgttgttgggccgtaccaggaccaggaccaggcccaggcctaagcctacgcccactattcgttgttggattaagtttaccaaatttatccttaaaccgaaataccatatataacgggaaccgcctgtgtatcactcgggtgatttttgagagattttttcttcccttggatttgcatccaacggactataaaataaacatatgtaattttagttatataggactgtaattttatattttagtttcaaatgtcttaatgttttaaccgttaaagaaatcaatttttatttagaaaagaaccgggcctaagcatccaacacacggccttatccatgcatgcagccccaccaattcttgcataaatcttggcccacatatggtgcgactaaaaaaacgtgaaatgcctaagaaaaaatcacacgatagacgtgtagcaaaatcatatataacgggtccctcaatatacaaaacaggatcgtccgaggttctaaggcagtattatgcccggttttagctaacatgtcaaagctgagtcaatgtgggactcatgggacccacatgtcagcggctaacgcccacaaatcaccacctaggaatagcaaatttccaagcgaccccatggtacaaggcta

SEQ ID NO: 59387 - DNA, 695 bp, Oryza sativa
catcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcgaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcacatactgatgtaaccttggatgtgcccgtgcccaatgaagaggaacaccgcaacattaaacgtaagtacaaaagtaccggacacccacccagatcccaataaaatccggcaaaatctgccggaaatttgtaatcccattcaccagctcctacatttaattaacaagagaactattgtatttatgtaacacctgaattatctccacctttcatttgatccctatttatagattacgct

SEQ ID NO: 59388 - DNA, 711 bp, Oryza sativa
tgcaagtagctcatcaaaactccatatcagtatacaatttagaactaactaaactttggaattaaaaaaagaaaatataagtagaagtttgagtctatattgaaatacaatttataaccttaatttataaaaataaaaaataaaaaatattgaaataagagtttacaatctatataaaaatacaatttagaaaaaaaaatgaaaatttggaatagaaataaggaatattggtagctagccgcgcagtttgcgcgggccaccatactagttgttattgaatacaaatccagaataagcctgtattcacttcgattgactgaatgaatgttctttgtttctcaaacaattgaaatatactgattgtcttgcaaatgtagcaccaagagtatgcgtgaagatggaggatttgaggtgatcaagaaggcaatcctaaacctatcacttcgccatgacttgcatataagtgcatatggtgaaggaaatgaaaggaggttgacaggtttacacgagacagctagcattgacaatttctcatgggtatggtttcagcggcctttttatatctttatgttttaatttctatttttaagctatactaacgaaacatttcattaaagggtgtggcaaaccgtggatgctctattcgggtggggcgagacaccgaggcgaagggaaaaggtatatgttcttccatgtcccctgaaattgttg

SEQ ID NO: 59389 - DNA, 19673 bp, Oryza sativa
ggtcgagttacgactactgcctggtcctcgaccagcgatgtagcgtttctcccaccacttccactttaagtggtcgagtgacgactactgcctggtcctcgaccagcgatgtagcgtttctcccaccacttccactttaagtggttgagtgacgactactgcctggtcctcgaccagcgatgtagcgtttctcccactacttccactttaagtggtcgagttacgactactgcctggtcctcgaccagcgatgtagcgtttctcccactatttccactttaagtggtcgagttacgactactgcctggtcctcgaccagcgatgtagcgtttctcccactatttccactttaagtggtcgagttacgactactgcctggttctcgaccagcgatgtagcgtttctcccactattttcactttaagtggtcgagttacgactactgtctggttctcgaccagcgatgtagcgtctctcccactacttccactttaattggtcgagttacgactactgcctggtcctcgaccagcgatgtagcgtttctcccactatttccactttaagtggtcgagatacgactactgcctggttctcgaccagcgatgtagcgtttctcccactatttccactttaagtggtcgagttatgactactgcctggttctcgaccagcggtgtacgactctcctactacctctatttcaacaaagttgatagctggtatacaatatcgccaagtgttttacccagagatcccttaccacgacgacacctagcgttgaaacctatcctactgtcccattacgccgtcttgacaaggcctccgaggaacctaagggacttcgggctggggacgcccagagccgataaggccttgtcggatcctgtagagacaaaagaccatgtaagatctggtcgtgtaagagttctcgccgtgcgtattaaccaagccgtgtatcggaaactgagctttccaacttcacggctgggggctaggatcagtgtttgttcaaccaaggcaggtcaagggtccaagagccttatcctccgagaacgattctccgacgacaaggctgggggctagggagagtgtatgactctacaaactgactgatcgaagtcggtaagagagaagacgctcatacacaaaacattggtcggtaaatttaattcattttcaatttaccatacatattataacattatcaccctttgggcattcgctcgggggctatttctatctaatattcttttctgagtattgatttcaggaaaattctattcgacattgacgaagactctatgtctctatggttctacaccaagatcgactatggcgagtacgacaaatgttgacaaggctccgtcgcagactctacgccttctcgatcgctcgagaacggttgctggatctcgacaaggaatacggaatgaagagatggtgtaccagccgagatagaatttcttgacttcaatccaaattctcgattacagcaagacgggagacttagtcgtacgctctgtacttccttggttgacatcagagattgacttagacaaacccttttggtgcccgcacgaggctgataaagaaagtctaacgttatctctaaactcaccgagaacggtaacgtgagcacgacaacagttactccagggtctgcggttgagaatatgaattcgttcatttgcattgaagtcgggggctactgtcagggttatggataccacatacctaatagtagttgactaaatctcggcaggacccaccacataccatgtcttatacagaaactaacttcagttatggagggagttccggataaggaaagacaaccagagttttacatggaaacgacaaggactactcggattgtatccatattggtttccctagttctacttggacaatgggacacctataggtataaatacaagcccccctaggaggacagtgggacacccaccatgacaggatcaacacagtcaccacgatcgacacagacgaccacctcaatcaacaaccaccacaatatacggaacaacagaagccacaacatacaagccaacatatgccaagacaagccgccggatatcgacttcagggataggcatggctattcccctacggtgtctccggataccgtcaggagagacgaaagcgctatctctgatctcgccggacacggattcgaggaggaaggctaccctgttgtcgactacgagtcagaccttcagaccgacatgtcgacaacagttaaataggctaccccacatattgtactggtgtgattatggtgaataaaagcaataccggctccggccaacaggatgtagggttattacctgacaactcaggggcccgaacctgtataaaaatccttgtctccgtctctttcacctcagtctcgcgtatatcctagcaccgacgatccccatactatgcaaataccagaattgcgacatcaaacgtcgatagttgcgtatcaagtagggggattttggtgcttcaggatttcgacttgatgggtttaagagatggattctccaataccatgctagttttcattatcgacgaggatttcttgtgcacgtacattcactgacgtgctagtaccaagtaataacaaactactcttgttttaaaatatactcctagtactcgattagacactagctatctagtagtataaatctagactgatttgatagtactatatgatgtttttttcgagtacaaggttttctgtattttagaacgatgagatataacaagaaaacatatggctacgaccacatcgtctgcatgcatgtacgtaaccccctgcataagtggccgaattagctcttgctgtggttgatggcgccgcacttgttcctgatctcccccttgctccccaccggcatgggcagcttgctgagcttgagcagcgaggcggcgaagtcgtggtcccagagggcggcgttgtcggcgtactcgcggacgtggccgcgcgcctcgtcctgcgtcagcagctgccagtccgagttgaagttgttttctgatttgctactactgcactattgagttgagttgattctaagtaattggattggatcattttgttgtcgcgtgtgcttgcttattttgttgcacaagcttcctagttattgctactgcactattcctccgttaaatgcgcctaacttgttgtttcttgttcagtccgccgccaccttcaccccaccatgggctttctccgcactcgcccagccccgctatttctccacaagagctaccagggtaaaattactgctctaattgccttgcctatctgctacctctgtccccaaatccaaatatgagggagtttggctctgcattcgcattgccaaaatcccttgtatttcttttcggggacggatgaaatcgattctgcatttgcatccacgattcctaactggatgagagaggagtgacctggagaagctacctgtgatgctggaagttttaccccctcgttgagacttgagaaggatttattgttttgtgctgacaagcaacattttgatgcttttctggtgcaaaaggttatgatgaggcgccttgagcagcgcattaggaaacaggagagggcggcaggaagtatgcatggatggcgtattgctcatctgaaggcaaaccacaggctagatttgttaaaatcagacatgaggtaagaatgaagaattttgtgaaaaaaacatgtttgtttaggttaggttttgacaaagttactatgttttgacaggggtgaccaactcaaggtgaccgcgcacatgtacagggggacctgttcgtcatatttgccggtgcacacacggtgatgagtttggtcgccggcgccataaacttcaaggaatccaaggaggcccctccgcctgagaagatgcaccacccccgggaagccctgcaggtcttgggctcttggctattatagatcgatgtggacctgatgtgggaaaaaacctgttatgtaactaaaggttaagacaagtaaaaaagaaaacctagctttcagatctacaagagaagatagagcaaattcgagtagaggtgtgtgggtacaacgagagagagagagaaaaaaaagagggttctggtgcgtcggcaaggatgctcaccgcgcaggaacgagctcggcggaggccgaggggatgggggcggcgcagggagcagcaggacgccgtccggaacagctgctcgccggcggtggcggggatcggctccacggcggggcggcgggccgtgggcgatcaaaacgggttcggaacatcctctgaactcgtggagcccacatccagtttttgatgacgtgttcacggttttgcttccaaatttctaaaaatttacccagatgtaattcgtagtgtaaataaactataatgtaattttgaacccttatgtaaaattaaatttgtgtaatggagtattacatttatatttgatgggtggcctaatctacgagtttttctttaaagaaccgacagcgggagctctgccgaataaaagaaccttggaagactaaccctattcttttctccaacaaaattgataagcttttggatactcgtggcacgcttttctaaactgctaaacggtagtttcatgtgaacactttctatataaaagttgttctaaaatatcaaattaatatatttttcaagtttgtaatgattagaacttaattaatcacataatattatcacctcgttttacgtgaaacacttaatcttcatcttaaaggaagattcaaacaccacctaagtttctctctcctgattagtattcccagaggtctcctttgccttttgtgccgtatttgttttggctatcttgttttcccaacatctaatcgagaatactgtgtcggccgggttgtcaagtttcccggtacaaatcaagtccaaaggcacagtttctgaacaggtgatcagtatcctcaaaagcttctgagcaaagagagcatatccaattgcacggccacaaagtttatggttttgtgataaaattgttagctatccttgcaattttgtgaaatgcaagactaaacttgcggtgaggcaaattcagcaatggatactctcaagtctgaaccccaaaaacatgttcttgggtgaggttgcagtacagtgccactacgcctggtgtttagagaaacattaggatataactaatccatatcgagttagtatttctttatctctatccatacaaattatatatatacaccggtcccagaagcttaatacagtaatccacatatacggtagacatctccagcacacgctatcaaatgccaacgagacaaaaagatcataagctggagaaaatgtgagagacatgacagatattagatgaacacaaggaatctggaaatctggcaaaagctttttctcagtcttggcatcctctctgaagagagattacacagggcattcattcagtttgtcaatgacccccaaaaaaaaggttaaaatgcagagactaaactttacaatggtgcatcagctgactacatctgttgtacattttggtggttgttcttctggcacatgaacagttaccattatacaacacatcacatgcaaaaaaaaaaaaaaaaacaagaaagaaacaaaaaaaaacgaaatatgatggaagggaccagaagtgttggccaattcctcaggtccctgcaaacgttgtgcaacgaaaaaatccagggctcagggagggcaagccaccatggctggctgccatccttgaagaacaatggtcaaagtccccctaaaacgcgacaggatcacgctgcccagatgccttattattgttgtcccttgctcgagagcctccgcttgtatcgcttcagcacggaggccaggttctccttccccttggggaaggcgacatccccagctgcggtgccactcctgcccttgcgccctgagactgcggtctccacatccttgatcatctccaggaccacagatgcggtggtgaaggaacctcggatttgccttggaatggagtttgttgctaccaggctactgtggcgcaggctgttgagcacccggatatctctgtgaaggcacgcacacgcgctgagagcactccgaggcttggagaatgcaggatccaggatgccctgcattacatttgagcgaaaaaaatgattgacagagttagtcttgtacgttgaaaatgagcagtttcaggtttgcagtcaagtcttgggcactgaaaaacaacactcaaattcagactagttcaggactgaaatagctcacctgaagacggttgagaacataggtatacttgccccaaagttctggcctgctttccaccagagacaggtctagcacccggcggatgcaccagacaccgaagctgacaacgagggaggcgcgccagatgcagtcgtctccgcagttaggcagtacgcgcatgtactggatgtctgccttatcacatggtggttgctgagtatcaccaagcagcagttggttgtcactggttccttgttgcaatagcttctctaccgcagcaacttgatcaatcagatcttcgtcgctgccaccattttgcttgaacagccaccctgatccttctagcttcaggagcttcgagatgcagaatctaagagactgaagaagcttcgcctcagactccttgtaagagaaatcatccttggtcatgccacccgatctgcctgcagggttgaactcgcttttagtgagctccgcactcgacacaccaaacagctgctcaaaaggttgcttagcccaaagggatcttgcacttgggtttgggctttgttgcattgagaagatatcccctgggagcttaggtggagagagctcatcaaacgccaagggagctgcaggcctggccaccgagtttgtatactgagatctttccgatgcaagcctgctaaggtacgactgggatccaatggtaccaccacccaactttgattcattcaacagagcactcctgcttgcagcaatcagtgcagatatgtctggtgagctgtggtacttctttgagtaagctgatgaaccagcattttcattcccgtcaagagtggaagggacataataggatctttctgccatcatagtacctatccgggatgttgctgcgatctgtgaaggagtagctcccaatgaagcaagcaagttctggttacgagcatgcatgacagaatcgacataggttggcacagccgatgcagaagattttggaagtcgctgtgggtccaatggcatgctagagtaaggatttcgattagcattcatctgttttaggtatgatgcgagctgatacccatgaatcgttgcaggttggtagaattggttgttgtctgcgtatgatggcgtgctaaaatttgaatttaatcttgcaccttgatcgagtaagctgttgcttgaactctgcagttgggtacttggtaactgcatgccctgagaccaggctgatgacccaatgttattgcccatctgaagcccatatgtcagatccaaattcgacatctcattcttagtagacatcagatcccttgaacttcccaagaaggcagacccttgtaaattgtctcgtaccatgggactcttcgggatttcattagcttgactgtctgctcttacagttgagctaggtgttcttacgtctagcccaagcaagatgtcaaaccttttagagctagcttcttgagtgagtttcccatggtaatcaaagagatgcccccagaactcatcaagtatggctgctagttgcctccttgctgcacggcccaaaccagataacctcgagagactcccgctgccattgcctgcatctgagcctttccccctgctgaaggtaagagatggtgggccatcatccgatgcacaggaaggattattgcctccaagtgacttgttgtcagactctagaatatttggagcctccttatcattgtccatcaaaagagctggttctacttcaatatccctttcgcctgtgctcttggagtccacactctctactgtactttcctcagccacaatagcattagaaattggctccagaggctctggccagtcaacagcaacaactgattttgactcttcaggaatgaatgatggagagtgacaggattcaggagcggtagatgtatgagcagtggaatgttgagaatcatgatcagattctatagctgtgtccgaactatcaatgtagtccagagctgatttcagacaatccacaggctgaatcctaggagaagggacaacatcagatctctgatcttcctcataggtaacattgcccgcacaagtctcttctctgtcttgagtagtattcaagagctctttctgagaaggcacagaccattcctgctgcaattcagcttcatggcttcctgatttcagtggtgtaacagccatgtagagtgaaaatgcaacagagacacaagccaccgtgatgagaaccgtagatggaaacaccacagggcttccagtattccctttcagagtgttcagccaaccactgtcaccaaacagcatttctgccataaagatgatattcgaaaacagcatgaggagaaatgcaagaaatgttaatatctccagatgcaaagacactctgtgggcacccattatcaatcttgatgaggcaacacggaagagtggcacgactgatgatggaaggagcatggcctggataatctggcagattatcagtaattggtatattccttcagcacctgcaaccttagcacagtacagagcaggaactatggcaaaagccttcagtatcagatgatgtccagagagaggaagattaatgccaaacaaatgctgcgaaatcacttggctaccaatagcagatgtcaacgagatgatgtggctagagaagagaagaaccactagaaatatagttggagccatagggtttacaaatatctgcaaaatgataaatgttaggtagtgtatatcactttaggattgctactgaaacaagatttcttcagcaccagcttagcatatcacagggtgaagtagtaggaactatagtactaacctggttcattagttctacaacatcttggaaggtgagaagaagggtgttagtggaatcagctgctgcagagttcattagaacatgattcaccagaaaaattccagtaaaaataaataatactgaaaacaagtgatcatgaaataaggcaccaacagcaaaggcagatcttttctgaccctgaaaagagattatttgattagcaaacatggatacaagctgaaaaaaaaagacaaccaaaagcataagacacaaagggcaatgaaatgtagctggttttgctgtcaaactcactaatgctatccatttttatacactttaggtaatatatatatcatatactagcaaacctaaggcaaagacctcatgaacactagacacttaccattagtgaaccaaaatatgtacacgcgaaagtaaaaaagaaaacaaatagaaataggccacagttttagggaacaaacatttactcaaggaacattctagatttgtgcttgtcaatcagaaatagtattccgcatgtggcacaatagcttattaaatactatagtttcattggccataattgttagttaagctccaaactggattaagtgagaacaaattctttcactaactaacgatgagcatgcctaacataatgctgcaattcgctagaagatgtatcttggtgttttgaaattaagtcaatgaacatcacttcaactctgcgcaaacaattgaaataggacaaaccatatctttttcagttggatacagcgtacccacaaaccactggatctattagaacaaaaacattctccactacatccgatattagactggtataactagtctaatatagtgacccttgctatcagtttggaatttctgaactgttcgaaacactagcaaagctagcaacatgtgtcattgtgtggtgtaaataattgtggcatgccattgaccattgtccaccaaatgcccaaacccccctcaccccaaatgcatcaaatcaaatataattctaactatgtaatgggcacaaagaagcatcataatttacctgaacaactgatgaatggatgtaaaagttgtgtgccattacgtttgcaccaagaagagccatcagagaataagcactttcaccactgagcttggggaaaattacattcgttgtcagaggaatttgtggttggctgaccaataaaccaagaacgtagcaaagaagcgcaaagcctgcaatgcaagcatttaatgtccccaccatcttctttccctagaataggtatatgaaagtaattgacaaatattaactccaaatcagattacaatataggtttgaagttttctatatgagataatcttcttctttaccaggtgtgatatagcatatggtagcagattaggaacaacggttgcaaaacatatcccagtgatgagatcatcatattcaaatagaagattgaatccaagtgctatcccaaaaatctgaaattgccagatattacaatcagaacaaagcatgtgcaaaacatgcagcatttatggctgaaatttctcaggctcagatctcatattaaatatcgaaaagagaagaggctgaaaataccatcgtcaattctgatgtcaacaaggacaatcctgcttgaacacccagaaagatgcatgttggcctgctgtattcttggtggcagatctttgttccatgtggaaaacacaaaaatgtcagcaacctcgaaagaatttcacgaacaaaacgaataacatagaaggatcaaagcacactgttttacagggaaagttggtttttccccctccgcaaaatggccagctagaaagggaacttgagatgagcaaaagttccttttccaccatttccgaaaacaaaacacctcctttctttgtttactatcacaacatatacaccataagggcaccaaaaaaaaagaataggattcttttgcacaagtatagttccaagtgaaccatcattttctttatcaacaggaattcacatacgagatttaggaccttcattatgaagatgcttttcctactcatcagaattcgctcagagactcaattcagtatcaaaaacccatcatcatttctaccatttgcgaaacgacaaaccgatgtcgatcaattgactgatcaaggccagagaggctggacacttttagagggtttgctcctacacttggtcaatgggggctcacacatttgcacactagtagagaagtgctttttagtcctgattcgtaaccttttgtagacctgattttttaaccgggactacgaatccgggactaaagatcgctatctttagtcccggctatctttagtcccgattggtgttaccaaccgggactaaagaggttagattcagttgctcctttattcttttcttttcttcattggtggttttaatatattgatttcactccatcccatcccaaaaatcccaaatcaatcatccccgaattgcctccaaatcctcaaatcgatcatctccaaatacatcataaaatcttaaaaaaaattacatcacaacttctacaaaattcatcacaaatgcatcacatattcacatcacacacaaatctcagatccaaatcacaaattctccaaaaataataataataacggcgttttcgcttagtggttacaagagcctcagtagcacctgaggtcttgggttcgactccccatgggagcggattttctaagatataacggcgttgtgcttttagtggtaggcgacatatccgtcgacaacgaggtgcctatggtgacttcgtcaatctcaaggatttgccggcccagttttcgaagatgcttataggggtagggtttgcgtgcgtgtattcatagatgtgagtgcgtgtgcgttgtgagtatctacattgcactgtgtaattctaaaaaaaaaagccccaaatcttttacatgagccatacaaccaaaatactataaccagagtgaataacaaattaaggtggttaattttcctcctcttatagaacaaggtggcaataaaaaattgcaacatgaatggtgtgtgtgcatggtgtagattggagaacaaaaacgtttaattagcacaaggtgcaaacttgccactaagcaaaaacggcacgcacaccaatggcacaagtgcgttcttcactcgagccagccagtatagctttttagctgttggtgacgttgcagaacctcctgacctccccccgcgccccggtgagcacctcgatgccgcccatcttcaccatcgacgccgcaaaccgcgccatccacgcggtcaggtcgccggcgttctccctgaccttctccgccgtgtcgttctggccggtcagcagcgccgcgtccgacgtgaacagcacccgcccggcgagcgcgttcttgaagtactggttgcccagcgtcgccggcgacacggggctgttgttcaccacgccgtcgtcggcggcgctgccgtcagggcacgccgccctcagcgccgccgcgtagctcgcgtccagggacgcgtccaccgtcgggtacagccggttcttgaacccggagcagtgcgcggtgccgatggagtgcgcacccgagagcgccaccaggtcgtcgacggtgagccccttggcggcgaagctctggacgagctccccggcgtcgaagaacggcgacgggatgctggagaagacggagaaggcggacgacacgttgccgtcgcggctgccggcggggaccgggtagacgaagccgccggacttggccaccgagtcgcgggcggcgaaggcgaggatgtcggcgcaggagaccttgccggggcagacggcctcgacggccgccttgatcttgttcacggcgtcgtacccgcggagcgggatcgctgtcttctccggcgagccgtttgccttcgtgggatcaagaaggatggacgcatcacaaccctgcatgatcaaaaaacaaaaaaaaaaaaacttcgtttacattttttttggggacaaaatgaagtaattaaccatcaatatctaagctttgcttgcagtaatatatcttgtgagaaattaaaactgctatcaattcatagttgaaaaactaaattaacttgtggttagcaattacattaccatgacaaagcaatcatggaaatgcaaacgcagcagcgccggggccatggaagggtcagcatcgatcaagccgtagacgacattgctgatcgtctgctcggcatttgggcacgacgagccgtagaaattgtactgcagacttgcagttgatatggagatgaggctcatagcctggaaggctaccatgagaattagcttcatccccctgctgaacattctgaattctgacaaggttgttcactaggagacagcaaagaaacgcctgaaaccgaatgaatatatgtgtagtgatcgctacctcaaaggattggttgatgtttgatgatgtgacaggcaaacattcgatgtatttataggtacaaatggatgtgcaaattgatcattgataattgagctactccttttgaatgaggagattgattaaataagagatttgaggaatatttggagagcaatcatcagaatagttatttgccagttcttgttgtctaacaacatggggagcaaaacagctagtaactgataaaacgtgtaggcgttgacatcgatccatacctggcgttgtgacggtgaacttaatttaaattcggctggagctatatagagtaaattaattggccgtccagatgcatcatgcatgtgtcaaccgaagcacagtatttgatggaaggatgcatggcggagctagaaagatttttgagcccagacaaatttcaatataactgatatttgctatagaaatttcatcatctatttactcattaatattaaaattttgtgtagttttcgctaacgagcccaagcagccgcccggtggctagttccgcccctatgaaggaggtcagtttatttggtcgatttgacaacatgtatctttatttcaattcaaatgctgttacctaagagcgatgtatttgtagaatttctttccatgtacagtagtaaattaattaactttcacgtcaaaagcttgtgttaagcgtatccactggaaaggacgctaacgccatacatatctttaggattttgagggaactatagcaggcatgttcgctagctcaaatataatcgagattatagtggtctcatcaatatttaatcactccattactgttatctagcatccgaaccaggctagattaattaaacattttcttatttgacttcccttttgtttaagaggtcctgttgactggttgggaagcagctaacctacgttcatcccagccgtgtgtcagatcacgtcaactactgggcctatcaattggcaggtgcaaagcgagcgaccaatagactagcaaccccgaaaatttccatgtacatgcatggatctaaacaaatgtgtttcaacatgtttttggaccccatttttcaaaagttctcatctgcactctctattgatttggctagaacaaatttatttttttctcccataagtgttcgatgataatcatgtcaactgcaaatcagtactacaaaaagacacataaaagtcagtattataggtgccggaataactaaaaccggcacctattatgcttttcccacccaccggagcgcccgcggggggcgctaaagggaaaaattggcacctttaagtatttataagtgccgattttgaaaaaagtccgacaactatactatagatgctggtttgtttatgtgtgttcatcttgtgttcttgatgttcatgtgtgttcttagatattcatgttgtgttcttgtgttcttagatgttcatgtgtgttcttagacgcctcaagtgcaaccaccccaaattcttagatccagtctatggaagtcgcggctgccacgtatgtcatccatctcatctcctggcttggaacccatggattgttggctttaataccatattgttacgaacccactctatgtgatttagtgaattccagcacaagcacacaattcttcctccaacacttgatacacgagtatttggggatacaaatgggagaaatggaatcaagactgagaattagcagtagattggagaagaagagatagccagggattgaagagaagagagatacagaggttgaagaagagagagcatcggaaggaagaactcaggtttcatctattttgttcgatcctcccatctgttggatctgctccttttgtaacggcttgaatgattggcttatcgcagcggattgagcctagctagccatgggctcaatatgtataccgattcagcccagttacatgacaatccacgagtactaaatatgtatgggatttagtctatgcactaacagatgcaaaatcagggacgaaggtagtaacaattcataacaggtaaatatatgggtaaccacaaatacaaatactttatattatactggagtagtctttttttttcgagtacaaggttttctgtattttagaacgatgagatataacaagaaaacatatggctacgaccacatcgtctgcatgcatgtacgtaaccccctgcataagtggccgaattagctcttgctgtggttgatggcgccgcacttgttcctgatctcccccttgctccccaccggcatgggcagcttgctgagcttgagcagcgaggcggcgaagtcgtggtcccagagggcggcgttgtcggcgtactcgcggacgtggccgcgcgcctcgtcctgcgtcagcagctgccagtccgagttgaagttgaccaccttgtcgaggttgttgcggtagtaggtgttgtccagggcgctgaccggccgcagcttgccgacgaacgccggcatgaacctcgccacggtggcgaggtcctcgtcgcgggcgttgttcaccaccgcagggtcggcgccgccgccgcgggagcacctgtagttgagcaggttgcggtaggacggggtgatctggtcgggcggcgcggcgaggcgggcggtgaaggaggagcagtggccgtcgccgacggagtgcgcgccggagaggacgacgagctcctcgacggtgaagttcttgcgggcgaagttgtcgatgagctgccggatggtgaaggtgggatccgggagctccgcctgggcctcgtaggcggaggagacgacgccgtcgaggcggcccgcggggacgtcgaagcggacgcggccgttgctgaggatgctgctggcgtcgcgggcggcgaagatgaggatgtcggcgcaggagaccacgccggggcacctcctctcgagatcggccttgatctcctccaggatgtcgaatccttccagcccgatgctcaccggcgctgccgtctcaggacgagggttctcgtcggacgcgttaaggaggacggaaccatcgcaaccctgcaatactcatgcatgcatgcatgcattgtgcaaccactcattagtcccaagtgcttcaaagctactagtacctccttagtgcttcaaaactactactccttttcactatataagttgttttggtcctctgtttcgtactcccttcattactttttatagttatattttatcttaatacaccgatcaaagataagtaattttacttatcatccatttaaatatgctactagttatttctcgtaaacaagcgatttattaatatatttacatttctcgatgcctatatagccaatattgcgtggaagaatggagagtcacgcattaaattccggaaaagctgcgcgagttaagcaaatagcgcgcactttttttattgagaaaggactcgtcgtttgtgttttttctgttaggcccacatctttttcccttttttttcacgttttgtttttttagttattttctatttttgtgttattactttgaactcaaaattttaaacttttaactgatatttgaatactttcaattcaaatttgaaacgttttcaatccatatttgaaaactttcatctcaaatttaaaaactttccactcaaaatttgaaactttcaatctagatttgaaaattttcaacccagatttaaaaacttttaactcaaaatttaaattttttaaagtcaaattttggaactttcaacttttcatcttaaatttgaaaaattttcaacccagatttgaaaactttcaactctcgacttgaaaactttcaactctgatttgaaaactttcaactcagatttaaaagttttcaacttgagattaaaaactttcaactcagattcgaaaactttcaacttaagatttgataactttcaaatcaaaatttaaaattttcaagttaaagatttaaaaattttcaactcaaaacattttttgaaaaaatatgtgtgctaaagattaaaaaagtaataagacaaaagcgaaaaaaaagataaaagaaaaaggcaaaaaaatcgcaaaaaaatcttgcgaaaaaaaagaaaaaaagaagcctgatgggcttccgggccggggccaacaggcgggcgcgcgccaattagccacccccatgaaatccaagaaagtcattaaaagaataggtggttggattgaaatatgcctatcaaaagtaaattttttagatttggaatatgatggagagagtattataactcattttaattttttttcaaacctttttaagtttgattaagtttatgaaaaattttagcaacatttacaacaccaaattaatatcattaagattaacatttaatacattttgataatataatattttctttgtgctgaaaaagttactatatttttctataaattgaaagtttgactaggaaaaaaaatagaatgacttataatgagaaatagaggtaatataaatgaattcactcataaatccatttaaaacccgaaacaatttataatatgaaatagatgaagtaccgatatgtactcactccgttacacaatgtaagtcattctatcatttcccatattcatattgatgttaatgaatctagataggaaatgtatatatctagattcattaacattaatatgaatgtgagaaatgatagaatgacttacattattaaacggaggaagaaacaaaatataccctgacaaaacaatcatggaagatgagacggatgagggagccgcctatgccgcggtcctgtatgatagtgtggagattatgggtatcccatatctacacggcgatggtattcgaactgggtacaggatacctaatgtagatagaatatcttatctgtatctcgggtttgtttcttaacttgtgtatcaaggaaacacccagagacttagtcggttacgactgtattttatctgtatcttcatattccgttaggaatatagattatcttttgtaatccggactccttcccatatataaggggggtccgggcgcctctaggggcatatgctgattttttcccgaatcatacaatcaataatacactcggcggattcatccccggacaggagtagggtattacttcttttataagaaggcctgaacctgtataaatcctttgtttccaaacccatacactttcctagcttgatagccacccccttttattattgccgaaatctagtttcgacagttggcgcgccaggtaggggtagcgtcaagctttttcgccgatcagtgcaatgggttccatctccggcatcgacgacctcgtcttcccacccgggcagacgtttcggttcggcagcctcgacttcatcaccaacaacttcggcaagatttctctcctcgactcggaatcagaccagtcgggagagaaccggctttcggtcccgtttggattcccgaacgcggctgaaagctatttcaagaccacctcaaccgagtcggcttcaaaccactcggccgagatcgcatcttctccacgataccagatcaggatgatgggccttacccaccggtcctgatgaagctccccgacgatttagcggccgtcttcaccacgacagcgccttcatcccgtaggcctagccggaagtcggcttcaacaccgatttcgcctagcttcagggaagtcggcgtcatcctccaaccactcggcacggtttcgacggatcagctggatgactacaacagctctcccaccgtcgactcacgtcctactgacatcgtggagtacgacgaatttagttctcgctacaacgacttcgacgacttcgacgacttcgacggaagcctagatgacaactacacccctctctactttggcgttttcatggccaataatgagacggaggagcaacgccaagccagggagaacgaagaacgtcgccgactggaggaggagcatcaagcgcaagaacaagaacggctacggcgtgagcagcaggaccgtgagcggaccgcgaaggaggctgaggatcgacgtcaacgagctttggaagcagggcgccgagcgcgtgatctcatcggccagcaagatgtcgaagggacaccggttttccgcacccctcaacagaatgcggttgccgcgatcacccttctcgacgccctcctcaaccaaaacgagctcaatcaatccgaccacgtcgtcaacatcttgacccagacgaagaccatgattgcggcgacggtccct

SEQ ID NO: 59390 - DNA, 6209 bp, Oryza sativa
tggtgcaggtgtttatggataatattcacaaactgcatgggatgccgatagctattgtgacagatagggacagagtttttactagcacattctttcaagaagtgttcaaatctcaaaaggtccaattgaggtttagcacagcttaccatccccagacagatgggcaaactgagagggtgaaccagtgtttagaatcttacttaaggtgcatgacatttcaaaaccacaaaattggtgctcttggatagctttagcagaatggtggtataacacaacataccacacagcaatacaaatgactccattcaaggccctttatggatacagtccacctcaaatcagtgaattttctgtcccatgtgatgtatctcaagaagcaagggtaaccctggaagagaaagaggctatagttcagaaactcaaagcaagcatggaagatgcacaaagaaggatgaagtattatgctgataggaatcgaacagagagaaagctggaggtgggagatatggtatatctgaaactacaaccctatagacaaaatgcttttgggatcagaggatcattaaagttaagaggcaaatactatgggccattcaaggtgctagagaaggtaggtgctgtagcttatagattgcagttacctgaagaagctgctctacatccggtcttccatgtgagccaacttaaaaagcacctgggtactcatgctgtaccaatgccaaatttaccggcagtgggaccagatggtcaaatcaaaacagagccagtagcagtgctgcaaaggagaatgattccaaggaacaatgttgctgtcactcaatggctaattctgtggagcaatttaactccggctgaagcaacctgggaggatgcttcttatattcagaaagtgtttccaaattttcaaccttgaggacaaggttgggcttaaggggggagtaatgtcagactcgtaagaagaatggaggaaatttcagaaagttcagagtttcagttaactgaagatgcaaaggagggagaaaacgtttcatcctgggtaatgaagatctaagagatgagacaaagccacgtgttcgagagagggatccgacggtgttaacgtcatgagaagtcgctgtagctatcaaagcttgtcgttttgctctttacattcactgtaataattttagctgctgtaaacttacttaagctggcttttgctgtgggaagaagataagaagaatcacaatttctatttgtcttaggagtagctaacttagaaccctaggagatagtcttgcggcggccacccaaatcctaccaaaattcacaaatcgctactctgtttctccatttctggttcagggttctgacagcggtgaagtcgacggcaggctgaggatggcgacgagggcggcgaggccagtagcccctgccatatggatgtcgtctgcctaagccaccgccgatgtgtgccaccacgaagcaccgccttcgcctccccctcgctccgtccccatcgcctcgcgccaccaccgcccactcgcgccgccgctaccactcgcgctgccaccgccgccccctcaaaccctagccgccgccagcctctcccacgccgccatcgagcgccgccgcctccgcctccccctcgtgacatccccgtcgccgtgccccgccaccacccccgccaacgctgccgcctccacctccgcctcgtatcaccgcggaggccgtgcccggtgacggcgacggcgttccgcgaggggaaggcgctcggcaacggcggaggcggcgacggcgacggcgtgagacagaggcggaggcggcgctcggcgacggctccgtgagaggcagggtgagacgagagggaggaggggactggcggcggcggctagggtttgtgggagggggagtggtctagtgcacgtagttttgcaaaaaagcccctcggttttcactttttagagcgcggtcctaaatcacgatttttctctccttcgcatggaatatccgtttttctgaaggacctccacgtaaagtaacacctcatggatactgtttgtgagggacctcgatcgaattacgcacaaagaggagggtttttttcgcaaaatcgccacccctgcactgtagctatccgacgtggacacgccgagcagccgcccagcccgccacacttaatagtttgggggtaattgtgttcttgtccctatttacaactgcaattgtgattttacccttgtatttttaactctgtgattttaccctcactattttgaactgaagctcaggtatgccctgttccgttaggaggacttaatggtgttaactgacaggtaaaaggacatctatgcccttgcagatttggcttgtgaggactttgtgttttggctgtgtttcacgattacagtagaaaacggaggtatgaacttgccctgcatgcttaattattttaacaacgaaatccaactttgtaactacacaagaaatacgattctccagcatatgtttaaaaaaaatcaagggatttattaattaagaaacactatggactgaggtatgaattcaatgcctcaatgcctgacgtatgaacttgccctgcatgtttaatcattttaacaacctaagggatttatgaatatgcaaacaagaaacactactctcatctctttctttcaacaacagaatagctttgttggtcctgtccagtttaggaaccaaccaatagtccaaggcagtaagaaaaataaaaactaaagggggagtgacaaagaagaaaaagtaaaagacaataaaactcaaatgttcctctcctcctctccttgctgttcttctcctccttgtcaccatcatgcctcaggcgagctcctcgcggccatgctaatggtggcaaggcagcctagctagctacgcatatgcagcagtacgtatgtactcgatcatctgctgtgcagtggttcgggcactatagccgaggccgatgccgacgagcccagtgaccaccacggcggacggcgacgggctagctcagcttgacatcgccatttcgcgccggcccagcctgcttcaccccgcgctcctcgctcttctcgcttgcccgcgtgtgccgccaccgctcgcgagggttaggaatcggggacggaggtcggaatggggtatggggatcgggaggagtcagcagtggcttaggttgaaaggtttgggatagagatgtctttttacattttgcaagtcaatttcttattttcttaaactcatttaatctgagtccacctaacagacgtttaaaccaggggcaaacagaccattcaacatcaaaaagtgagggcaaaatcacaaagtttaaaaagtaagggtaaaatcacaattgcaaataaaagtaggggcaagaatacaattgccctaatagtttctaattgttagtgtcttcaatgaggctgtacaagaacctgagcacgggtgaaatgtgtaggatccttggtaaattttgttctaggttcgctgctgaccacggctggctcatgcatgcatgctgttgtcatcttgtagcgcatctagccatgtatcagtgactctagtttgattgttttgacgaagatcattttagtacctgccgtctatttgattattgtacggtaaacagttatcaaggcttcatggctatgccatttagctttgttaaacaataccagatagctcataattaattaagataaccaagactaagaaaaaaaacagagaacaaaggctacaaaattataaatactcaggtagatgataattaagagaaccagagctacaataccagatagtacaatttttatattggaagctaagctacaaagctaaaagttacattcacagacactatacattcataaatgatgtaccagttaatgtcatactccctccgtctcaaaagagccaacttaggtaccaatgagacattacatagtacaacaaatctagacatgtcccatctgtacttaggttggcttttttttttgggacgaagagagtattttcgagcctgaaaaacaacgactagcatgcataatgtgcagctttcagaacaggtagtttgtgatgccatcccatcactagcactagcacaaactgagagcagacatcaacaaaaacaccaggcattacagctaaagttccaggaacaaaagtacaagtttaaagctctaatgttcagcaggcactttcagcgcttgaagtatgtttcttgttgatctccctcctgtattcttcagatgttgctcccttctcttccagctgatcattgctccaggctcctggaattcagccttcctctgtttcacttttcctccaatttctgcaaaggtaaccgggatttaataccatgtaaagtataatagacaaggttagttggattttaaggcatttttctgcttaaaacaggctgcatttcggttttccagatcagtgccattattcccatcatcctcttgtcaagtttgtcaatgtctctatgaatcaacagcttcaataggacatttgcaatggcatgtgaaactggtttctcagtttaaatatgagtaatctcatatctcatccagtaaccttgcaattctgcttacagcttcatgaactctcttcctccatgttatcttcactatctattaactgaagtggtaccttttcttttacgtaaaactgatgtggtaccaatcatgcaaaataagaatctgaagaatgcaaatgatagcgcaagaataagaggtgaaaactatgaacaatatagagtagcaggatcttataatatactcactaaaaacagataagatgtatatatactgctccaaacaaaatggcataggagaacaaggttcaggaatcgggagatgaattagcttaaaaacttggtagcttcaaccgcacattatttacttaaagttaaagaagtgatcatgaaaagaatcaggtagtaatccgtagtttttttgttttttttttggtctaccacaataaaaatcaactaattggaagcaacagttagcataacgtatatgcatcaaatttctaacatgaattcacaagaacttgtactaaattactagaacaacattatgttgagtgagtaggcaggaaagtttttcaatacaatagacagcaagaaaaagcgcaagaatcttgcaagaactgaaacccaacagcttcgcctcacagatcaatcattcaatccccaaatataacatccgagaacaatttcaaatcaaccgaatcgagggcacacaatcccacgagaagcatgcacagcagggcagggagagaaggagatcgaagagattgaggggagcgaccaactcacaagttgacgacgagcgacggggaaggtggcaccggtgaagggaggaggacacaggggaggtggcaccagcgactgatgggcggcgagcggaggaagcggttgtccggccacgggagcggacggaggcatcgtgttgtgtccacagctcggcgctaccgagctcgccgccgtgcagcaccagcccgcgatcgccaccatcttcctcccgaatccaagccccagcagccaccccatcctcctcccgcacactcctccttcggtccttccatcgtggccgcggcggcggggagacattttctcaaacagctcgtgggcaagccagccgccgcccgccggccttgcacaacttcctccgcaagtcgcatcccaccggggggtgtggggcccacaaaatctcagggccggacatggagcaaatggtcccaggtgacgtggtccccacgtaactaaccgactgccagatcagatcgaacacgcaagccaagcggccaacgccacgtaggccggcgacggcgagagctcgagctctgccgctgtatatattcgctcgctctcgtgtcgccgcagcgagcaagccgacgccgccctcgcctcgccattcccgtaccacaagtcttggtcgacctcaacgcaatggccgacccgtcgcgatccaccagcagcggggcggcgaagaagccgtcgccgaggaatcctcggtgcgccgcatgcaagtttctccggcgtgcttgctcgccggaggagtgccggttggcgccccacttcccggccagccagccggagcgcttgcagagcgtggagcgcgtcttcggcatgaggaaagtgctggagctggctcacaaggccgggccggaatacctcgacgacatcctcagctccatcgtctacgagg

SEQ ID NO: 59391 - DNA, 23247 bp, Oryza sativa
gggaggagagggacgatctcatggcggctatcgtctacgaggcggatgcttgggccagggacccccggtacggcgtcgccggcgtcgtgcggagcctaacgaacgagctcgcccgcgtccgcctcgacgaaatcgccttccacctcctcggcaccgacgagacctacgacggctacaaggaggaggacgcgctcgccgtcgaccccgtgagcggcgcccaagcgggcatcggggtgctcggtggctcgggcgcggacctccaagagaataccggcatcctcctcggcgccgacgagccaggcccaggcgagctcgccgtcgacccaatcaaagacgtcttcgacatcgacaggttactcgccgtcgacgatgacttgtcctccgggacccagccctgataccaccgccggcgacaattaatggaaggtacgtcctgtccgatatccatcaaaatgctttcgttcctcgtaatcatcatgctttggtgaattcttgataacctagtcccttcgattagaaatcatgcataaacacgactagtgaatattcttgtaaaacatttgatctacaccgaaattccccttagttgttgatgatgtgaacttcttgcaagacgataaaataatcaagtccgtgatgggaaattattgtaaaccgaaatttttgcttctagaacagttcggccctccttttgattgtactgctagagatcatctcttcctctgggagaagcaaaatactgaagcttttccttttcatgttcagaagttgcaaaaaaggctcatgtgcaacagaacagtaaacttccttgagcattgaggagataagtagataacatatagtgctatatatcagtcataggcatcggaatatcacaggaattgatagacagtgtgttccttgcaaactacagcatgttcaacacttatttacttatttggtgaacagaaaattggacccacaatgaggtgcctcaccagttaccagcaagtttgctattgaacttaaatgtcgctgccaatttgaatcaatagggcgtattgaattatgttttacaagttctagttttatgcacacatgtttgatcccttccaacagtgttacaatcatcagccagcaggcgatcatctggttggcactgagaaacagcattttaactaaagataatttatttgaaagagggtcttgaaaaggaagtaagaaatgccaattttgtaatgaagaagaagcaatagatcacttgttctttaaatgccaattagctcggtttgtgtggagtgtaatgaactgtgtttttgcctgtggcattccaaatggaatgagggatgccctgggagaatggatgaaacaatttaataggacttaaaactggggggccagggggaatgggcttgcctttttttgggcaatatgaaaatgcagaaataaagcttgttttgaaaatctgctaccaagagacccgttgacattttttttttcagattactcactgtatatcatcatggggaatgttgcagagcaaggaggacgaagcagaaaaggcaggtagaaatgaggtgtatggactgcagcatggatggtgtttgagaagaaggatacaatggtcaagatgcagaatgggtttttgtagcctggaatgtgatactgccatgaccatgctgctatcttccatgaaagatgcagaaagtgttcttttgtcgcctggaatgtgatattggggctcgagaaaatggatatttggctacgttcaaaactgggtttcgctattatgccatcctcaaaacgtgattcgataaaatactatttccgagcacgtattactcgccaaagtgccatttttgctgttttattcatttccaaaacgaatttcactcggctgtggggtgatgagacgaaaatgccctgttgacaggtgggaccccgggcttgttatccccttgcagcgagctcaatctttatactgtacagcaatgaatggaaacgaagaattgtcgtcggcgcgccgcacggtggcctttcggtagaaccacttccctaccaccgaccccatcataaacaacatcgacattgccacgatgtctcatcccgcgtcgtcaccgtcacagccagcttcttcaccgccgctgccggcttcttcacgtagatctcatctccccctcccccacccgcctcttctctccctcctgcagagaaagaagtgtccgcaaacgtccccagcagccgccgcctccgcccccttgagctccttccatctacgtcgtcgccgtcgctgccctccttgagccccatcgccgtggacctcccaccaccgccgccgcctcctacggacgcgacggtgattgccgccaccaaccacctgctccagatcacgcgagcctcgcgaccgaagagctccgggcgcaacggtaacccgccggtgagggagctcgaggagggaggagggattgccaggagggaaagggatgaagcgtcaccatccgtggagataaagaggagggtgggacccactgacatgtgggccctagtaatttgatgttttgtttgactgacgtgtgggacccacatttaaaaaaaaatcaattgcactcctagtccacgtcactaccacgcaggacaaagacgaagtcagactagtcacatagacgccacgtcatccaaaccgccttaaaactttatgtgcactggttttgtaagttgggggatgccttgtatccggttttgcgcatcagggatgaaaatcaaactggacgacaaattgagggacctaaagttcagactggcgataaattgagggacctaaagtgaacttattccgagtaaaaatgggtggacattttatattcaagaaataataataataccagcaaactttgcagcgaagttgcataaacacaaacacataggaacaattatctctgtaattcgcagatccatcatattgtcacctgttctaataacttaacagtataaagtattcacattgataagactggcattcgtatttttcctcggctacattgcagagacagtattgtatatctaacatcacgatttttttgctgcgcccagcagaatttacagtaacaaatcttcaatcctacaaactcctggcttgcattacctgagagtgttcgtttcctatatttaagctctgttccaggagcttatgctattcatagtacagacttctatcgaagtgggtaattgatatacagatattcagacgttataaacacgttccactattctaaggacagattgtattcttctcatgcctctagtgttccacgaactgcatcggctccacaaggtatgggcagtcatcaacccaaccacaaggccttccgacgaactcctcgacatcgaaggagccaatcccagccttttcttcctgctccattccagtttcaggtaaggcgtccagctcttcccagacatcatcacacatattctcaatattctggaaattgcacattggagtggtctccactttcccaactgtgccacagccagtgctccctggagaaacatcagcttccatcacagatgcagcttccatacctttgttcaatggcgaatcagcatgctgttcttcgttttccatcagccgttgtcttttcgcggcgcctcttaggccattcttattcacatagttgagtagaacctgctgcacgaaagccgggttggtgagtaccttggcaaagaagccgatggtctgctgttgccttctctcgatgttgcggaccatctcctccatggcaatgagctgagatttacaggcgttgtactgctgcttaagcatgatgacctcagctctgagggctgcacggtctctcttcaagctcacaacctcaccaggagcctcaggctgtccaaaaacaacacttgctttatttcttagttgtgaatccacgagaggcttggaaacacgcctcctcttgatgtttttcagcaaatgcttctgaccagctaagaaggcttcatttgcaaactcccaccgatctggagtgacctttcggaacccctgcatagcaacaacaggtagaggccggtaagtttttctagaagcagctgcagggaaccaaacccagtctagaaagtcagcagtatttagggattgaaaactgtcaatggtaggtatacgcatattaacaaaagaatcagtctatggttttagtctatcagagattaaactagcaatttcacttctgtgttctaccgttgaaccacaggaccagcattacccagaagctagaaggttcagttgcctgatatgaaatgtctatttacagcaagaaaagtatatagataatatcaaaacagcaagaatggtggtgccattagcaataaacacaaacaggccaaataaccgagaacacactgctagataagctcattgacaagaacaaggtaactgttctgtacttctgtagctcattgaatcagataagctcatgtatgtacaaaagcacggagctccacatcatcaaaaaagacaaaagaaaaagtgggggagcatagttcacctagatcatgttaccatcacctttcccttttaactattaaaggtatggacaggtcatgaggtattaggtctttcagagtggtggaaaaagacttcaagatttcgagtacgacatacgagctacctggacacttgtaatgcccacaagaaggaatattatccactttaagtattttagggatcagtatcttggattgcaacgtgaacagacagaacataggtcatatccagtgacagtggagcagatgaaatccaatccaagtgcatcatcacaaaggggctaaaaaccaagacaaacatttgtcccgtagtacagatggatgcaagtaactagcatgactttgcatcgtacaatacaagtataccaccactgaacattcagcatcctacaaaaacatggctgaggatttcagtttcttggtaagacaaaatttctggtatgcaccatcctaaactagaggtggaacaaaattgtatatacaagggatggttctataccatttgcagtccaatattaaccaatttaggcatgatttttaaattctggtcaaacttctagaattctcctgctattatcaccaattttgacaaaacaggatattgtatatgcgagcgcattcgtggacacgaacaaaccacagcataggacagtaccagttcatacatgatacgattcttgattagtacggaaacgcagcaaggatttcccacgaatttggtatcactccttttcaaatttcattctcataatcagttatcttgttcgatcaactaacaactattgtctcaccagcatcaacgattcaatttacacgggaaacagaagcacacgagaccgatcagcggttcacagaaagaacaccacccacaccacaagcagcagatcgggcgattgggatacgtacgtaggtgttgagctggcgaacgaaggaggagaagttggcgtgcttgaagaagcgcgggagcacgccggcggcgagcgcgtgcgggtcccacaccacgaaggaggcccccgagccgccgggcccccacgacaccaccgcgtcggtggccgcgtccgccaccatctcgtacgtcttcgccacgaacggcgccggccccgcctccccgagcccctccatcggccgcggcggcggcggcaccacccccagatcacccccgccccacccctcccccgcctcgggcttcacctcccgcttcaccggcgccgccgccgccattcccccctcccctcctcctccggagaagcggcgggtggtcggcctggggatgagtagtcggcagagggaggaggaggaggaggaggacgccatgtgggaattgggatgcgcggcgcggcgagcgctaggtgtttggggtttaagcatttgacacgctcttcgcctccgctataataatagtagagaaagccgttggttaaccccacggggggaaagcggtggcaatgcatggctaacacgagggcacggattgccacctgactcaccaccctcccctcctgctgccgcttgtgtgcactactagcaagtgttttccacgttcacactagattcattaacatcaatattaatgtgaaaaatgtttacattgtaaaagggagggagtagaaaacttctctagataatgagtgtgacttaataccacatccgtcccaaaataagtgtaatcgtgagtatccgtgtcctacgtttgatcgtccgttttatttgaaaaatttataaaaaaaattaaaaacaattagtcgcacataaaatactattcatatttatcatctaataacaataaaaatattaatcataatttttttaaaaaataaaacgaacggttaaactttagatataaatagtgtaaaactgtggacggagggagtagtttatacacatactcctttcgtcccaaagtaagtgcagttttgtatgattcatctccaatgtttgaccgttcgttttattcgaagaatttttatgattactgcttttattgttattagatgataaaacatgaatagtactttatatgtgactaatttttttaaaatttttcgtaaattttttaaataagacggacggtcaaatattggatatggatttttacggctgtacttattttggtagagatgtagtatatattgatttgaaagaagcatgatgttggcagttttaagaagatgatggtacggactacggagaggttgccagttttaagaagaatataagtgtttgtgtctcgtctacaagaacgtgcataaatataatggtttggtagagggactggtaaactgtagaaatgcttttaaataccgatatgtctttttgtaatataaaaattcaaccgaacggtttcgatcagcccgggtagctaatattgagattagcataatggctatcacgtacggagtagctcatatggctatcgtaatgtggccaatggcatgattttcaactttgagggccttttcactttgatgtcattttcaaccttaccaagttttgataaagttaccaaaaaagtggttacatttagtttactgccaaattttagtaactatataagaaatcctgccaaaattttggcaagttaccaattttggtgccaaaatttaataagtttttttttttttgcatcaaagtgaacaggccctgatactttgagctacaaccgatgagctgtggaaaattgaatgaagttgcatacgatgaaaaactttaaaatcaacttaaaattaggtcctaaaattatggctgataaactaacaagatgatgagagataatataagagaaatagaaacatctagtcataagaagaatgaatagaaaaaagaagagagaactatggtattgtcttacacatcttgaagatgttttcatggctaggccaaaaaccatttaaattttgcgaaagggcctgtagcctagtggttacaagagcctcactagcacctgaggtcctgggttcgactctccatgggagcgaattttccaggatttaacggcgtcgtgctttcagtggtaggcgacgtacccgtcgacagcgagacgcctgtggtgacttcgtcaatctctctagaatttgccggcccagtcttcgaagatgctcataggggtagggtttacgtgcgtgtgttcataggggtgagacgcctgtggtgacttcgtcaatctctctagaatttgccggcccagtcttcgaagatgctcataggggtagggtttacgtgcgtgtgttcataggggtgagtgcgcatgcgttgtgagtgtctgcgttgtactgtgtaattctaaaaaaaaaccatttaaattttcaatgagttttagacccctttgaaacacataattagcaaaatagagaaacagaaaaaaaaatgaagaaaatttacataaatgtaagtgcaaatagaagattatgaaaaaaaacaataattatcatttggataaacccagaaaaaacacaagaacgggtcgagagagataaactcttctaagaggttaaaactcttactaattttcttcaaaatctctaagaccattcattccatacaaatttaaaagaaattgataagattcaattaattgattcgaagttctttatagaaatattttatatagaattaaaatcctctaaattttctacagatggggctgcccatgattatactatccctccaaagttggtgcacaaaacaacaaaataaatctagctgacacgtgcgagctcacgactagtccgtctagctgacacctgcttgactgctttattatctcgagtgcagcacagtatctccggcaagtcatccgcggcaggcacacacacactggtatcgcctccggagcatccacgtacacaaggctacagccacgtcgcacaagggtaggggagccaacgaggcacagagccaaacaacaacctgccatgcgccgcgcaggcagcgactccatccccggttagtcatcaaacccaagtattttttctatattttttcaatggtttttttgaagcggcggggtacgtgtagaatttcctgacgaattcatcggcaacaggagtccgcagcttgcatttttcttctcatcttctgcttgtcattcaccagtctgaaaataaaataatcctggttggatacgcagggaacaagagcacccaacaagcaaagctcagcatggcgtccagatgagagatcatgattagtgttcacgaataaactactagcaaaagaatggttgaaatggattcaaggacagaaggcagtggttaggagagccaagaagcgcacacagacggctgtttgaagttgaaccctgccagctgcgattgtgcagatgttggatgtgtaaaaatttggccaatcagtccaattgcctagtttatttcgtaaagataattcggtacatggcactactgcttctgctgcagctgtccctccacagtgagggcggtaaagggtgcagaaactgtgagctcttagatgttcacgaaatggatgatgtgaaggtgcagaagagctatgggtttttcgttacactgaaattctgtgcctgcccttggcaatcctgcgcgcaatcaccttacgcccacctttggttgattttctattgatgaaaaagaaattaatggaatatcaatgcactgaacacaagcacctgaaccacaattatgttccagaaaataccaacaaaactaacactggtggtatgattggattttggtattcaaaaataattttcccataacaatgcagtacaaaagagaatgatattaacttgaaaaacatagcatcttttgcaggggccttagcacaagcaaaacaacggaaagttcaatcagattagtagatatcaataccgtgtaagaaacccatgggttcttttccgcttgatggtactgggctgataagttctttttggaagtagctccaggggttcattagcaacaggatcctttcctaagaagagcaaaaggaataagaaacaaattagaaaccatggagccagtctgattgatgtaaataaccatttcgccctagctcaccagatcacaatcatactcctagaagctaacttactagccattttagtagcattcatgtaacaaataagacaaaacttgagcagcagtacaacaaacaatattatatgccaccacgcagataaacccagattgcaaaatatgagttcttccctatttctcaaaatatatatggccagaatttagatttgaagtaattaaaccacaacatcataagttgagttggttgtattacggttatgtatgctaactttgagttggttggttgatgggtaactgtgaaatgttctgcatatgatgaagaactaggtcccgatcggtgatgtcctcataagcatatctctggttgctattcaagctaagaaattgcatccaactattcatgagattgaaaatagcatatactgtattacaattattgcatgattccatgcataatatggtgatcattaagtaaaatctgaaggtaattcgccaaaccacaatatgaccaatatcactatttgaaactgcaagtcatcttttattattttcataaagctgttggtcaagacctggtccatgttatagattaacaataaaaagagaacaacagacagtagtacattctatgattcacatgtgcaaaacataacaaaattgcatatcgatgacaactccttcacaattgcatgatatacaacaaaaagggaaacaatagacatcttctcaaatcataataactccaagcaataaaatagttgccaataccaaatgctacaaagaattaggctgcccacgcaccaaatcagccaaaccaagggacattaactaaagtagaattcctaaaccactctcacagcattgagcaaatgaaccaaatttcataaacattcacactggatcgagcgcacgaagcatgatatgaacatattatcccaattcattcgtgcacactccgcaaggcctcaaccatagtacattctatgattcacatgtacaaaacagaacacatgtggaccagatcgaacaatcacacaacttatcatatcaatgacaacttcttcccaattgcatgatataaaacaaaaggggaagcagtagacatcttctcagcttataataattccaatcaataaaacagttgccaagacctaatgccacagttaagcagtaaaaggactgcagagaattaggctgcccacacaccaaatcaaccaagggacattaaccaatgtaaaattcctaaaccactctcacagcatcgagcaaatgaaccaaatttcccaaacattctcaccggatcaggcgcacgaaccatgccattaacatattatcccaattcattcctgcaagctcctccaagcctcaaccatagctaataatctaagcacaccaacacgactgaaaccaaacagagcaagcatttctgtcgaaatcagataccggcttcaactcattatgtaatgtcctgcactatatgcatgaaatggcatggtaacgattctttccctccttatacatcccccgttcaccattgatccaacaaaaaggataaagctaacgcacgatccgaatactcaaacaatgcagcggccatcctaacaagggaggagaggaccgtaccgtcttcgatgatgaaccggagcgaggggaggccgcaggggaaggagatctctcctgggagcgagctcagcctcgccaccgcctgcgcctcgtaggcctccaccgtcgtctccggccgcggctgcggcggcggcggcggggggacgagcggctggatcctggagagcagcgacggcggaggcagccccgcgcgaaggggagacggggacgcgaggaggcggccgaggagggaggagcccgcccgcgctagggttttcgccgacgacattgccgaggacctgagaaaccctagctttccgccccactttctgctcgagctaatggtgaactggtctcgggccaaatgggcctaattgactgtgtggagtggagcccactttagctagctaggcccaaataagaaaacaagcccagccaatagcagtggcctaactgtgtgacttttttttttctaaagaaaacggtaaatttatcgggatgacattagtactccctccggtgccaaataatagtcgctttagattaagaaacacagtaaaaaaaactaagaaaataaaatagtcttttttcttaaaaaacatagtcgctcacagcgtgcgggtacaacctgtccttaagcactgaaaggacctttatatcgcctagaggggggtgaatagacgtttataaaaattatcacaacttcatagcatattggaatgatgagaattttatatttaaatcggaacttccggtatgtgattcgaagttccgatctcaacagaaaagttaggcggataacggaataaaacactagctatgaacttgtacctcaaacaaacaaaatgtgtatgaatcaaaatgtgacaaataaggtatctaagtaagatataaggtcaccaactaaatcaattaagcatgcaagtacatcgggtaaaaataagctcaagcacaatatgagagaatgcaagaatgtgcaaaccaagagaagagacacgtgatttatttcccgaagttttccgttgaggagctacaagggccgggtctatttcaaccatttcctcacgaggtagcacaaatgtactccttggtttcactcttgattttttctcttgcggaggcgaaattgaagccttcacaaactttccgtagcacaccacaaccttggatgctcaccggcgatgcctaaccgtctaggagaccttagtccccaaaagtaacaaacacaatcgaagatttgcttgctatgaactcgagtgctcaaagtatagagtgaagctcactagctctcaacttctcaatctctcaatccaactctctccccttctcaaattcctcttacaaagaggcaccacaaaggtaggaaatgtggatgtctatttggctttggatgtgtctaatactccccaagaacaacagccactcaagggaggggtggaggagtttatataccgagcctctcaaaaactagccattggaggcaaagactggaattttcggaacttccgaaaatttacagaagctaaactcggtttcgcagccattttcggaacttccgataatttttcggaatttccgaaaagcacaaagtaaaataaccataactttttgctcgggagtcccattttgatgatcttagactctatggaaagctcactcagaggactacccaactcaaccaaaaacaagatctaaaatcacttaaaggataggttaaagtttagatttctctcaaggtagcactatgataggtcactttgatcatcgagacatacacaaacacatcaacgttgcatccctcttgatagtacgggattcctatactcaaatttaaatagtaggagaattgtactaatggaaatgctttctttccatcttcctttcattgttttaagggacgccaacgccaaaaccgtttcaccatatattcttcaaatgattgatgtggttacttgtagcttcaaatggtctcgcacggtccatcatgacaaagccgtcactcgcccttcaccaccggattcagttcttcggcgccaagccccttgcttgcccttcaccgcgcatggttcatcacgaccaagcattgcttgtccttccccgtcttgccatagtagccactttatatcccacatcttcaatatctccattttgtcattcttggtattattaggtgtaatgataccatttgagtatcaacacctttgtaatccttgggaactatttctctcattcaactcaataaaattattagtctcaatgattcggttgtcaacttccacatattgaccaaccgatcgcatatataaaatgagatgaataagtgatgagtatttgatgagtattaatcaacaccacaagtgtgatatactcaaatataaagatctcaattaaatgaaagtgaataacttggatcaagtgcatgcataactaaggtatagaatttgctccccctaaatgtatgcatacggaatgattgtgtgaagcaagagtatgcataaatagagatgaaatattgggatcttatcctataaaaaaatagaaggcgtttatcgaatatagatattagaataaaagcataccttcatcatctccacgtcctcaacgtaaataaactaaacaagcgataaaactcaaacaaaacattagtctcacatgcatatgtcaaccacatgaaaatgttatatatgaatatatcaatatgtgcatggagagaaagagtgatacatatagctcgatctccatgcatttaatccttgtgatttggatccaccatcaatgaacgtttatatctcaactcatatgaagtttgggaatcagctctcacaaatttcactttcatatccacatgagactaagcaaagaaatgcttataaaaacattagtctcatataattggatttgtcattaatcaccaaaaccaaattaatggtacttaagctttctagcaccttcgaaagactgggccaacatatcttgagattgataaagccaccaggacgtcttgttgtcgatgagaatcaatgaaagaataagcatggctctatttacttattctgcattgaaaaaaattgaaagagtcggataagtactcccccgtcccaataacaaagttcttttaatgttctaatataatttaaatattatttgataaaatagtgttattggattgacatttcaaattattttcctgtggttatgattttattgctataaagataataagtatatgagaaatttaaaatcaaatattaattttagaaaccgtaaccccaccttaaagatggaaaggatcctaaaaatcgtaaaataacctctgtttagcgaagagttagatgtctgaaacgacttatatttggtataggatgaaataaagtacgtgtagcgaccacttatcagaaaaatactattaaaaaacctatgggtttgagcccataaaggcaccgaaacttttcatatatgaaagaatgttatataaggaggagaggggcgttcatactgtacatttggtgctacaggaatgaatgagaagagagtctcactccatgtctccacttttataaatattatgcaacccatctgtactacggatgtgctccatccgtttaacaatgtaagactttctagcactgcccacatacatatagatgctaatgaatctaaacacatacatgaagtcttacattgtaaaacagaggaagtaatacaggggttgcgtaataaatacttcgtcaacggtaattttcgtgctagtgacatgctaggtcagcgctagaatatataaatcaattcatcgatgaacaaagcataaaaattagtactctacaaattaacgagagttgtgcatggtgaaaatagcatattccagttgctacgagggaatcaaattaacgttaatccgatataggttttccggattaataatcggtctaaatgcaacacaaaagagagaagaaatcacggagctaagctaagattatccactcgtgcccgtacgcgctcctcgtatacgcatcctactatacccaaattgaaccttcgctaattacgtgcagctaccgaacaaccatgacgattacagcttgtctgcttcaagtaatcaactcgcatttacttctgagatacagattgaatttgaaaaatatgccacatttttagtgacacatcgacgctgttcttccatttgttcgatcgatccatccatactgattaaattagtatcaggaaattgatcactgtagactaggaagcaaaagatgtcagcatcaatccggggtgcttagattcagggctgtaaagttttagcgaatcacatcgcgtactatatagggtgtcgtatgggttgtgcgggcactaataaaaaaaaactaattacagaatataaaccacgagacaaatttattaagtctaattaatctgttattagcaaatatttactgtaacaccacattgtcaaatcatgtagcaattaggcttaaaagattcgtctcgcaaattagtcgcaatttgtataattagttaagtttttagcatatatttattactttatgcatgtgttcaaatgtccgatgtgatagggtgtaaaatttttgtgtgggactaaacagggcctccaattctcgatgacacacatgccatcgatggctcgctaaatttctgattttgattttgatgcccgcagcaagaaccgacataaacgtgttcatcctccgattggccgcgagagacgagcaatgatgatggcagcgggagagcttcatcatcttcttcctcttcctcgtgttcgttaaatccattggaattgatgtttttgcaggtcttaatctctcgctactggctaattaaaagcgtcgtgagctgtctgccggctcctccttctctcatcccctcatctgctcctgcttaattatctcgatttaaggcgccggccgttcctatcgctcttaattttcagatgtttctgtcaatcaggaatagtcttttttttttgttttctgataataggggagatctttggagcacgagttgtttggctatgaaatctgcagcaaaaatgtacatttttcctgtcattttcagtgtttttagaggtgctgtttctgaataacaaaccagaattccatcaaactgcgcagacaaattcatatagcggtgtatgtttctgaaaatgggggcaataatttgtccgggtttatcatttctggcatctgaatgatccaaggttgtatctgaacatgaatttttttcatgaagtgacaggataagataatttagtcacatcaaactctcaagatacacgtgaggtatatccgtatatgtgaagactggttcaattgtctgtgctgctgcaagaagcaaaagaaagtgtacaagataggtcaaggggactccttgtgtaacacttcagattcaactaacatattttttactaaaatacttaagatataatctgcatggcatgtgttcacctttctttggtgcaacaacctctctctgataaacatgattagttgtgctggttgagtcaaaacacaggatgacatatctacaacaatatcagaaattaaacagaaaccaattagttttggtctcatgttgtcgagtcaataaagaaacgaaatgttcagctctgcaagttattagccagggaaaaatatcaagaaattagaggctaaatggttgctggttgaggccttgagggtaacctgttgactagcttaaattgtagcaacaactaaacagctccataaaaggaggagcactttttttcctctgcatatctcctctcttgtcttcttctcttctctcatctgctctcatcatctccattgcaacttctctctccatttgctgctcatatcaacttatcaaagggaggtaggtaagatatgcatatgccccacatgctcacatgcttgtgtttcttgtcttgtttcttttttacttttgtttttgttgtgttaccctgaaagtttagtggaatgaatgagtttttagctgggtcggttgaatgatgagtttgttagggtgttgtttgccatgagttaagggcatatgtgttgttcttggtcacctgattagattagaccatgttttttcttcatttgcaatagtttcggcacatttggttgggattcctccctcaaaatttcagtaactaggaagaaattggcctgagttatgaatcagtagaaaccatgttgcaaaaccatgtgtggtccatttttctctctctctctcttagtccaaacaacacgtgaactagtatgaattgaagaaatttctgggttttgtgtagtttttcagatgaaggagcttggcagtgctgaagttagcatgaactgcattacatggctgttctgaatatgatccaggcagttctaagaaataaagaaattaatcttaggcaataaaattgataactagatttgatagatggtgcgataggtcttggcgattgcaacaacaatatatcaagagtcaatacaaatatacaatcatctctttgattttgtgaatctgattctggtggattgcttacattttctccctttctacatgaactgttgtagtgcaagaggaagaacaaaacaagatgtttttccagagaaagaattcaaagaaagtgaaggactccaatggatcgtcgtcgaagaaggacaaagatagccgcgggaagaacattttcgacagtgccaagggaggacttggtgcccttacaggaactctccagacagcaaagaatggttagccattccattcatttttagcaacaaaaaaactactttacaggaatgctatttatgttgaaacaagcctgttcgtccttttgagttcaagtattagccatgataggaagtatctgacattaatagcatgtaagagttttgacagcaataaggaaatacgaatgatttgggtttgaacttcgaatgcttgaccgtcgaattatgatttgtgcatgttggtgtattaacagatgcctggatagtacgattgcttgattaccaactcaatacgctgatattttgttggcacacgtcctgagacagacatgcaaatgcccttaaaaagtgtcaaacacaggaaaatagaacagctaatattactattttttatagtgggtaatatgctacacacctacacaagaaaaattctgatactcacatgaacatgtaataattaatcaaagtagagagaatgcactacttaatcagagatgaagttttttttctttttctgtttcagaattgaaatgaaaaggagttcgtgccttgcatatttcttcacattagctgttcaaagtcctaatggacagcagatcatatgttgtactttcaatattgtcatgagtccctgacctttgaaatcgatcggtagatgccggagagaaggctgaaaaccttcaagatgatgtgaagacaaccatcggagcaatcttgcgcagaggatctggtgttcttgagaaagccaaagagattggaggccattcagaggccagccagtccaaggaactaggtaaattacagcactacacccaattcagagtgacttcttctcaatgaaattcttcccattatctataataaaaaaattaaagtgacttcagagtcctgcatcttacaaaattgtattcgagaggtgttctagattgatttcttttctttgttttgcatggagaaatagaaaaagaatgagttgttggcgtggttctaactttcaacttccagttggaccctgcacaataattcataaaagttagagtaaatttcacttcgggccaccttttgttacctatgtttcactttggaccaccctttaaacaatattttcactttggactgggtaaacttacctttatttcactttggaccacccaactctcttctcaagcatatgaatgatcttgattacgccgtctcctactcgtcaatgaactgccacagctatatgtaagactatttcttcgacatattacaagttggatgtagatggataaaagagtgagggtggtccaatgtgaaacaaaggtaaaaatacccggtccaaagtgaaaacattggtcctaaggtggtccaaagcgaaacatcggtaataaaaggtggcccaaagtaaaattaactctaaaagttaattacagactgaaaccaatttctaagttcaacaaaaaaataatacattgggtacttgaaagtacttggcactgaaaagattagctcccaaaaaaaaataattctacagtaagatttacactgtaccgtaaaatataaagtggaaaaatgacagattgatgcttttgttctacaaattaggatgtggtagtcccctaaaaaaattgaaacgtgataaataccactagatcatggatggagctacctaatctttgcatcaacatacaacttcccttattaggtgagatatccttttcagatatgtatgcccccttggtaggaaatccgcaaaccatgtaattagccaaaaaaaaagaagaaggagaagacataacagatggttcttttagaaggtagtagttccactgatcatttgattcagatcatgagaatcagtaggtaacacattttcaatagaaaatgactgaaaagttttggttcaaatagataaaccacgggaaacaccaaaggaacacaggctggttgttctccaatgataccatgatgaattttgcagcaaaacccagacgcttaaatctgagaaaatgcagaggttaacatggaaaatgactaacaaccaaaattatgagaaaaattgactaagttctaataatcacatgtaggattactatttggagtgtccagagaccaaattatggtttgcatttgagtattccatagcttgcaagaacttcatttttgcaggattgcagttccctagcttcagaagaataggtcacctagcctataggattacttagctttacttcaaagtaaaagctacttttgtgcacaatgattatctgggatgttgggcatgtgtggttgaggaagtagtacctgataccattttccagctttgcttttgtccataaagagagctgttcatacaaaagaatcacaacaaattcactacacatctcatacccaaaagatcattgctagctaaatacaggaaatatatttttattttaaattcctaagagacaattacagctcaagcaacatgttcttgtgtccttggttggcctccatgtgacagatgattaggttgaccttagtacaaccaaaccctcaactcagctcaactattccaatttccaaccaagaaaccagaaaacaaaatcctaaatagcacaggatccaactattattcctcatgctcttctcttaggttctcttaggatcaagtaaaacaaataaagattcagagaaaataaaataataacaataaaaaaatcatcaccctttatggtatttgattgacccagttggagcaatgagccaatgacactctgtcaaaactacatcgtgcaagccacactgcaaaatcatcctcgaccaaccacaatcaatgcctgcaatttgccggtgtcaatttagctgtcactctccagcaactgccctaccatgtatgatgctcctgtattctgtctgtatatatatatcatacagcaccattagccttttttaatccagatcaaggggctccattagtgcacctatacagagacccgaaaccaacagctcagaatttctcagtcttctcgttcacattgaaagcttgaagctttcagtcttctcttctgcagctctgcttagcttcccctgattatcccaaagcttcagttccatccaatcagcagctttgaactggtaaatgactgtctttctctttgcttcgattgatccaagacgtaagatgagatatttttgttcttgcaagctttgttttcctttttcttttacttcgctttgactgcatgattgtaaggggattggactctcctgcttatatttgggaagcatagagtgctttcctttcaattttatttgtgactgggtggttctcaccctggtttgtgttgattaatgatgattgcttgattggggttcgctgctacagtaaatcgggttttgctagaggatttggaagaacataggacgagtgtgattcttgatcactccactttgttgttgattatagttcttgtctgaatttcttgtcatataagttctgcaggaattttgttctatccagtcacttcttaattcagttcttgtttacctccttactatccatgaattctcatacccagttagaatttatatatgttgtttctgaatttatatatgcaaacattgtgctttgcagtttcttgatagcataacacgaggccaatcgatacgccatgttttctatgctcctgaaaattgcaatcagaaacaagcgtcatttgtatcagtagtaacatgcttattgtcatcttagcagatgcaattgacaaacctgaaggatcttttgtgatgttcctgacattaaaatgctaaggataggcttttctgttactcttctgactacatagcattccctgataagaactcttgttgaattttcacagagcaaggaagtgaagaacaaggaaagaaagatatggaagccttaaccaaagtcatggacaaggtcaaggaagtgaagagtaacccagaagtggtggagaagctggacaaggtcaaggaagacatcagcagccttgctcatgctttacatctgggaaaacatggtaaatctttcttttgagatgtcttatttcctaggataggataatcatatttctgacaactatatggttgcatgataagtaggcatttcattatttacgcgtattcccgaaaaaggaagcacatctcattgtcacaaatagaactatagaagcacttgcattgtgtatagtccgaacatccaaaacctgaatattaacttttcttacatcttttcccataattttacacatgatcaaaagataaggaacatgaatctgaggagaaggcaaaggaaggtgagactgcgaaaagggccgacgagggcgcctctgccagcaagtctgaagattcaggtgtggtagtacaagctgtggaagagattcaggccgttgtcacagctgtgcagcagcagctgcacacagaaggagctgcagctgaaactcccaatgaggctgctgctgctgaaacttcagcagaaggagagaagcctgaagaatcaaagagagatgtagagaaggatgatccgtcgaagcggctcgacttcaagggcttctttgccatgatatttgagaggtgctgcaaccctgggaacaagaagaaagattaagcttggaagaaaatgatgtggattttttttgtttttttgtttttgtgtgtgtgttcttggagactgaagaatgatgtgcatgggattgtgggatggtgtacagtttgcagtttgtgtgttttcttcagagttaattgtctgcttttggtgttttatccttttatgtgttgatggatgtatgtcaaagagtactttgtgaaattcttgttagccttgtgagcttgatcttacttatgtgaatgaaagaatttatttatttattttaaaaaagggcttcctgtgcttagaacaaaaatgcaattcctttggttagaatgatggtctgaattgaagctgtggattaacaaaacactgaaccatttccttatttattactcctctaaatgatgtgtagattgtgtgattgaatttcagtggcaactagtttacgccctgttccttttttacattatcatgggcgcacttcccaggtttcatttgtaacctcaaatattatcacaaaatcagataaatctatcatccattcatctattcagacaagaactggaagtgccaaagagaaaatcaaccaaatgaagctccagaggctgattaaatttaagagccacatggtgtttaccctttcatatttcatgatctctgcttccaaaatattacttacaaatagttgatgtattaagtagaaaatactgaaaagggatctctaattatggttaatactagtatatgtacaacccatgcagggtactctcagttgcaatatttgatcaaattgtataatacaggtagcacattc

SEQ ID NO: 59392 - DNA, 3841 bp, Oryza sativa
agatgagacgcataagggagccgcctatgccgcggtcctgtatgatagccttgatgacgtgcgacctgacgatgtcctcgacgccgctgcatttgttgtcgtagtagcccactttcagctcgccgtcgccggcctccgccgacgacggggcggcggcgagaagcgcggtcgccatggcacagacaattgctaccgtgagcttcatgcttcacaaacctatctaggagaccaaaagcaacacaaagctcagcgaaagctaatttgctttgttagacagctataactgagttagcgatgcttgagcggcgaggctacatgatgcctaagctcaaggcaagggtatatataaatataaaattgccgggttcggccgaaaaatttcagggccatatgctaattaactgtactgagagtaatattacagatatatttacggcgttgacagtcatatgaaagattggattaatggtacacactttccatatacttcttttgtttcaaaatattttgagtattcaaaaatttatgccacaatataagtatttatgggacactcagtccagtgcacaaaaatcgttctgtacattttcatccgatgcttgaaagggatatataaacaatttaaaatttaaccactaaaagatatttttttcactctgccttagttttgttaataatcatataaatacttatattttaaatcatcttacaaaactattttaaattcttttttcaacttagtgtaccctccaatagcgaacacaaaattattcagctagtactcagaaaaaggacactgaaagtaccaaaatagcaaatctaatgtacagacgatatatacatactccctccgttctaaaacgtcaacggtggaaaagaaagaaatagtatacgacaatagtacagtggcacttgatgtaggggctgttccttagagattgtactgtagcgaaagtagtgctttgaacaaaaattgcatgaatactgatattgatttttttttgaaagaaatataccggttgaaatttgtttggaagaaatattccatcggtatcgcggggtaggagtgcaataccggtataccgaggttagcacgcggctacgcgaaactgccacggtatcgcttattgttgacggtcattaagtgtaaactttaccgtcaactcctgtataaagaatataaaatattatatcaaaacttgatggtaggagtttattgctaaccattttcactagttttgataaatatatttatgcaggtcatttatgaataaaaatacatatgtcatgccataaaatgaacctccggtcaatcatacgtgagtaaaaagattggagggctcacatgacagttgaaaccgatctaaagtagggccaaaccaacctcagtcaccatagaggcctacctgtcattcactggatgaagtcgatggctagaggcggtgggagccgaaccagacttaccgtcccccagctttccctttgcacatggcagcgccctattagatggtgatcacggttacagatgaaccgactgaaaaccaccttacaaccatcatatctaaacatttttttaaaaaaattcatactcatttaaattgaatatatgtactcaatttaaatcttggtgcctggacaccatagtgccccagttaattttacaatatatataaaggaatgtgggagtagttgaaataaaaagatgcaacatcatcatcctctaacaatatgctacatcatcattcaataataattattacatttaaacattatgaagcatgctatattatttgtaattttatgatttattgaattttagagtttttaaaatgtaagcatgttaaatcatcatcccacataattcaaatattatttcaatttatctcttcatccttttttataatattctatatatagttcattctcacttagttaatgttatttctctcttctctcattaagccatatcacatcaattatttttagtcttagataatctatggtccaaaatatctctctccttttcttctctcataaagccatatcacctttacttttacatttaaatcatcattctatacactatttaaatttaatttatcatttaaatcatcattctatacactatttaattttaatttatcataaatcacatgcatcaatttatgtaagcttgtattgtctagctagctatcttacacattgttttcacttgttattatgctaactcagtagcaacacgcggagttttacatagtatatataaatgccagccgcccagccggtacactctaggagaaaatgcatgcgtactaacgtcattttcagttcggtgcaaatctacatcatcaaggtacgtatgtacaacacctaaattcttatatatactggttgtggcaaactgcaagctaattaattaactatatggccgtccaaatttgattcttagcgccttcttttttattcgtgggagattcttagagcctttgcttcttataaaatgaaaccttgaatatacaatataggacatgtacttttttaaattaggatgtacgtacatatacaattaattaacatttgatacattttctcttcgagtgaaagtctgaagtactcaaatgctcacgtgtttttccatggcacatatactatttcgtacgaaaaggcataacatgctcgacgaaatattattagatatgtatgtatttgttatttttatacaataatgtattttctacgagacactttcatggtagttttctaaaatgaccataattttaatattttaacatttttcagctcaactactagatagatacaattacagagatgacgttttaaattacctcatgccaagttggatgttcagcctggttttatcttttactaaattgcagaaaatctccaaacattttggaggtgattgatagaatttttctaaaaaatatcgggcaaagaattgaaatttggatagtgttttggtaaacttaaacattttatgaattaaaaacgatccaaattgcaaaaataaagaaaatgtttacggggtccatggaaaactaaaatacttaaatagttaagaatatattttgatttttttcagatttcaatttttttttctaattaaagatgtccttttaggaagtaaggcgctgaaattccaaaattttcaatttgcgaaagggcgtaaaagcacctttttaaattttatctgcccaaatgagtaaaatgttgaaataatgatcatgaaatgttttggcaaattaccaagtaatcgaagtgtcctggcaaagacacgttctatagtgctataccgcaggtatagttaaatatgttacatatatgagacttctactacaaattttggcatgaaacatatttggattagttttctaatatataaaacttgactatcagggttaattttctaatatgtctctaaatcttcttctactaagactcttagaatttttctttatatatctcttgtaaacctcacaagaagtatcgcaccacccaatgtattctatacgtttgtacccaactcctctatattaatcattgccgatctatgcatgtaggcttttctggtaagagtttttcacataaaagtcatatattagtcgtgcatctatttttataataaatggtattagaactttagagatggatatactaagggtctatttggcacaatttcagctccacctctactagagttagagcctaactaaacagtttcatctccacctaaaataaaaacgaaactgagtaaaataatttcacaaaataaactagaaagaaagatagagttggatttaaattgctctacggctttatc

SEQ ID NO: 59393 - DNA, 3886 bp, Oryza sativa
attcatgcacaaacatgtgtacaaataggggtggataaagagactctttttaaggaaataagtcgctcgatcgagcttatcttaacgagctagttagggcacctacaatgattatctataagctctctacaagagatccatgtcagcatattttcctacttggaagagattaaatgaagagagagagcaaagctatctactaacatggagatagtctatagagaaaaacgaggcaatggattagagagctatagatactcatgtagacataccattgaagtggtttactattaatctagtctattgttgaggtatacatgttttatagatagcaccttactttaccattgcgggtgctcttaggttcgactcgttaaaagcctagctctgtttgacttgcgagctggtttgttaaactcgttaggtaatttgttaatgcattgataccacattcaatttttaatttagtattcatatataaacttaataataaacattaactaatggagattcactaaatacaactagtttggatgtaaataaagcactagttatgcatcagccatacttagacgaagaaatgatgatcttttgtattaacgatctaaacgtgaagctcgatcgtgagctagctcgttaagctcacgagcaaaacgtctagcttggcttactacaagttaaaattggtccgaggcgagctcactacaagtcgatccaagtcatgagttttaagttttttaattccctatatagaaattagaacggaactcgtatgtaattatagaaattaaactgataactagcctatttattattcagtattgttgagatcctaatgaacatatgtacggttcagccgtgcttcatgcatatgccatcgtttgatcgactgatatgatcccaaaattcccaattaaggtttattcgatttcaatcaatattagtgtagcttaatactgtgtatttgatttattttcttgaattatagtgagccaataggtacaattgttgtgaactagtgatatgtatttctcgcgacgtgattgactagtaactttatgcttgatatgtgctaccaccttttctctcaggtaatgctaccatagccagcgacctttcctcgcttttattagtacaatgtagttttattgatcactgttgccaatttcatatatttatttcaaaaattgtatttattactagctgattattcttttttggggaaaactctgactgattgtgaatcatatatatcatgcatggcgccatgattcttttagagctaaggaggcttaaaacagttaaccccgacatctagtttttaatagtcttacaaaaaccatttcaattgattttcaacagttttgcaagtcggccgattgatattttggcttgaagacataaaccagtagtgattttctcttatctctaaaaagattcataaccatgaaagtttagaggttattttttttggtaaagtgtactttcattaattgtgtttaaaccgtcattaatgaccttatctaattattgcacgaattgttagagatgactgctacaaattaatcatcagaggttgcctttttttataatattgagtgagacttccggttgagctcttaataaattttcagattcagatcaaaatatttaacaaactcattaaatcccaaaactatgtcacggaaaaaaagatccttcattcaatttcatacaacaacaatacaaactttcatctcatgccttccaaaaataaagaaaaaatgcatatccaaaacgtgggaatgcgaaaagtagcctatgccaaacagcattactactgtcaacctcaaagctagcttgcaaattaaaaggattggccacgttgacactttcaagtcctctccaacagtgaaagcacaacatgggcaaagtaccaataaaaagtgataatgttataatcttgttgctttgctatgcaaccttgcttatttctaattaataacagtgccttttgaattattggagagcaccatcacaccacaccacacatggtagcaagttcattaccatacttcaattgctgaaagtcttccatgtctttgacttaattagacactgttaagtgatagttgtattagtactagttacatccattgttggtgactgagaagccataaaagtaaagtcacattattcccaagagggacttctcatttaggcttccttcttttcagttgaacgaactcagctcattctaatagggtaatgaagataaccattaatgcataattacttaagtggagtacttactattataaagtattttttttaaaaaaatatttaatattaacaaaacttgtaagtagaaactttttatataaaatataaggtttgacaattcagaaaacatgctaacattaaacaaagggagtagtactagcatgtaggactatcactgactggtgcatggaccaagtccatccactgctgaacatggggaacaacactacacagtaagcacagaatcttccaaataatataaacaaaaagatcagaaatttttttaagaaaacaaaaaaaaataaaaaaaatagtgaagaaaaagagctagggagaggagagagaaagagagaaagctgaaagctgtgaaagaaaagcctctgctgctctctgctagcttcttctcctcctcctcctcccccttctccccgtagataaggaggacccggggaaaaaggggaggcaaaaagctgcgattttccgctaattaaccccggggattagctgcccaagaacaggaggaggtacgattcttgcattacttcaccccacgcgattccctccccggtttcccccaatttcctcccgcaatttctacttgttcttggctcctctctgctgttcttagcctcgccgcgatggcgtagtcttggagaagatcagatccatctcgagttcgattggggttttttttttctctcttgaggttgctggtgatgagcttcactttcttggattgattttttttttgttcttgttcgttgagtttttcactttgctctaatccaaatcttttttttctctctctctctctctaatatccataattaatctgcagatttccatgattggtggtggagttcatcggcaaggaattcagcagaagagatcagattctgtacacagttcgtcttcttgctcggtgactaagctgggttaggagaggaggaaaagaaaatctttttttttttttttgcggcgccatggatgggcagcagctacgtagctcggaatctccggcgagcggcggcggcggagtcaccggcggcggcgcgccacatctgttccacgcgctcgggccggcgctgctgatctcgattgggtacattgacctcgggaaatgggtggccgcggtggaggcagggtcacggttcggccttgacctcgtgctgctggccctcctcttcaacttcatggccatcctgtgccagtatctcgcggcttgcattggcacggtcaccgggaggagcctcgccgaggtatttcgagatgcttctcacctgatgtttttgttttgtctgattttgtagtggtgaatgattcatcatcatcctcatcatcgtcagtcaattgatcgacatcggtttgtcgtttcgcaaatggtagaaatgatgatgggtttttgatactgaattgagcctctgagcgaattctgatgagtaggaaaagcatcttcataatgaaggtcctaaatctcgtatgtgaattcctgttgataaagaaaatgatggttcacttggaactatacttgtgcaaaagaatcctattcttttttttttggtgcccttatggtgtatatgttgtgatagtaaacaaagaaaggaggtgttttgttttcggaaat

SEQ ID NO: 59394 - DNA, 8677 bp, Oryza sativa
ccgtgtatttagagcttgtcttaacaaattacaattggagatagacattctcaaccagataatatcatatccctccaggttgctaaataagatttgcaaataggagattagatgacaaccaacaaagctgctgctatagtttcatggttgctgctcagtgctcacacacatgacagctgcattttaatacaaggtagaacttgccactttgcaagtaatcctgaattcctgatgtatgacacctaacagaattaagggtggtaaagggcccaacattttagcctagaaaattgggctgtgaaaggacccatgggccaagcccattaccacccgtaaacataatgctcactctgttccatattattagtcattttgggtttgttctaagtaaaacttcttcaagtttaatcaagcttatagaaaaatgcagcaacattttcagcacaaaacaaatatacttaaaagtatattcgatggtggatttaatgaaactagtttggtgttgtagatgttatgcttttctataaacttggtcaaacttgaagaaattgacttaggacaaactcaaaacgtcttataatatgaaaaggagggaataaaaaactgaaggaactaaaatttaacatgatcatgtttatgtagatgatataacacttcaaaatgaagtggttaatttggttcattgaacaagtgaatgctggcatcaaggcctttaatattattgttaataataataacactcgatccaagtggagagacgttccgaaagcattgctttaaggtcaagaaaaggcccagaaagccagctatcgctttagtgaatagtgacctgccacgaccatggggcatacacagcaaggggcctttctttgcgtgatcccaggtttgagccctggttggcagcctcatacctggaggtcttaccattgtgctatgagcatgttctcctcaaggccttcaataaagctatttatcgttggtcagggctcatgtaaatccttatagcatttattcttttcttgagttgtcccatatcataaaattggataatctcttgtgtgtctgttagaatgaactaatcaatcaattattactaacagaataaccctgctcacaaataaagctcaactcttgctccgcatcatagtactacaatggccttttgattaacaagtgaacaaagcagggaaatagtgggtttgggtgggataagctggtagggtctattcctagttggttagtcctaggatgggcctaggacaagattaagttgacctggactgcacttggttcaacaggtcaagttagttttggcttaggtcattgctcagatggacttgctttggttcctggctgtgtgattaaacatttatctctagatcgttacctagtggtagtaaatacacatttgtaatttaatcctttctagaaagcaattgatcttatacttttgtaatatcatattcttttaagcaaccatgttagatattggtacccattattcttggccttgaagtgttagcaaagttaagtctaatgtttttgtagctttaaaatctgcttcctccttcatatttcatttgaagaaaaaaatcatggcacgttaaccatattttcactatcttaaattcattgcaatgaacatgctaggttctagtaaactattaattagagaatctattcctcttcaagccagggctactccaagtaacactcctgggcaaggcatgttgctatggacttccaaacgcacataaatatattttgccttttctgtaaagttggcaatattatatcactatatgtttcgtggaaggaacagattcctatcattatttccttatttgtgtggattgtaggataacaccgcagttccttgagctgacattttaaattccttacatatcgtgccatacccagacagagagacaaggatggtgatggaaagctaaactttgaagaatattttcatgggctacatgaccatatacatggttatgattacgagaacgcagatatttcccatattgggaacaatacagtagctaaggagcggttttccaaacttgacaaagacagtgatgggtatggaagtggagctttaattaatgacttcctctgatataattatttactgaagtattttcattttatatttttaagataaactctttgcctatgtaggtttatttcagagcacgaactagaacctgttcttgataagctccatctttcagaacgttattatgctagacaacaagctgcccatgctatttcagaggtttgattctcattgttttcctggaatttctacattttttctattgttctttgatatcttgaaatctattttccctttgtcatgcatgtctacagctttctatagttttcctgaacatagcagtagatgaacttttagtctttaataggtttgacatgtcctgatttgatattgtcaaaacctaatacaggctgtaactatctaatctcagtatagtgggacataagaataccctattaaataggtgtataagttgcccgtccaccgcaaatcatttgcttttcattttatagtatcatccagaattcaataaatctagttttttatgcatagaaaaaatcacagataatctgagatttttttttattttgagccttcttatttaaaatttcaaaaacaacctattttgaaaaatacaccttttgtcacacgtggagggcaaatgttgctactccatgaatagtggagatatataaggtactgtaccgactcttttcatgccatatcaaccctgatttaccacatcagtatgactctatgagcggcatgaccaaatctttgccacaccaaggtttttaacccatgcttcagcattgtgctgccacactaatgagaatgaagaagctaaaggtttagatatgtaaataatgtttcggtagagttcaattgtcaaatatattaaaaagttaaaaaaaaactcgataatctgtcgtggttcctgtttgcacaaggttgtccaaaagtttgcctgtgaaaaatctcaatgtattatgtgctttcctctgatgcatgatgtgtctcttgttccccgaggatgacatgttcaattggctaatccaaaaattgcaggctgacaaagatcatgatggaagactaactttggatgagatgattgagaacccgtatgcattttatggcagcgtcttccttagcgacgacgaagactattttcatgatgaattccgctgaggtgtctgcaggtgacttgcatgcatctgatgcacaccataccgaaaattgttttgcagctagtattcattcaaatattctgtccacagattgttggtgttgcaagtatggtttgcggatcgatccaagatgctttcaccatcagactgaatgatctaggagctgctaaccacacaaaaagagaacttcagctgtttggtaccctagagttctttctatcaggtactcaggtggagcaccaagctggctaatgccagcgatattaggttacatacatgccaacttgcctgcctttatttagggtgagccgctaacctgacctgacatatgttgtgtattatctcatcagttttgtaaaatgcaatggatggagtctaggagagcaatcatagtagaatggacatgaccagaccagtgagctaattgtgcctttcttctttctttttttctgaagtgtgagctaaattatgccttccttgttgaaacataatgactggattgctgatggcgctccgaccgacagttttcctcggcgcatgagtgcgtcgtggacgtggaatgatggaattattgtagttgcgtcgatcacatggaaatgcattattcgggacagtctacccaacgtgtcgtgtcatgtcatgtccatcgtgtcgtgccatgtagtactaaggtcctgatcgatggcatatatgacatgctccgattccaggtgttcttgctcgaagtgttgggttcttttttgcataaatcgaattagagcattcctctggagacaccaaactaacacaagggattaagttaaagcaacctttgtattattaccattattgggttgcttgtgaaagctttaaactcagttgaaaggcacgtactcgtgcgtgtttgtgttggtcagtaggtgtggtgtgtgtagatgcgttttctatgtagcttgtagctgtgaattcttttggagtacttatatgacatccgacatttttttgtcgaaaaactttaaatgcatagttagaatgtaattgcatacttataatttgtatgtaactactataagatcaacaaaaacctggttgctggctaacgcaattttcgttcacccaagaggttgcgggctctcactctccagccggcatagcgatgtatagtggcggacccaggataaaaatatagctatggcgaagacaaacgagttgattcaaagcattttggccctatttagatcccacaccaaaatttttcaccctgtcacatcgaacgtttgaacacctgcacgatgtattaaatatagactaaaaaaataactaattgcacagattgcgtctaatttgcgagatgaatcttttaagcctaattgctccatgatttaacaatgtggtgctacggtaaatatttgctaatgacggattaattaggcttaataaattcgtctcgtggtttactgatggattctgtaattagtttttttattaatacctgagcatcccatgcgacaccctatataacacctgatatgacacgccaaaagtttacaccccggaatctgaacacccccttcattccaatcaaagaaaaaacgtaaaaatgcccacattgcagtcacgaaatacctcattgaagcgatggttcatctgggaagctgggggtgggggtattcgcgaagaaggttagctatcgcatgcgccacagcatgccaaagtggtaggtccgctcctggcgatgataaaaaaacacctctgggaagttgggggtgggggtattcgcgaagaaggttagctatggcatgcgccacagcatgtcatagtggtagttccacccatggcgatgtaaaaagaattgttcattcccttgcatgaatctccacgcgatctaacagtccacaaactgaatgttttgggaaaaaaatgtcaacagttttttagcacatcttctttaaaattaaattacactttgccatattaaagtttcacttcaaaccaccttaaaagtatctattttactttggactaggtattttcaacaaaaagttaaactttaaaccgatgaccaatatatcaatgagactaaccatctctggtgtccgtgtctcacttatatatgggccacttggacataaggtacaaagtgcaacactggcaacaatacgtagctactagtcccaagtgaaaaaatatttatgtagctagtccaaagtgaaagaaaaaacatttcaagagtggtacttcctccgtttcacaatgtaagtcattctagcattttccacattcatattaatgttaatgaatctagacatatacgtttcacaatgtaagtcattctatcattatccacattcatattgatgtaaatatgtctagattcattaacatcaatatgaatgtggaaaatgctagaatgacttacattgtaaaatggagggaggaaaaagtaaaactttagcaagaatatatatcccctaaatcataatttactctcttttcttacatcattgtgcactatttcttatgtattttggtatcagttttatgttttggaactaattactacccccgtttcaggttataagactttctagcactgtccatattcatatagatgttaatgaatctaggcacacatacatatatgtctagattcattaacatatatatgaatgtggataatgttagaaggtcttataatataaaacggaggaagtagttattaagtatatacattaaaggtttgttgtttgacaatgaaagtttcatcggatcttatctaaagtgtcaaatatttacgacctgagggaaaagagagagtaaggatctactctctccatttcacaatgtaagactttctagcattgcccacgttaataaagatatgaatgaatctaaatatttatatgaatatgggtaatgctagaaagtcttacattttgaaacggaggaagtagctagtttaattcgtttcgatcgagcttcaacattcgtaggggagagacgtacacacgaccggttccggcgatgacgacgctggcgtgcacatggagcgaagggcaaggcgtacgtacgtacgtgcgagaccggaccatacatatgcccacatgtgatgctagtcttaccccagctggctctcaccatgcagagctgctgccctgcagcttgcttgcttgctcttctctatcatcaaacagacacttggccaagtgtgaggtcaagtgtgtgtgcatgcagcactgtcaatgctgacacatagccgtacgtattttagtggctttctgaaggcattttactagtatatccgacttttagggtcagctgatactattgttcatgtatagtgtcttcaacaggactcaaccaattaatatcccttctcttcttttcgagagaattaatatgcccccctcccaacatacttcctccgtttcacaatgtaattcattttagtatttctcacatttatattgatgttaatgaatctataccacatttatattatgtctatatgtctaaatgcacggtgtaattttggctcagctttgtggcccagctgttgatgcacggggtaatcaatataaatgtggtatagattcattaacatcaatataaatgtgggaaatgctaaaatgaactacatcgtgaaacggagggagtacctctctttctctctcgctctattcacaagtgtattataaaataaagtgtaaacctagagtagctagtactcttttaattgtgtcgtgtaccacttagatccataatcttgtgaatcatatatttggagccgtaatcttgacttaatatatcatggtacatagggctaaaaactaaagcacgactgactggctacgacccctgacatggcaatccaccgtggcttcacatttgcaataagtcacctccatgctccctcgtgtggctatcaaactgaagaaaaggaaatgatcctatatttataatatctgctaacctaatgttttgatcgtatacatgagaatacaatatacaacatacttttcataatctagtcacggtggacgaatttattcatcatctgcctcgcataacatattacagcaggtgttcatttagcctaaaggtccctctgcgttagcaacatacgggtgcatcttaggatatgcttgtagacaaatatgtaagacacctccacaaataattttctgtagcgtgcactccaaatttaagaaataaaaaagttgtaataaagaaaacgatcgacattaattcatctttcaatgatatgtgtaactacatacgttaggattgagatcaaatacagttccactagggaccgcaagataacgattgcacaagatctaatcttggctatctatcttttctatggagggtttagatttaaagctacagtaaaaaccttttttttttcaacgatatctcgaatgatttaatcattggatttaaactggacatcctagtgtgattgcttaacttgcagtcgcactggctagagctgggactgcaggtgaaccggccggatcccatgcattgggttggggttggtcccaaagtcccaagtcccaaccgtccggcaaatgcatgcatgtacaacagtgcaactagccaagcacagtacgtcccacgtgtgcggcagcatgcatgcatatgcttatgcatgtgtgatcaataatgttttccattggccctggagctcagtacgatgtatacacgcgtatttatctcatgtcacagctgaagaatgcatctatactctccggttcgtaacttctttaattaatcttggatatgtaaccgaaatccgaatcaagaaataaagatgcatatctttactcccggttatctctaaagatgatagcgccacgtggctgacgatgtcatctttagtctttttttattgttttttatatattgatttctaaccaaactcaacaataaaatcatcaacattcacataaacatcacaaaattgtccacatccacattcataattcatatcacaaatttacatattaaaagacatcataaatcaacaaattcatagataaatcaacaaaatctaacaactaaatcaaccggggctggctcctgcacaggccgccgcccgctgcacgtaggcctgagcaggctgccccctcctccaggctgctgctgctgcaagaaaaagaaaaggagaggataagagagaggaaagagagagtcgagagaggagaaaagagaggaggaagttaaaaaatgaggatgaaatgtttgtgatccagaaggagaggataaatgcgagggattatatatgaagcattgaattttaatcctggttgataataccaatactaaccagggctaaagataataaggggctggacgttttttgaacctgtaggactaaaaatgatctttagtcctgattgataacactaaccgggactaaagattataaaagtgacgttgg

SEQ ID NO: 59395 - DNA, 2646 bp, Oryza sativa
gctccaaccttgggaattcagcttctattacagatgatcgattgacaactttcatgactaccaggtttagccaggtctgcaatagccaccatggtccacctgctccaactattgagccgacggctatcttagccgatgcattgttcaacatttggtatagatagccgagaaggattttgcccaaagggaattgtttctatgatcctaaagcttcgactacaaattgccaattggtttgtgggaccacagctggatccacagaagagaaacttttctagccacattagcaagaaagctacgtgctcccgaggagtgacaggccatttgcccatgtatgccgctacataaccagaccaccctcctatgcttttggtcttgaagtggttcttggtgttcatactcatacggttacccgataaagttacatctaatctagtaatcatgatgatgtcgatcaaagttggagtcatcggcccttcgttaaataagaaggcattgatggtgttggaccagaaataggtggcggcagccatcagaggttcattcttagcagaattggctatggtgagagcaagcgcttggccgatcccaatctcattctagtggactttcttactagccgatatgtgttggtaccagatggtccagctcttatcaggggtaggcttttcaagagatggccaagacttgaaggtattcttccagtgacccaggttagggttggctagtctaaaggggattctgttggtttcaccaataatgaaatcagtggggtcaagattgccgattgggccaagaaaatagtggtttttgtgcgataggctgggaatcgcaactaggttggaaaggtgctgcaaatccaaaggaatcgggaagcagaaaacataatgagaaaaggagaaatcgatttcatgcgaggaaaagggatctagccggtgagaacttacctcagcgtactcggccgatggcgcagtagacgggctagtggaagacgacatcgccgcacgcggagatctgatcaaaagcgaaatcgcctggggatcgcttttgcgtcggaggaatcgccggagagagaaaggacaaagtttcgcttgagcggtgaaaatagaagtcacggtgtgaggtttctcgagggcaacggttggtatttaaagcgatagaacgtcacgactggcaataacccaacgggcgttccttacgtgcgtgtattactccttgtcccaggaggcaaggtacaccaaaagttgatacaattcagagtttaacaagcggaagcgtaattaattaatttattacatgggcggcgaaggcccagtacacaagaagacaaacgaaaaacagcggaagactagggcgacgaccacaggcgcttgacggtaggcacgagctagacaccaaagccttcatcttccaggaactcctcttatgggtttgggaaaaattgagcaagactgagtacaaccaccgtactcaataagacacacccacaagtgcagaataaatgcaagggagtacaagggagccataatatagggtgttagggtttgcagtaaacagcattaaaagacacttagttgctcaaagctattttgtaaatacgatcctagagctatacaagattattaatcaaggccgtgaacccacacgaacctgccttaacccaaggcctactatgattcagaccgaactggcaacccaaccctgggtcccagctcatcccaagccaacccaggccaaccattccacattttagttgttaggcaggttttaagaattaaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaactccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacgatagtgctttgcaacagaggcctgaagaccggtccttatatggccgaggtgctactatcaaaaccatgcaccccgagcccagcctaaaaccattttgaggattttgaatagagagggaggtgtgaatccaattccacaataatccaaccattccatagtgtccaggtgatgagaatattcccaaagtctagagttgtaaaaccacctaatgttgcctaattaaccagcgaagcatctacctaaaatcatactagtggtaccatgagtagagtgtccactagttggggttttgtttaatctagggtgaacaaggtaataatatcaataacaataataataataataaggtcataacaaaggtaaataggcatggctaaataaaacagtgataacgtgggcatttaagtaaagcgataagcaatatt

SEQ ID NO: 59396 - DNA, 7769 bp, Oryza sativa
  unsure (1)..(7769): unsure at all n locations
actccatctgtgtgaagcatgcagcgctgtcagctatagctagtagtagtaccatactaccattatgttttacgttcgtttgcttgctcgtgcatgcgacttgtgcacaacgtacgtactccactgaactgatcaacacacacctcagccgttctgcgcgcaggactactatatactgcgtgcatgtcagaggagcgcgttgtccagatcacatgcaagcgaaagtcgtcctccttctgcccccctcctcccggatcaggctcctttaccttcaaatacatttaactttatcacttatatatggacccgatgaaccctgaacctatctgtcagtaacaaaggtatggtgtctgtgaaggaagaggatctcaatcccctcctcccaccacgcatttacctgggtaacatatacgtaatcattatccaacaatctaatatgttatcctcgatcacacttataggctagatatctttatttatatatatgggtttgatcagtggtatatatgttactagctactccctccgtcccaaaatataagcaattttggactctgacatggtctccgaaatgttactttgactaataatatatataaaagtaagatgttttaaataaaaagagttacatattatgatagtttgtttaataataaatctagtaacatgaattttacatgattgattttttttctattaatagtcaaaattaaaaatgttttgactttactatgctaaaaatatttatattttgggatgaaggaaatagttattagtagaataggtgggggtcttttttttttcttgaatcgttaatttgggcatttcatactataattaatagaaaaaaaattatagttttgctacattattcttgctcggacatatagtctttgaaaatgcacagtgaaaaacattcacttccagcaaaatatgtgcgaagtcacctatatatgaatatattacgtatatatatgcaatatgccagtacatttacagcaggaatttggcgggacgaaggatttaccaccagtccggtagtaactgcacaagcatgcgtgcagtacatactgtacatggtctgttgccgacacgcccgggaatatcctggacatgttcctgcagtcaccgcgtgcacgtacgcttgcgtgtgtgtaccatatccccgctgggcggctggctagctctcctcccttcccctccccattccatcccacccccactactgtccctaggccggcgctcctcaccacgtttcttagaaagctaccgtgatatccacggtcactctatcggtatcctctactgtaacaattgtattatatcgggagacagtctgcatcactatgggtagcgcgggtggcggagtggccgactaggtttgtcctcattggtcatcgccatgaaaaatgaggagtcgaggttacacgggatagtgttgacggcagtggatgagtccattgattcggatgggggcggaagtttgatctgtttttaggcggttacaagatggtgtggagagagaaacgtcaaatttggaagtagcgatgacgtatctactagagcccatttttctccttcggtatgctattttcaagattgcgtgtgtgacagatgagctattgggaatgctcttatgtaaacgtagatgcaagccatgctttaagtgcgcatacatgtgtacctcttctatatacactaaagggaattagcattcatgataacgagtcataacccacatttatgatggctattggttactccctccgtctcaaaaaaaaaagcaaaccctgggtttccgtgtccaattttgactgtccgtcttatatgatttttttataattcatatttttattattgttagatgataaaatatgattaatattttatgcgtgacttgtctttttaatttttttcataaatttttcaaataagacggattgtcaaatgttggacacggaaaccagggtttgtctttttttagactgagggagtacataacagatcaatggtcaccgatgagaatacctcattcctatgacaagtcaacacccattaatgatgatagacaattgtgacgagtagtaattagcacacttcacatatgagtgcaccaccctgtcagatattagactgacctcaaacaagttgaagtagtgaatcatcatacatgtagaaaatcaacccaaaacatcttcattatcagcatcaagatgaccaattctatagtagtgatactactacctcagttttcaaatacatataagcttgtttaactttcaaacatactgtttgaccatttatttttattgaaaacactatgtaaatgttatttattttactatgacattattattattaaaggtattttatatacgatatatgttttacatttgtattttttcaataataggaatagtcaaatatatatatatttggaaacagataagggagtagtaattgtccaatttgcagctaattggcacgtgtgcatatatacgcatgatattggtaggatcgctaaatcacatcgctacaaatggggcctctatgcttaattatgggagtagatatagtactggctagctatagtaacagtggttggtaggtagctttgatatgtacgtataggacacacgacagacatttctcatcagtggaaaacagattatagtggggatgttggagaaccttctgcttaattattatgtacccattatgtcccttttcttttgtttaattctggatattttctgtggatatatccttatgttttttttttgttttcttgtgcagatctatatataatgccaaacaaataacaaagggttatatatatcaaacaattaatatatatgagttgagacgagattatggttccaaatggcaaataacatttcaggcttattcgctttgttcccaaattaaccttaccaaattttaacaatgttaatttttggtgttgccaaattttggtaaagttagatatatttagtttgatgcatcctaaaatttaatagcgtttttattagaggaaagttctgcaattgggtaagatcatgtttaggttgtcaccgtactgaaatttgataacaccaaatttttggtatgataggaagtgacaatggtgaatatgctcttcttttttccaaataatatttctcttaacaaccatatcatatatgcttggatatggttgtgacatcctggcccaattaggatgagacatgtgtggcccgtgagagttgtatgtgcatatttagtaccaccttgctactttagaaagggtgaaaccaatttataaggtattttccttccaaccgtatcactcccgggttaaccgttttatatgaaacgaggataaaaatgtaagtggggtggtatgcgtaagtgagccagccctgggctggctacgcggttctggagggagggctgttatgcagttgcacgtatggatatagtgccgggttctggagggagggctgttatgcagttgcacgtatggatatagtgtcggcactgtgtgtacagatgtgcactaagagggggcttgttcctgtaataccccgagttttgaatttctagagggagggctgttacaaacgctattatagccgagttttttatttccctcgcagttgcgtatggatatagtgccgactggagggagggctgttacaaacgctattatagcccgagttttgaatttctagagggagggctgttacaaacgctattatagccgagttttttatttccctcgcagttgcgtatggatatagtgccgactggagggagggctgttacaaacgctattatagccgaccctcgcagttgcgtatggatatagtgccggcactgtatgtacatacgtgcgctaagagggggcttgttcctgtaataccccgagttttgaattagtgtatttcaggaaatattaaaacaaatgcgcaaaagttcaacttttaaaccattgttggaataggcaatgaggaaatgtggatgcgtatagctcgtcgagtagtgcgaagtacactataagtttgcagtaatcagagtccaaacaaagttccgttgattgaatcgtaataccccgagttttgaattagtgtatttcaggaaatattaaaacaaatgcgcaaaagagttttgaattattgtatttcaggaaatattaaaacnagtgtgcaaaagttcaacctttaaaccattgttggaataggcaataaggaaacgtggatgcgtatagctcgttgagtagtacgaagtagactataagtttgcagtaatcagagtccaaacgaagtttcgtcgattgaatcgacgtggaccgtttgatctcctttctagtctctttatatacctacagataaaaaaaagaaaagaaaagttctagtctctttatatacctacatataaaaaaaagaaaataaaatggaaaaaaaaaggagagatcgagagcctctacaaccctagccgccaccgctactgcgcccttgtcgccgctgctattatccctgtcgccgccaccacagccgtggccggccatcgtcatccgtcgccaccggtgatccctttctgtttttttccttcccggtgagctcttgctgctgtcgacctgatctgttcctgctgtgtgctttggtccctgctgctactactaacgttcattgctactgctgctgctactgggtggtatgccactgttgcttctacaacgatcagaggggagaaggttcagagggcagaggaagaaggaggattaaagaagaaaaagagaaagagaagcaaagttggggattttctgggattccacaaattcacctcaaatttgattttctcctctataagggtaactcctcttaatccatggaagttcaattttcacgtgggaatcgattcgattgccggttgggtgtatttagttgttgtttatgggctaaaaatagtattttccaatctggtattaaaccattgtgattcaggttagttgtcctaaataaagtttgtagtcatcgtcgatatctttctaacggtgctggtttcactcgattctgataagaaacaaccaaaaaagtactgctgaccaggtccggaaaccaggacaacaattcattttcctttatatgggacttacataggcttaatctgatttttcacccacatgaaagttgtagagaattttgtttagatgtctaaagtgatatcggttgctactttttgttaggcgctttgtgaaatatgtatataacattgtataggtagtataggtagttttatgtaggtaccgtcccggttgacagataaattttggttttgatctttcatgatgttttgtacatgtatagatagtctcaaggattcctcaatagaggttttacttgtagctttactccacaggtgtggagagatctggtgtggagggggtttcgtcgggttgccgtcgaggttaaaggcaagtgtatgacgaacaaattatgtgtttcttggattgtttgctccacctatttattttcaatatatttctatgttatatgtgattgcatatgttcagattattgttcatgatatttatatttcaggtttatcttatgttcacaatgacgttattcttgtttcaatattctggattctggttctggttaaataactcaatttccatgcttgccatggatgtgcaatttagtttcaatttgcttttttgtttctagtttcaattattcatgttccatgtgagtcatggatatgctatctggttttatattcatgttcctataggtaattgttgatcaagcttactcggctttgccggcaaatgctaggatgtattcacagttgtccaggatgggaactactatttcaattcatgtctgttcgggatgggaactattaattttctttaacatggtgtttgaaaccgtgtttcttttcaaagaaagaaagttttatgttcaggctttattgccaatgatgtgtatatgtgttttctagttccatattgtacttgctaagtatttatgtactcactcttgtgtttatttggttttaagtacacattgagatcagtatgtatgggcggaaagtagcacccttatatacacatctatctacacactatcaaattatattgcttaggtccataatgacacttaaactatatcctggttttgtcttgtaatattcatttggatatctattagtttctttctatggattatatgaatagatagcactgtgggaataatattattattagtttatcttataactgcctatcatggatgtccgtatctataggagagactctgccgaaatttctaataattttaggagttagtagttttgagtgtattttggtgtggcactctgggtacgtggttacctagggtgttacaatggttgccattcttattcccataatcccgtctccattttggtaccctctaaaaacagttcagaataagagtattgttagataaaaaaaagtgaatattagggaagaaattaatatcaaataaatagaagaggtgtggctttgaacccagaccaattagcccatcaccttgtggagctagccggaaaacccctgggtgtttcttgagagtattgttagggatgagttgttaaaagattaattagtataagaaattagtacgtgtagaaacttttccttcttttaaatgggtaccgctagtagctatagcttccatttgatgtacgtagctattttttttttagaaaaaggcaaagcccatctttcattcaaagctataagagttcagaatacaaaagtaacataagataatcggctgggaaacaaccagctaggcgaacataagcatcatggctgctggctcagcccaaaaacaagccagggaaaattaccaaacatctggaaagctccctaccaagactaccaaacccagcaaagcaaatcacgaagtcacggcgctactacacttttcaggcatttgagcttgctatccttctgatgctggcaagtagtaagtcccgcgaggtatccaaagagcttcgagtcttcactagtgctagttttctccgctggagatgaaaagagacagctttgtaaggcaaatgggttgcattagagatcagtttattattaaacacccaatcatttctaatgagccaaatggcccaggcccctgctgcaaaaagagaaagtagaatcctattttcatcgcaactttgcatcttaagcttatcaaggagctcccctcttgttctgggtataccagcccacccaaacgcatctctaaagcaacaccacatgaacttcgaaattgggcaattaaacataaagtgattgacatcctccaactctccacatagtttacaataaggactgcccttccatttcatcttttttagttgggaagccgcttgaattctccctctcaacatgagccaaaagaagatttttattttcaagggtatgggagttctccacaaatcttgcataatgacatctctaacacccccaaaggctagctctctgtatagagattttgttttatagataccatatttggtcaacttccaacacatagtatcattatctgagttcagctgaatctcatccaataaagtatgtaaatcattccattctgtcatctctcttccccctaaattcctccttatgttaattgtccactctcaattaggacacatctggtaaacagtctttttcgtatcggcacaaatgctatagatgatagggaattgagtttttaaaggcacatctccca

SEQ ID NO: 59397 - DNA, 2494 bp, Oryza sativa
cttgtatggtgcgggccttatgggctattgggaatctgaattaggccggcctagtacacatttcggccttgttcgtttaatttcacaccataataggtgtgagattaatctctttcaaatcctccttaatctcattagacttctggagcctcgttcattagacttctggaaatatgtggtgtgattgctttttctttcgataatccactctataatctagtaatccactttaaagatgcttattttagattattgggtggctaccagctaacaaatagcttataatccagagaaacaaacaactcaaagcttattctatgtcggcttattataattcagcttacagtaatctggcttaataatatatattacaataattttaagctgaaacaaacagaggcttagtttatttattgagagaatacggtagtgcagaaggtggagaacggctccgcttttacactagtagacacaaggaagacatacgtgttaccgtttgcgcataataccatatatttcaacagctgaaacacacttgtgtttacgtaaatgcagtggcggagctagaaacaataaattttatctgccatgaaggtgactatcagtaaattatttgaattttgcttaaattcaaattaatctaatttttttttgtcaaatggagggaggttatggtggttattcttctttatgtactccagtaggaaataaaacaataaatgcatgactaagattgaacaataatgaatctgttggatcagttggcaagtgtaaatgattgtactaaccgggaaattggtattagctattaatttatgaagttatgtatttatttttcttcatgcagacatgtgctcctacgtatcaaaaccatgtttcattttttacttcccccagccacagatccttgttggtatcctttccaaaacagttaaaaccagcttatcatactagtaaaaatattattattgtcacaaccatctatcaacttcctaattaatggctacctgtagtaaacaaatcaaaatgggtaaaccaaaccataactaattaaaaaacaatttacacttgtctgcatatttttttaaaaaatattcgataatattgagtttgttatagtttatcactatacttttatatactccatccatcccataaagatttcattttttttctttttccaacacttgactacccatcttacttaaattttttatggattttttatatagtcgcatataaagtgctatttatattttatcatctaataaaaatagaaatactgatgatagaaaaattttaaataagatgaaaagttaaatgttatataaagactgaaaaatagagtttttatgggagagagggagtaatacggagtaataatacacaagtttatcaattcttttacgacgtgctattgggatggtatagaatggacttccttttcttttcctacctcacctaacatttgatgaagagaacggtgaaccgggaaaagccctgtgaattttcaaacttacccagtcagtggatgggatgctatgcgatcatgtgagcgacaagttacaagatccaaaccagtcgtggagcagtcaagccgcgcacgcagagagaggcaggcaaggcaacgcaacgaaggcgaagctgcctgcctctgccgcgccgcgccgcgcgagatctgggcggaagggaaggcgcggcgcgacgcgacgcacgagagaaacaaaaggaaaagggaggggcgggggggacaaaaaccttcgccgcacaaagcggttaccgcgtccccccagatctcgtcgccgtgccgtgccgtgccctgcccttgccccgctggataccggcggcgcaccggcgcggccgcgcgatccgatgaggcggcggccgttcctcgaccagcggcggccgtcgtcgttcaagcgccggtggcagcagcgcccgtggtggttccgcctcgcggtcaccctcctcctcgccctcgcctgcctcttcctcctgctcgcgctccggggctcgcccgaccccgacccggtggtgctcccctccaccgactcgtccagatccgcggccaccacctcccctctcctccatcaggtgagcgaatcgcgtctcatatctactttgcttcacatttcgttagctcatttgcatttggcttttgagttgatccggttttaattagttcatgatcatgagtagcgtttgaaattcgtggctcctgtaatgtgcagagatcttacctcgatggcgttacggatgcgttcaacatgaccgacgaaatgctgagtgctcactcgttttcaaggcagcttatggaccagatttcccttgcaaaaacctacctcgtcgttgcgaaggaagccaataacctgcagtttgcagcagagcttagctcgcagatacggcgggcgcagagcatccttgcgcatgctgcagcccatggtggcacggtgacggagcaggatgcggagaaggcaattagggacatgtcggt

SEQ ID NO: 59398 - DNA, 1484 bp, Oryza sativa
gactcgttgtactgtagtgggttgatgctgtgttggttaagttgaggagagcgggtggggggtggtgcggtcttttatactggagtggcctggcgaaacaggcggcgggcgcgcgttggtttttccgggataccggtggttccactgcttagctgtggcgctgcacgcactcgtcgctttccgcgcgggttggtggctggctgtggctcatcacacgcccggcgcccacctcgtctcgtcctggttggttgtttgcggcatggtggaggctggggatgagttggagttggcccgctgcgtgcggctggcccacgcgtgcagtgataggataggagtagcggagtagtggatcccacgatggtacgtgccacttccatgtgggtcccacgaagcagtggaaaaatcgcggatctacggggagtccatgagcttgtcaatttagcagcacatttcttttttttttccttttttttttcataagtaaagtccttaatttctcgtttgagtaagtgtttgtttgacacgactccactctagctatatctttcctgaggttagaactcaaccaaacgatttcagcttaaaaaaaattggagtggatctattagagggctatcataaaatgaattacgcatattattgtaagttcgtagggactaaccaagttattataccgaaataataaatttacaatttagtatatctatttacactcaccacgtaaattcatgtacagtaagcataatttacttgtcgtagcacacaggttttcgcaagtacttgctactagagtactggggcttctaatgtaggctggctcgtcctagaagactggagttttagcgagcgtccgagcgattgcttctttttcctgcactagactcacatcagtgttgcacgcgttcaacagactgcatgtcgtcgaattgggaagcgtattatgatctgctgcctgctggtgactctgagagcggagttatgggaggtggcatggaaaaccaggggctggaggacatggtttcccatataccgggtgcgagtacgccaacagaaatgtttaggggccgttttgttcaatacttcaacttaccacaccatactttaggctgccacatctccttagccttgtgtttggttcattgccatagttatggcaagtcatactttcttaccatcttaccccacatgttatagactgaattctttgtctaactttgccataagtgtggctcataatttattagccacaaaaagtgtggcaagccacacttgcctaaagtgaggtataaatgttagttaataaccaaacagcccaacttcactcagtgtcatggtccgggactctcctgtctcctccaaggctccaggccccacgcttaattagtagcttcatttatactagtacttcattagtgccgttgttaccagattatactactttgaagaacttgtggttgttcttagcaattttatttgccttccat

SEQ ID NO: 59399 - DNA, 1074 bp, Oryza sativa
aggaatattagaagaggagactagagttcatatagaaatacaatttagaaatagttgaaatttggaattaaaaaaaaggaatattagaagaggagactagagtccatatataaatacaattaggaaataactgaaattcgaaattaaaaataaggaatattagaagtagagtatagagtccatatagtaatacaattaggaaataatagaaatttggtattaaaaataaggaatattagaagtagagtatagagttcatatagaaatacaattgagaaaaaaaaatagaaattcggaataaaaaataaggaatattagaagtagagtatagagtccatataggaatttaaaactaactaaaattcagaataaacataataaaattaaaagtagagttttgagtccgcataaaaatacaatttacaaataactaaaattcgaaattaagaaaaatatgggaagaagagtttaaagtcaatataggaatacaatttagaagtaactaaatttcgaaattaaaattaaagaatattgaaagatgagtttagagtccacatagaaatacaattagaaataataaaaatttagaaataaaaataaataatattggaagaagagcctagagtatatagaaatacaatttacagaaaattcggaattaaaaaaatatattaaaagacgagtctagagtccatataggaatatatataatttacataactaaaatttgatattaaaaataattaatagctaacacgtatataaaatacaatatgaatattttagttttgtaaagttattgcaaaatttaaaattatgatgtcattttaatatattcgaataatataatgagaaaaacatatatgctattatatgagagaaaatataatgatgctagccgcacaatctgcgcgggccaccaatgctagtttaccagtattttgtgtcaaaagctgatccatgcagcacaacttttcacaagaaataattaaaattcagaaaaaatcaaacaacttaatgcgttagagtgcaatttataaagaattttcgttgttccattgcataggttattga

SEQ ID NO: 59400 - DNA, 5009 bp, Oryza sativa
tggagacatgatccaaaatctgccttgtaatcttaactacatcaaatttatcagatacatacacccatatcttaacattaaactgacttttaattaccagatctttgcagaccagttgcgccaaagtggtttttcctatccctccattgcctacaattggcaggacggttatgccattagatctattgctcatgatcagctgtttgatggtttccatctctgcagccctcccatacactatgggctccggaagataagacgatgttgttgcatttgtggccggtggtgtaccctgtcgactctggtttgaacttgaggatcgacatagcctcataacctcatttacagcctcttctaactgatgagtcatgcattggatcctgttggaaagttcagccttgttccaagggtgcgtgctaactgcctcgtggtgtgttgaagtcccatccattctcatcctttttctgccaactgaattaccagttgcatttgatgcaccctcaccggcactggaagagcatgtgatcgtggttaggcgattagaaaggtcagcaatataacgcaatcttaagtagatgaagagcgaatcatttcacttatacttatgattatccttacgatttattaacaatttaaaaaataacttatgggtaaaatttttatatacgcattcttaactattcaaaatcaaatgttgtaaaataaaataggatgaaaagaaaaccacaaaatcaactccaaaattaagttttaaatttaaatttataaacataagtataaacgaaacaatgagctattttattggagactacaaagcgtttttatatttgacttatattaattggttgctttctgtaaaaaaaaaaaggcagcagattttgtcactcaattttgcatagtagatttttgaaagaattggatttgatacactactcatgttttagatataattatatttgatatatacaattgttcacttttgtttccttgcatctaattacatttggtgcaccatcaccggtactatatattaggaaaaaaaatgaccatgagttggctattagaagattagagacagaatgagatcttaagcagatgtaacgggccaaatttacacttcaacggatttacactaaattcagaactccattagcattaccttgatggatttaccggttggtcagtacttgttacacgtttcctcttgcaaacattgagatggttgcgcaaagctgatgtcccgttcttagatgtgcaacataggtccttgtggcagtacttgcaccgtgctttagaatccttcccgtcagcagtgaactctacggtagtaaagtgttcccatgccttggaccgtttcttgctgctgcctgccgccactgcctccggtacatcagtattgtccatcggaatatcgtcctcgtcctctgctccatctccgaccgtctcttcagcctcaaaccgtgtagtaactgtagcacaagcatggattggaaactgacgccaatacgccattgttgcaggcaacgcagcttgcaaacttaattaaaaggcacggatatatgcaaagacagtacctcctccctcgacctgctgctggagcctgaagtagtcgagctcgtcgaccgcatcgtcggcgtcgtacagcaaccccctgagacggccgagcgatcgggccagcgacctgttcccgatcgccctccccttcacggcagccaccaccccatccaccttctcgatctcagcccgtagcttctcggtgtcagcggcgagcctaatctggcgaatccattcatccagcttgtcggcgtccaggttatccaggatggtctccgccagccacctgatcccgccctccagccaaccggcttccacctcctccatcggaacaggagcagtccttggactgtggccaatggcgtgtgcaagagggctgcaacaagcgaggatgggaaggcagagtagtagctaggagaggagactgcagagtgaaaactaggtggaaaggagaagattcaccagtgcgtgtgggcgtgtggctcggggcagcgctcctggtcgtcgtggattaatcgtctgatgatgatcgattgcttcgcgcgacccgcgttttctcggattactactgccgcgttgacggtggactcgtcggcttccacttcgatgggctgtgggctagttggttatttggcccattagcacttcagcatccgaagagaagcctaagttgagcattccaaacttttggaagtttatgggaataagttcacttgccatccctcagctctgcgtcgagtcatgtatgacatccctaatccccactacgaaaaatgttgaccgacggttgttttatctgacgtggcatccgagtaaaaaaaaaatatggaaccaacatgtaagtgtccacgcacaccttcctctatcccttctcctatccgcgttggtggtggatgaataggaggggggaggggaggtgtgacgctgcgaattggagtgggcgaatcgagccctccctgccaaatcgtcatcgcctcggcagtgggggagctcctcagctcatcgatgctagaagcggctcggggacaggggacctcgatgaggccgcggcgtgagcttgcgaggctgctacggagcaggaggacaagggtgtcgtggcggcgtgagcatggcgagaggatgttgcaacagacggagctatgaggttcaccgtcccagctgtctcctcgccatcgccgcagcatggacgatgttgaggtggtggccgagctcgtcatcgcgaacaggccgaaaggactggacgtggcgatggttcaggtagtgggccctgatatatgccacatcaatggaaaccaggggaaatatggtctataccctcgaggaactactttgcatggttttgaagacttgaggggtcgacatctggtattgggaattagggccatcatacacactccatgtaaagttgagggaaggcaagtggacttattccagtttatgtcgatgttggcccaggcccatctctggcttaaaagtttgagttatgcttcgacgggccgctacacagtacgaaatgcggtccattaattacggttttttttgggtataaatgcataagtgtttcttttgttctactagtaatatgcccgtgctaacgctacggtgtcattatatttttctaatattccaagaaacctttatacataatattttcggtaaggtctatctctttcctagtttggtagtttggcaaaaatccctgttactgtttgccttacatactccttgacaaagcatagtaaagttgtccatgcgaggaatatatatattctcatttgaaaccatgaacatcatcactctatgttagcttacctgacaacgccgatgtaatatgtttcctaaaaacaacagtaattatctttcataaacatcctgaatgcctttggaattaagaaatatgtattcagtcccgtcttcctgaaataaatattatgtatacattaaggttcacaaataaggtacagaattacatcacttcctctgttcccattatgtcattttctcaataccttacttgcaaaggactaagatacaaatcatacaatcgattgttgttctggttgtccaacgaaatgggaaacaatctaccaaatagtgaacggagccaataataatatttgctgcacatagaacagctaaaagggaatcattatcttattatattattcaaagcactaagggttgcatctgtgaaacagttgcaagattgcacagtaatgtcacttgtaatgaatcaggaaaaaaaaaggggcatgggtttccagagtggaaagagaaaaaaaattacctccactgctatgatttcttatgccaagtgaacatcgttatatcaacaaattatttgcatggtttaaaaaaaataatagtcaataatatgacaaaattggagcaagattcagaaaaagaaaagttgttggataaatgaacaaagctcatttaatttgtcaacagaaagctctaatggtccattgaaccagttacaaacagaagattgatgtaatgtattagtagtaaattcatttagcatatcaaattgcataagtatgtaaatgtccaccaaaacactggtaacctgaatttttttgacaaactttccctcagaagtttcccacgctttgattgaagaatcttcagaactctacagtgcaacatattagtcatagaatattccatagcattgttttaagaactgtacagcagacacacattagttttagaatcttgatatttcaggttcccaattgtgaaaagtagaaacaatatgcattgttgtacatatacttatgtattcaggttcccaattgtgaaaagtagaaacaatatgcattgttgtacatatacttatgttgagaaagtgattacctaggcagtgtgttagcatttgaataattttctgaacaaatcaattatatttcctatattttcacgcttttactgttctacaaaattgagtgtgaactgaaaggtgtacatttgagtcccagtaatacctatacaaagaatttgcagtttttgaaatttaatggatgacacagcaagaggaaagtgcacccaacaactgctaggaaactcagcagatttcttgtttatagatcatagtaccactgcagtttcagtcattaaacttctagttttttcctttttagataaatagccattaaactgctataagtggtgtttacttgtgatcaatggtgattagttgcaaaactaatcaaatcatcaaactaaggaacttaatatctgacaacaattcaaaaatttccaagatcctagtcaatatatactcaatatacagaattagatgcagatgatatactcttgacaatggcaagatggaattaaggtgctcgccacaaatgaaatggtgaggctgcattagacaaagcaagtaatctggttaatccttacttaattatatgaaggctgtatatagatgcaaaaacgggggatcc

SEQ ID NO: 59401 - DNA, 504 bp, Oryza sativa
tgtttcaatcgcatattattcatcccctttgtgaccatatgtttgtcattttttgcttccctacgatacttgttgaatactgctcagttgaaatatactagggactgtaatgcttggcctttttcttgttgccagctcccgttccatgtgttctgtgattctgtctgcttgctttttctatggaccagtttcgaacagcagtctgaaccagagagagaagaaatttagatgtctcggaggtaattcttttttcagatcttaagctacctattcccaattaccctgctctctccagtttgactggagtattaatagttctttttgtggatttaattgctggtaaaatatatttgaagatattgttcattgaacttttctgagtgtgttcctctgtttcaatttctgttttctatcatgtgcttctctgctccaaacccgataaattgcaaacatgttaatttcttgattatttccatgtatctatcgacgtttttttttaaaaaa

SEQ ID NO: 59402 - DNA, 3840 bp, Oryza sativa
ctcgggttccatcaatggcgccggcgggattaggggagggtttccaaacgaatccaagggagagagggagggaaaaatggggggaaagggagaggggatcacggggaatatttccccccgctttattgcacgcggggacgacgggaggcggcgggattcgcggcggcggcggcgctagggcgcgggcgaggtggcgggagcggcgggaggaaggggatgacgggtgggccccacccgtcagtgagggtggcgggcgggcccgcccgtcagcggcgctcgcgcggggagaggccggatgggccgcggggagagaagagagagaggggagggaggagagatgggccgggccggcccaagggagggaagggggactttttagggtttttttttctttttataaaacctttttaacttcgtttattccttaacaattattatttgtgctctgaaaatttcactaaaatttatttacgtattttaggcttttaggaaatatacaaaaatcctctaagccttaattgacttttaactttgcacattttaattgttggaggctttcacacggattttaattattctaggcataatttagaggatatattttaggatcgttttgggacgtgacatagaataacggtcgaaaaacagcagagtgcgaaacttgctcggagtcggtacacggcaaatccggaacattatcaaatatcccggacttggggggcatgtgttaacgaccaaatttggtaatatcaacatcggaaaagcagattagatcgaggtggagtcgaaggcggagattgatccgagaacagagcaagaatcggctgaagtctagatcggctacgattaggatcggctgggtctgagtcggactaggtaagccgatgcagccgattccgacagtataatttggtgtatgacatcgggttgaattgaggtgcttcaagatgattgccgcacatggatagagtcctgagaaggcaattgtatctattaattaggatgttttatgtaacttccttagagatatgtttgggcaaaagtctgccgcaaagacttatggtatcttagagtttgttagagatggtggtcgtgtccggtatggacatatcttgtaatcctcgggtataaatagaccccgaaccctatgtaatttttaacacacacgttcaatacaatttcggcgcatcgccacctttttgctttagttttgtttcgacgagttcttgctttcgggttgagctgcatcggtttcaatcttcaacaagaggtaaaacttgttatgacgacttgtgttctcgagattagtgcttccatctttatgacactctaatcttgtctatataattcgtcgagttatcatatatcttacataatctttggcaatatcgtcatctaacctacaatcggctaacatctgttaatagaaggcagccgattaggttaaatagagacgttgtcctatattatataagatatctaccactttatgaaacatccagcggcttgattgtatagatattgttcttcttttcatacttaatgctgtatcagttgagtttgatctattaagtcgtacttagaatatcaatctttagcctgtcctctggttgtcgattagggtagtatcggagtttcagccgatcttatctgatttaaccatattcgatctatatgcttcagtgacatgtaaaatctgccctttatttcaagatcttattgtatttaagtatattaagcttttgtttggtatattatacttgttttgatatctttatatagagtagtatcggggtattagccgatacatgctagatctatctgatcggctatgctataaacatatataatcctattattaatatatatttcgatctaagtgatttatattgtctcggcatgctgatcgatctatcccaatcacttgatttaagtatatattaatataagaactatatatcgttaatatctacagccgatcgaatagatttagttccttactgtctatttataaccgcgatcgattcatatatggcatcggctcaaagataaatgatatgtcatcggcacctagcagatcggctatcatttatagatttaaccacgaattctttgtctctatttcttgttgattacaggatcaaatcaactgtcacgctcatacattcgaagacgagctttggacctgcactggagttaagcagatctcccaggcctcgtgttttctgtcaacagctaccttgtgaccttgtgagtacccttccctcaccatgctcgccctaccttgctcgtggtgtgggtttccattttcgatgagggggaaccgccccagctgccatcatgcacactaaaacctagcggagtaggcaaccaacgatggtggtatggtggaatagcaagttggcgtgctcagctaggcgagaaacaacttgattatgtatgtgaaaggcaggatttttgagagatatatgtttttttttacaagcgggcatataacggggtatgtgaaattcactcatcatcataagtttgaacaaaaaaaaatcaatgaaaacaaattatttgcaaaaacaacattccataagaaatatttacaaaaacacaaaaatagttctcacaagaaataaaaatagttgaccatatattgatatatagcagccatgtgagctgtgacatgttgtaagagcaaaagagactagtatatatatacacacacacgccaactaaccggtattaatttattaacttatggccacgcaaatatctaaaaacgttaacattcagctagatatatatatagacacataaatagcagagaaaaatccaagaccacatgtacacaaatactacctccatcccaaaatgtttaacgccgttgacttttttaaaaatgtttgaccgttcgtcttattcaaaaaatttaagtaattgttaattctttttctttaaatatacttttatgtatacatatagttttacacatatcacaaaagtttttgaataaaacgtacggtcaaacatgtttaaaaaagtcaacgatgtcaaacattcagagaaggagggagtatataatatgctcctctattcctgcatgcaatttgtttctattcagtgatgacacagtgggtcaaacaagttgcacggcaactagagagccccatgcccagataccggaagaacaccctgaattccaagcacacagttttgttgtttttgcatactgtatcatgatgagtaatacttcctctgtccactgtcccactgaataagacgcatcggcaatttaatatttatcactttaaatatttgaccaataattattttattacaagttaaattttatttgatgaaaataatatcattgaattagcatttgaatgtcctttcctataattatgattttgttgcaacaagcattgtgatatatttttttagatattggaataaaataacatctcggcctttactcaaaagagttatagccaattattacaaactagcactttgtaaaaaaggaaaccaaactagacaaaataacattatttcagtatattggtaaatatccatccatgattggtaaacagttgcataaccgtcgtttcaagcttacgacatgcaacaattaggaaatctccatcttcatcacatttttataactgtgcccatagacgaagcaaatatgttgccttgaaaatgacctacatataagtaactgtaggtgatttgtcaaaaccctatcattcctactcaaccataaagcccaacacaaggcaaaagctccaacaagtatcagttggctctttttatttacgactctctgacgccaatcataaaaaatat

SEQ ID NO: 59403 - DNA, 4049 bp, Oryza sativa
cctagctctaattgagtccattttctggtgcacactctcaggcataagatagactcccatcatatacaaagggatactactcacacaggaattaatcaatattgctttcccaccataggataggtgtccacatttccaagtggccaatcttttctctatcttattgggaggtatactaaaatcagcaactgtcaatctatcaatcgcaattggaataccaaggtatgtaatagagttctgtaaatttggtacgtttagccatttccttttaaaaccaaatcatccatgcatgctaaggcacatatctttttgaaacgtatatctgataagtaaaatattagaggcggacttttggacgtcatttaatttcatttctctaatcaattatatttaaggaggatttatttcaaatcgttatctgataattaacatgcatgtgccatgtacgttacttcccacataaatccaaattcatatttgtctcttcaaaaacatatacagtataaattaattcgatttttcttgcgcggcttgtgaataacttctctgaaatggctagctctctccctctcctacatgtgtgacctgttgtacgatatgacaaaacatatttatcacgctttattaattagcgatatatatgccggccgcgcgacgcatccaacagtgcacgagtgtggtacgaattaacgtacgtacgtacatgtagctcgtgtccgtaggcagggcaggcacgtactttcacgccacagagcttacacgtgctccctccgtaaaaaaaataataaaaaaaagacaacccctgggtttcttattttaaaaaattataaaaaaaaattaaaaagacaagtcaagtattaattatattttattatctaacaacaataaaaatactaattataaaaaaattttatataagacggagagtcaaacattggacacgaaaatccagggtttgtctttttttggacggagggagtacgcgttataaattcatcgtggacgttgcgtacttgctagaccaccggtcaaacatcacacctactactccctccgttccaaaatatctataaaagtaagatgtttttattctgatacggtcttcgagatgctactttaaccaacaatatttataaaagtaagatgttttaaataaaaagagttacatattatgatagtttatttaataataaatctagtaacatcaattttacatgattgatctttttttattttttttttgttattaatggtcaaagttaaaaatgtttgacttgtcactatgctaaaatgcttatattttaggacggatggagtagtaactaaaattgtcaaccaaaatgctctgcggaactcaattaataaataagtatttttttttcttttgtctatgaacaggaaaataatgaaagagattataacattttatcatgagagctagacgtataaaattagatatggcaaaaatacaaagtgagtgtagttaattgattagatatgtttcttgttgtgacctgttcaagtcttagaattggcatagtgctcatatttatggttaatcatcatttaaattgtagccaatgtatccttggcaacgagacatttatggtgactttcttaatattaagatatgttggctcagtcacatgtgactttgtcaattttaagatatgctagctcagtgtttcagatatgttataggggtaattagattgcgaatagacaaggccaaatcacgaaatcctattaaaagggcatccactcttaaagagaagaagaccaatagcaaattaatcctccgcctcgcaaatcctattaaaagcatactagcctattaaaggcatactagcgtaatgcttaatattgatgggtacgtatataagatttgaaccctagtagattctcgagaagaggaggctcgaacccagaccgaagacgttttattaatattacttatttataaaaatcattggcaccaagcttttttttttccagaatttaattatcatgtcctcgaagtggtgcggtcagagcaatatatcttaattattggaaaaagttttacctttagggcgggtttagtccccaactttttcttcaaacttttaatttttcatcacattaaaactttccatcatatcgttccaatttcaatgaaagttccaattttagcgttaactaaatacacccttaatctaaggtttggaatgtcaagctagctaggtccaatatattttaatttgctgcagagagcatgcattacgctatatatatgctcgttgtcatgtctttgtcacggcctaacatgcatatacattaattaggacgcctgtgtgaaggtctttgttttcgcgaaacaacagtataagcactgtggataaggaacaatgagttaatatagctcgtgcacgatcgtccctattaattggagaaggttaagtatacatcagttgatcctttttgttttgacgttctgtcgtacgttgacccaattggatatttggatcgatagagctactctatctgggttaataatactcgttttttaacaagagcacggtctatataaaaagtaactttgaccaatattttttattataatatgtataaaagtgttaataaatatatgattttattaaaatattttttaagactaatctatatatgtagtcaccatatttgaaagaaaaatattttaaaaataatttataatcaaatattctaaagtgtgataccatatttgtctaaaacgataagtattatcagctctgagggcggagggagaatatatattagtataaaaattagatctagtatatgcatgatcatccctttgtctttgcatatactagatcgcatctcttgactagtggtaaatttatttcccctgtactttggattatcaaggtactacctccattttaaaatgtaggcaaaatttgatacgagacacccaaaaatcgtgtaattggctgtgagacaccgcaaaatcgtgacgctgtttatggacactacgaaagttgtgaaattggttgtaggacactggaggcaatattttataatttccgagacaaaagaggtcagagaaatttctaaaagacctgattgcccctaggcgccgtagcttgtaaacccaactgggtctagtcgtcgtgtccatctcccccacccgatttccttattcctccccaatccctaaccctagttgatagtggcgacagcgccggcgccgacggcggcagatacgacgctggcaatggcggtgacggcggcgacctcaatggtgcaagcctggtcgaagcagatgcagcaaagctccatgtcgctcacctgtgcccaaatgatcaacacattttgcgaattcacaggagtttgctgttcttctcagacttgacctgtcattttgctgaattgcccatactctgccactgaaccctacatcagcagagcccatggtgtggccatccccacttaagttcatcggtgagcttgaaccagaagctaaggctctcctggaagcagctctgatggaagccaacagggagagggagaagaaaatcctgaatggcacaaagtactccctgccatcccctttgcctggtgatgacagtgccgatgacgatgcatgctcagaggtatttgagtgctgaacaatttcagtgttatcggttggattgggctcccataaacacattgtgtaatttagttttctgtgttgatcatttgggcacaggtgagcgacatggaactctgctgcatctgcttcgaccagacttgcaccattgaggttgtcgtcgtcgcccgccgtcctcaccgccagcgccggcgccgaattcgacgccgccgccaccgtcgactagggttagagattggggaggaatgggaagtcgggtgggggagatggacatgatgctgacttggtctggtctacaagctgcagcgtccaggggcaatatggtcttttagtaatttctctgacctcttttgtctcggaaattaaaaaatattggctctggtgtcctacagccaatttcacaactttcgtagtg

SEQ ID NO: 59404 - DNA, 2357 bp, Oryza sativa
accagtcaatttggaggtctgaggttgcggatctggtctgatcgttggccctccacctccctgagcggtgtgttggcgaggagaccggcgctgagtgactggtggatctgacttcatcaatgcatattcctgaacaagatgcttccatagttagtcaactcagcatgaagataaaattatgttctgatcacggtttgagggtttccgatgcatacctgtggaggcggattgaatgcattatatggcacaactggcagttgatgagagtagctgactacaattgcatttgagaagattttatacatcctctccttcatgattttgaaatccagggaatctggttcttcacggttgggatcatgtttgccgtcgaactcgaatgctgtgcgggatctttccttgattggcgctagtcggcatttgatgaagtgccgagtgatctgctctccctgtaagccttgttctttaagatttaacatacgatccaacaactccaaggcttgtactgcttcatctccgattggaagagagttccaagtatcttggtacactggaggaagacaagagtacccgggaagagcaagctcgggattctgaacatagaaccagtttgcatgccagcctttgttcgaagtcttgaagggcatcgagaaatatttttggctcagagttccccttagttggaatcctgcccccccgactacacacggtttgttcttgtttggttggggcttgaggaagaagatccggcggaatagggcaaagtgaggtttgatccccaaaaaggcttcacaagcatggatgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaaacctcaccgtgcgctggccgccacccgatgatctccttggcagggagaacgccgtgcgccaccatctccttaagattttcctccgtcacgtcggatggcgcccattggccttcgaagctttctctctcttccgccatcggtttcactcaaatgtgctgatttgattcgagggatggcttgggagaggtgagggattgaggcggtggatcacgggaaggattttgatgcacttttcggaggtggatttggccggagctgtgaaccctagttcgccggcgcagctttacactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtattatatgcctgttttcatggtaaatagtcatggcctaggctatttgacttatttattaccataatctttataatacttgatgggtaatctttagagtttttatattcggatgcctgtcaagtgtgttcattcgtgaactttttagagtgtaaaccactcggatttcttttattgtggctaaaaagcagtcggctagcatgcctatttaggcgccgcgtgtgcttttgtcatataatgcacaattgtgttattattttgtctttcaactatatgtttagtttgttaactaatcacatagttgggggctacacctaattaggtgcatctattcgatgcaccatattctttatcttttcgccctttacagtccactcggcagattttggcttgaagagtttgaagtactcggattatcatctttgagaaggctatgatggtcgactgcaaaggactcgggggctactgtggagattatgggtatcccatatctacacggcgatggtattcgaactgggtacaggatacctaatgtagatagaatatcttatctgtatctcgggtttgtttcttaacttgtgtatcaaggaaacacccagagacttagtcggttacgactggattttatctgtatttcatattccggtaggaatatagaatatcttttgtaatccgacaccttccatatataaggggggtcccggcgctctaggg

SEQ ID NO: 59405 - DNA, 10718 bp, Oryza sativa
ttaagtttgtttgaatgtccgaaaatgtgttacaatgtctcaaacctatttgcatgagtggatatttaaaatttctaaacgatatcagatagacacaaaacctatataaaagttgtagatatagataagatctacatttttctacacttttcattttatcttatctatggtgttaaatatggattataagttcaaatgatagtggtctcaaaacaatagcatttgtttccaagacaagaagtgtttgtaggtgatatggcaaggtgactttgtgtgaagtgagatgtcttgaatttgaatttttcttgacacatttgtatgaatatggattcaaaaattatgtgacttttgggaacgagagtgtgattgtataggtgcctaataaaaataccaaatattttttttgactttttagcacctgaaaaataaaaaacgaaggtgtgttggttcaagaaccggcaccaatgagcattcatgtagtactgcgagcagatttaggattaattcttatgacgagtttgaagataatctaccacgtctagattgagtacatattctcattatgataagtaaatatttgaagtggggtatttacctaagaggaaaagcacagaaaaaagaagaagaatatttgagtcgacgagagggagcctcactcctgtctagatcacaaggtgatccaattttctgacaaattttgctaccatcatacccaacataccagtaggttattgggagatccaagtactttgtcttgtgcactagagttttgcatttctactagggttacataaatttatggcagcatattcaggattttattccaatagcgagtttgaagtttgtgcatcatgtttcgtgtctatgctaagttcacaccaatggtaagtttgaagtatgggtcatctcttttctatcgagggtactacatgatgttgtttggagattgaagatttttatggaggacactacggaacgggtgcccgatttttggagaaaaaaattgggccccctaagcatgcatgcaatcttttcttctgggaaacctccacatgcatgcacgcagtcatttcttctcttccacatgtgaggtacatgcaaacttctcccatccccttgtctcttctcccatactcttaattagcaaattataaaccattttttcttatgaaatacttatccaatttgtgattcaattgcaccgttgaatttgttgcaattaaatctttacaaagagatctcacatgattatattttggagaaataaaacatatgtaattatattactaattgaaacatttttattataagtgggacattgatttgtgacctctaaaacaatacaaaatatacattgaaatattgaaagaacaatacgtgcaagatcctaaatgatctagtgaaacatctgctgaaatgtccaaaaaataccacgtgtaaaatttcaaatgagctagtaaaatacccagtgaaacatcacaaaatacatgctgaaacatccaaagaacaccatgtacaacattccgaataagctagtgaagtatcttgtgaaacatcacaaaaaaccttctaacacattcaaataacatcacgtgcaacattccgaatgagctagtgaaatacgttctaaaacatcacaaaatgccttctgaaacatccaaagaacacgacatgcaacattccaaatgacatagtgaaacatcacaaaatacctagaaaaacatcaaaataataccatgtgtgcaacacttcaaaatgacctagtgaaacattagctgaaacatcacaaaatacctcctgaaacattcaaagaacaccacgtgcaacattaaaaaatgatacagtgaaacatcagccgaggacatcacaaaatacctccttaaacatcaaaaaaacatcccgtgtaacatttcaaaatgacctagtgaaacatcattaaatacccattggaacagtaaaaaaatccattataacatcacacggtttgaggagagacgcatgagaatccgattgttttccctacaatcaggcgtctggacaggagcgtttcggatttttatgctacaaggaaaattcgtcttaagatggagattgttaaatatgtgatccaaatttcagcatgcaatatgttcagattgtcaaaacttggtggtacatttggctacaaaggaacgcaaagatcttcagaggagaagaaccggacatgcaaaggacttcacaccagatcatccaagatattcaagaaagcagttttgaattccaaccgtcatgagtgtatctcttcccttctcaaaccaggatctatggttctgagatgattctaagttgtttttccgcattaatcgtgtaaaccatacttttctctccttctaatatattcggcaatactcttgccgctttcctttcaaaaaaaaaaatagcatgcaatatgttcggattagttttataataaaacacttgattagtttcttattatgattgtaagtcttttcctactaggacttatagatttctcttttacatgtctcttgtaagctacacgagaagggtgcgacaacccagtgtgtcgtgcgtttgtattcaacttctctatatcgatcattgctagtcggtgtccgtggttttttcccgtaaggattttccacgtaaaaatttgtgtgtatgtgtgcgtgtgtgtatagaactactatgtggcaccttaaggtgctacgtattaaatggcacgtgatacagcccccagccccacccactgctcaaccccccaccactgccgctcccaaccctgtcccccaccaagtttatagcatgcagttaaaattttactcactaacgaccaatctcgatcccacccctgcgccccctgcccccactcctatagtccaaataattttttttactaacagtgagatagtttcttgttgtactctaacgatgtcagcatcttgagttatttttttactctatgcgcattaaattgttacagaacgtagagaagcgaatcttcaggaagtagtcattgcaaaaccgccacataacagtgatcacgcatagttatcgtcttctcctaaatatctggatcggcttttctcttgccacagcaagcccctcttccttgtgtcgcgactggctaatcggtgatcgccagcaccgccgcagttgctaccggtggttctctccctacgacgaccaggtaatgcgctatccacaatccgttcatcttttttttttctgattttatctccacctcgtagccggtatctatgatggacctcttcgtagctagcattgacgactgcttcgctccaccgccgccgtctccatcatccctgatgacaccatgtgacgaggcaggatgacggatccggccatcgtcggcccagatccacgagcccattagcaaggtggcgaggagaccttccctctacggtgctgaggaggatctggttaaatttttgtctatttctcaaggaaattaaaaagaagtcaatggcaagccataatggtttgcttccaccgtacagctagcatgccaaccactttctgtacatacaaccaacctattcctttaccacgcgcgtctctccaggtccccccccctctctgtctcaatcccaatcgattttcttctacccacgtgggtcccacaccgccacacgtcagcctcttcttcccctcccctttcaacctctcttcctctatcctctcctctctcatcccctctcttctctgtatctgtccgctctctcccatgggagcagccgaccagaggggagcagaataggcggagcggcgccgcatgaagccggcgggtagagcaagcaggcgaagtggggcgacggtgggcagagtggcaacgtgcgaagccgccagcgcggagcggggtatcggcgaatgacaacgacgattgcgacgagttcgacgagaaggaggaggacgcgcaccacctcttcctcttccccgtctccttcatcttcgcgccgacgaggacgtgacgtgacgatgacgctggtcctccccatcctcatgcatcgcaccaccattgctgccgacgccacggacggctcgcttgctcccatgcccgccggccggcggcgagcgcacgcgaatagggaggaggtagggagggacaaccagcacacggagagagggaggatgcggcgcaagagcaggccggggctccaagtccgccgagtccacctccacggcacccggccctgtctccgcctctgtgcccaatgccgcggcgcctgcccgcacggggcggaggcgacgcagcgccgtcaatgccattcgcgaccgtccgccaccctcaccttctcccgcgtcgcagccgccgtcgcctcctcctcttgcgcctcgccctggcggcctcctcctcagccactggccggtttgcccagagaagagaagagaagagtaagagagagagagagaggaggaagggagaggagggggaagagagagggtgcggacgtggcatcctgacatgtgggctcatgtgggtcccacactgactctgctcatgtaggataaaaccagggtcaaaaccaccgaatgacctaaagtgaatggtttttataagttgagggatgtcatatatttggttttgcgattgggggatgattttgtaactcgatgacaagttgagggaccttgggtgtactttgattggcaaataggcggcccaggccattcggcccctttagtatgatttgattttctttaggatggagggagtgcctcagattgttgctcgttaattgccacattgccgactgtcaactcttcgtcattgttgtcacactgccgaacgactgcccagaaacacttgtaaaaaaactgttgtttggtcgcctggactggtatagttccattttatttttaggacaacgaattaccatccaataaacgctatgcactagtatctctatagatctgcatgtttcattgttcataacttcatataggtgccgaaaagctcgtccaaaagtcaacaaacagtcaaaacgacatagtatttattccacacattcatgtttcatcatgtgcatgcacatatttcttccacacgtcccatttggccatgtcgtgcatggccagacctggcacagcaaggaccaagaacaagctccgcccggtcggccacagaagaagatcctctgacgtgaaatctcccttgacgtggtcactgacaggtgggctcgcgagcggttgggcccacatatcagtcaccacgtccctctgacttcatgtcagcggatcctaatccgttggccatctatttttttcacaatgattatcctaatttttctcatgttcttcctatttcttccttatttttccttgccatcttttattttctttcttttttttcctgttcctattcttcttattcttcctatttttggttttcccaacttcgatttcaaatgtcatgggtcacgtgttccaacagcgttgctaggcggcagatcatctgcataagcacggcattgacagacgctcgacctgcccattttgcgctcagaagcatgaaatagcgagccacatcatgctcgactgtgtgttcgctcgttaagtttggcactacatccggtctccctttggcttgcctaggcttgctcggcccctccgtagcgattctcttcaggtctggtggccggtagatagggcttgcctgccttagcatcttcgtaaggccttcgactctctggtcctcttggtttcctacagctttggaaagagcggaacgctagggttttcgattctttctctttcgccggtctcgatggttttccaatacattcactaggaggttcgtctctggtctctcgctggtcctgtctcgtttgggagccttttgggagattaggaggctcctccgccaccccctcccgcactactagaaaaacaatttttcatggcgtcacactataattttcactggcggttatatgctaaaatcgccagcaaaaacatgaggggtggggggtataggactgccagcgaaaaccgattttctctggtggccacgttaagacgtccgccataaaacatactctatttttcgtggtggatctcttaaatgtccgccagcgaaaaccgacgttttcgcgtcggttttcgctagtggttactaaacacttccgctagcgaaaaaacagagcccgctaaaaaaatttggcatcatttaaaatcacgcgcgtgctgagatattttcctttcacccacccactgcctctctctcctctatctcctcctctccacccacccatccacctccctctcctcctcctcccccacctctctcccctcctccttccctgctcctccagcttccacctcttgtcgacgaccgagatctgggaggggcgcggcgccgacgacgggcgggaggggcgcggcgcggatgtgcacggcgacaacagcgactacgacggaagcggtgacgatgatgaccacgaaggaagcggtggcgccgcgccctcccatcccctcctctaccctctcctagatctgtccgaggggaggaggctgccgccgggaaggacagatccgccccggcggcggcgcggggcgcacggccgcggggcctcgggcggtggagcacgaccgtcggccttgacctcgtcacgatcgacgctgcgccgtggggagcgtgaagccgacgccgccaggtcacgggcggtggtgctcagatttctgtagatttgtgtggatttgtgtgcatttttgtggatttctgtggattgtgaatggaaaattttgactgtgaatggaaattttttattataaattgttcgtgtaaatttatgtgaatttgtgaatcgaggagtggatttgggaataatttgaaccggtgttgacggaggcgaacggagcagtgttgctttgtcatttttttttaacctgggccactattttcacaggcggttggtataactcaaccgccagcgaaaatcgtttatcgctggcggccagtataacacaaccgccagcaaaaatcaattatcactggcggccgataaccgctagcgaagatcttgatcttcactggcctttgctttgtgacggtaccaaaaaccaccagcgaaaacccaaaatggccgcaacgaaagatggttttcgtagtagtgccgctagatacgagcaacaacttctagttttgactcttttcccttccgcaatctttttccttgtaaccgacagcgaccagtttggtcgattacgctgtataactaaaactctattttttttctaatatactaacgtgcaatttcatgaaaaaaatatttcatgggtcacacgtgcacgtcctggctcctcttcggccatatcttggttctggccttaccacgtgagccgccacggcatatccttgtcgagcagtgcataataatcaggatgtacccatcaagccatgggctagggtgggctgaccccacatgcatgcccgtttgatcacaaatactaattgttttgatataattcatgtcaaattgtattttttttgttacttatatcttctattatattattaaaggaatagaaaaggaagtctccacgttcgctttcatggcctagaaattctcacattaatcggagaaaaagaaaaggcagagtccatatagaaatacaatttaaaaatagttgaaattcggaattaaaaaataaggaatattagaagaggagactagagtccatatagaaatacaattagaaaataactgaaattcggaattaaaaataagaatattagaactagagtatagagtacatatagaaatacaattagggaatagcagcaattcagaattaaaaataaggaatattagaagtagagtatagagtccatatagaaatacaattaggaaataactgaaattcagaattaaaaataagaaatattagaagtagagtatagtctatatagaaatacaattagtaaataatagaaatttggaattaaaaataaggaatattagaagtagagtatagagtctatatataaatacaattaagaaaaaaatagaaatttggaattaaaaaataaggaatattagaagtagagtatagagtccatataggaatttaaaactaactaaaatttggaataaacataataaaattaaaagtagagtttagagtccgtataaaaatacattttacaaataactaaaattcaaaattaagaaaaacatttgaagaagagtttaaagtcaatataggaatacaatttagaagtaactgaaattcaaaattaaaaattagtttagagtccacatagaaatacaattagaaataataaaaattctgaaataaaaataaataatattggaagaagagcatagagtcaatattaaaaaaaatattaaaaaatgagtcaatatatataatttacaaataactaaaatttgatattaaaaataattaataactaacacgtatataaaatacaatatgaatattacatattagtagttttgtaaagttattgcaaaatttaaaattatgttgtcattttaatatatttgaataatataatgagaaaacatactattgtcagggttatggataccacatacctaatagtagttgactaaatctcggcaggacccaccacataccatgtcttatacgaaaactgacttcagttatggagagagttccggataaggaaagacaacaaaagttttacatggaaacgacaaggactactcggattgtatccatattggtttccctacttctacttggacaatgggacacctatgggtataaatacaagcccccctaggaggacacggggacacccaccatgacaggatcaacacagtcaccacgatcgacacagacgaccacctcaatcaacaaccaccacaatatacggaacaacagaagccacaacatacaagccaacacatgctaagacaagccgccggatatcgacttcagggatagcatggctattcccctacggtgtctccggataccgtcaggagagacgaaagcgctatctctgatctcgccggacacagattcgaggaggaaggctaccctgttgtcgactacgagtcagaccttcagaccgacatgtcgacaacagttagataggctaccccacatattgtactggtgtgattatggtgaataaaagcaataccggctccggccaacaggatgtagggttattacctgacaactcaggggcccgaacctgtataaaaatccttgtctccgtctctttcacctcagtctcgcgtatattctagcaccgatgatccccatactatgcaaataccagaattgcgacatcaaacgtcgacagtggcgcgccaggtagagggattttggtgcttcaggatttcgacgagatgggtttaagagatggattctccaatagcaaactactcgacgacttcggctgtggagatctaacccgaccggaacatgtcttccgacaagatcagaaccatcatcgtcatcgacaacttggtctatcgagatcacccaagcctcaagctccgcgccgtaccaaaagatgtcagatcatatgatgtcgaacgagtacgcaataaggtaattggtagattggtttttcaaattgatctactaatttcgtagatacatccggcatgtatctacaaaggtacgtaatattttatatgcaatttatcgtacctattcagatgatacaacattatcatatcagcaatttattatgtttacctagagcatgtttcttatacaacatccgttgtgcgagtacttccgacgatagaccaactacggtctaacgctgggggctcactccgttctcttatgtataaatcatgcttgtttacggtttacataatgccctgatatttacatctgcttattgtatcctgataatactagaagatccatgcagttctttgagtacatactcgatattatctgctatatatcttgccttctagaaaatatttttcaagaacaattgagcactcgagtaggttatggtcgaatatactccattatcgagaacattctcgacaaatgcggagttatcgcacccaacctaccaacaaagaccgacgacctatctcatagcaccggccatggctggactacttgagaaaaggttgttaacggataattccttgcgaacgtcgtcggcttgatcacccgacatgattgcgaacggacatccggatatgctataagttgggtacgtgagtcatgctggccacatgagatacacttgcaataaaccaactctagcacttccactggtgttcgagagataattctgctcgctcactggttctcgcaccagtacgtagcaatctctcacaccgcagcttccattggtgttcgagagataattttactcgctcactggttatcgcaccagtacgtagcaatctctcacaccgcaacttccattggtgttcgagagataattctgctcgcacgctggttctcgcaccaatacgtagcaatctttcgcaccttaacttcagatggtcgaggtatgactacggcatcgtagcggtcctcgcaccatgacttcagatggttgaggaacagctacgactggtcttcgaccggcagcgtagtggtcctcgtaccacgactccaaatgatcgagggacacctactcaccggttctcaaccagttgatcgtagtaatctctcgtacatttgcttctagtggtcgagttacgactact

SEQ ID NO: 59406 - DNA, 1605 bp, Oryza sativa
taagccattctagcaatgtaagttattctagcatttcccacaatcatattgatgttaatgaatctagactgtctagattcattaacatcaatatgaatgtgagaaatgttagagtgacttacattgtgaaacggagggagtatgttgttgttgaaaaaaatattagcttcttcatcttaaaaaaagatagtattagtttccatatagatcaatgactcccatcatgctaataagagatgtcttttgatatctctatctctactattaaaaaaattgaagatgtttccaccagaattttagtacgtcatccatatttgagttgattatacgtcgtcattatcaaattcaacctgattctagaataactattatatactcctatcccaacctaacccctccccctccgccagcccaaactaaccgtcccacaccatcccgcacgcctccactgggcaccgtgcgcgcccctcccacgatcgacatcttttttttgtcgtcttccctttttttgttttctttttctccctttctttactcacggtaatcctgatcctctccatttccttccaatctcctatcttttctcctcctttttctctcctcataaatatttttatgcggcaagtttgttacttcgcaaatgctttccatctatagtaaaaaaacattttacaaattgaataatcaaatttcaatttttggtccatgaggtatatatatatatatatatatatatatatatatatatatatatatatatatatatatatatatatcaagctatatatatggaacttttgtaagcaatgaagaggcaagaagatcaaaagaaaatggttaaatatataccggcatatttgttttagtgttttctctcgtttcctgtgatttctccgataaaatctgtgaatcatgataagtaggatttttcaaaataaaaaggatattttgcgatgataatgctgcaaaaataatctctggaggatttcaaacaaagagcacatcattttaagtacatgaattatgctattcttctatataaattggagcagtcgtaagtaaactagataggtatcctgctcgttcccacgagaaaatttaagcgataaaatagtatatatgagttagaattttcttacttacatatatacctatacgattttctttcatgtgcttatatattttgcatcttgatcaattatccaaatgttataaatgattggattgtatggtgtggtttttggaagaagcgatgaactttacacccttgatgattaatctaaagagaaataattgaaatgatgtgacttcattgtagaaaagagaattaagaattacctgaaacataggatttagtgagaatgaaccttatagatacataggattaactaaacacatcagctagaaaccaacgtgaaacttattatgataatagtgagttgctaacataaaaccttttagaagaaaacaaacaagagaaagatcgatgatggtataatggttttcgttaaaaaaaagagagaagagtataagagtataacacgaacttcaggagattgaaggtaaatatatatacccaattttctttaccctgtcaacgtgagg

SEQ ID NO: 59407 - DNA, 4829 bp, Oryza sativa
gtgacactatagaatactcaagcttaaggaagctcatgacaacctcctttccactactcaacatggagttctcattgatgttggcatatcttgtgatttgcttgatgatagtgctatttgccatattgctcatgttgtatcatctagcatttctacctcttgtgatgatcttgtggatatgcctagctctagctctagcacttgtgtttctatttgtgatgcctcacttgttgttgagaacaatgagcttaaggagcaagtggttaagctcaacaagagtttggagatgtgcttcaagggtaagaacactcttgacaagattttgagtgagcaacggtgcatccttaacaaggagtgacttggattcatttcaaagaagggtaagaaagcttctcaccgtgctactcgttttgtcaagagtaatggtaagtattgctccaagtgtcgtgaggttgggcatttggtaagccttccaagacttgcatgtttgattctcattatatgcttaggaaggctcatgatggtagcattattgctagatatgtgggttcccctatactccgtggtaaaaagaatgacatttgggtgcccaaagctttggtctctaacctccaaggacccaaacaagtttgggtatctaaaagagcttgatcttcttttttaggtgaactaccgcaccggtgggagccattgtgtgcttgatagtggatgcactcaacacatgactggtgatagggctatgttcaccatatttgaagtaggagggaaagaacaagagaaagtgacatttggagacaatagcaaaggaaaggtaattgggttaggtaaaattgctatcactaatgatttgtcaattgataatgtctctcttgttaaatctctaaattttaatttgctttcggttgctcaaatttgtgatcttggcttgtcatgtgctttcttcccgcaagaagttattgtttctagccttcttgacaagtcttgtgtgttcaaaggttttagatatggaaatctttatttggttgatttcaattctagtgaagcaaatttgaaaacttgtttagttgcaaaaacttcaatgggttggctttggcataggaggctagcccatgtttgcgtgaatcaattgagcaaactttcaaaacgtgatctagttgtgggcttgaaagatgtgaagtttgagaaagataagctttgtagtgcttgtcaagctggcaagcaagttgcatgttctcatcctactaagagtatcatgtccacatctagaccattggagctcttgcatatggatttgtttggcccaacaacctataagagcattggtggtaatagtcattgtcttgtcattgttgatgattattctcgctatacttgggtgttctttttgcatgacaagtctattgttgccgagcttttcaaaaagtttgcaaaaagggcccaaaatgaatttaattgcactcttgtgaaaattagaagtgacaatggttccgagtttaagaataccaatatcgaggactattgtgatgatcttggcattaaacacgaactttccgctacctactaacctcaacaaaatggtgtagtggagaggaaaaatcgtacattgattgagatggcaatgactatgcttgatgaatatggtgtttctgattccttttgggcggaagccataaacaccgcttgccatgcaaccaattggctttatttgcatcgtctcatgaaaaagactttctatgagcgaattattgggaggaagccaaatgttgcctattttcgagtttttggttgcaagtgttatatttatcaaaagggtgttagactaaccaaatttgaaagtcgttgtgatgaagggtttcttctaggttatgcctcaaatagcaaggcataccgggtctacaacaagaacaaaggtattgtggaagaaaccgccgatgttcaatttgatgagactaatggctcccaagaggggcacaagaatctggatgatgtaggtgatgaaggcttgatgagagctatgaagaacatgtcaattggagatgtcaagcctactgaagtggaagacaagccatccacctccactcaagatgagccatctacttccgctacgccaagtcaagctcaagttgaagtggaggaggagaaggcacaagatccacctatgccaccaaggatacacaccgctctttccaaggatcacccaattgaccaagtgttgagtgacattagtaagggtgttcaaactcgatctcgtgtcgcttcaatttgtgaacattactcgtttgtttcttgtcttgagccaaaacatgtagatgaagctctttgtgatccggattggatgaatgctatgcatgaagagctcaacaactttgcaagaaataatgtgtggactttggttgaaagacttagagaccacaatgtcatagggacaaagtgggtctttaggaacaaacaagatgagaacgggttggtggtgagaaacaaggcaaggttggtggcacaaggtttcacacaagttgaaggtttggacttcggtgaaacttttgcccccgtggcaagacttgaggctattcgcatccttcttgcatttgcattatgctttgatataaaactatttcaaatggatgtgaaaagtgcttttctaaatggtgaaattgccgaacttgtctttgttgaacaacctcccggttttgaagatcctaaaaatcctaaccatgtttataaactctcaaaagctctttatggtttaaaacaagctcctagggcttggtatgaaagattgagagattttcttttgtcaaaggatttcaaaattggaaaagttgacaccacccttttcacaaaaatcattggtgatgatttctttgtgtgtcaaatttatgttgatgatttcattttcggttctactaataaggtattttgcaagggatttggtgatatgatgtctagggaatttgagatgtccatgattgaagaattgagcttcttccttggacttcaaatcaagcaactcaaggatgggacgttcgtgagccaaaccaagtacatcaaggatctactcaagaggtttggcttggaggatgcgaagcccatcaagacacctatggcaaccaacgggcatctcgaccttgatgagggaggtaaaccggtagatttaaagctttatcgttctatgattggtagcttgctttaccttactgcatctaggccggatatcatgtttagtgtttgcatgtgtgcacggtttcaagccgctcctaaggagtgtcacttagtggccgtgaaaaggattctaagatatttaaagcattcctctactattggcttgtggtacttaaaaggtgctaagtttaaacttgttggctattccgattcggattatgccggttgcaaagtggatagaaagagcacattcggtagttgccaaatgcttggtagatcccttgtgtcatggtcatccaagaaacaaaactccgtagccctctaccgccgaggcggaatatgtttcggcgggtagttgttatgcccaattgctttggatgaaacaaacattgttggactatggcatatccttcaccaaaaccccactcctatgtgacaatgatagtgccataaagatagccaataactcggtccaacattctagaaccaagcatattgacatacgccatcacttcctaagagaccatgttgccaagtgtgacatagtcattagccacataagaaccgaggatcaactagccgacatatttaccaaggctcttgatgaaacccgcttttgcaagttgaggaatgagttaaatatcatagacttctctaatgtggcttgagatggtgcaccatggttgcttctttttgcctttttgcatatttgctccttttgctcttatgctttggatttgttgccactaaattcttcattgcgaaaatggagcatgtcacattaagggggagttttgcactcttgcatgtgctctacttccctttatatgtgagcaaatcaactagtggtgctagtagtattttcaaaatgcccaagtcaacataagtcaaaacttttgtaaaatcaatgtaatttgaaaactatctcttggaaaatgtttcaaaaggtttcctatatgttttccaagcctcacattgcaaggaaaatgatttttaaatgaaaatgcccttttggccctcttttgaagaaactatattcttatttttggccaaaatgagattttcctccaaaatgagattgagagagaatttgagaaaagtttcaaaacaaagttggtaaagaggaggatttgaaatgtttttggtattcaaatcatattcaaaaaccaaatatttcaaaagttatttgaaaaacaatttagcccaaaaacccctatataccataaaaggtcacctcctagcacttaagtgagttttgttgcaaatcattataatttttaaatattatgggtggttagcaatatttatactcacacatttcaaaaattgctttaaaaaatcaaatttcttgttgaattttattgtgtggggttgccggcttgtgcaagggctgtgcacagccggcagggggcctggcggtctgaccggcgctatatgcgcggtctgactggccaggtgcggtggtctgaccggccacatagggccggtctgaccggctgaggtgggcctaggcagttttgcccctttttcttctccatcccgcacctaccctctcctatctcatccccattcatccccaactcgaaaaactctctctctctctctcccacctccccttaaaccctaactctttcctccaccaaatcccctcggtttgaccgtggatctct

SEQ ID NO: 59408 - DNA, 4116 bp, Oryza sativa
tgttgagtttttgatccatggcatggaaccctaggtgaagcacgaggtgttcttcgatttgcaccaatagagggtagtttcttggtgtgattcaactcctccaaccggtaaatcactcttcctcttgtgcattctctcaaatcgatctatttcaccctagggctatgggtagttgttccaatcttgatgaaataggtccaatcctttgatgttctagttccaatcttgtgcaatcttgatgtagcaaatatttttagagtcatttgtatgtgatggtaaaagggattttcttgtgcacttgtcagaggtggtctgatcgagctcggtcagcggtcgacggtctgaccgagctcggccgacggtctgaccgacatgtggacggcggtctgaccggccgttatccaccggtctgaccggccgctggacttcggtctgaccgcccctgacatgcagtgtgcagtttccttttcgcctaaacatagtgtcttctaaaagttattgctaatatcccatatcctttgctctttgacagcaaatgcctccccgcactcgtcatagtcgtcgtgagcccacgcccgatcccgtgagtgaggagtcaagcggagatgagtacgctcaaagtgatgaagaggttgaggccaatgttgagggggctagtgaggaggaaagtggagatgatgtcagtggaagtggagaggatgaggatgaaggaagtgatgatatgcacattgatccctccatccagtttgttgtgaacatgaggaatccatcgcagtataccattttgaggcaccatgatcagtttttgaggcctcgggacacccggaatccccgttttcacaccgctttccaaaagagtgtgtatgagcaagtttatgcagggaaagcttttgcagagcataagtggatttcttggagagacatcaatgagactccagagtttgagggcttgcaggatctcttcaagactgttggcattgacggattgtgactctcaaacaagactacaatgaagatttaatccgacagttctatgctacagtgtgggtggctggagactatagtgagatgaagtggatgtccgacacccttcagtgttctatctctaggaggcaattctggcggctcctcagtattcgcttggactttggagatgacttgcatgaggagcacactcacaatccgctctccatagactacgtctctcagttttacgaagacggagtgtggtacacacatgggaaggttgccggcttgaggaccatcccctgtgtggttaacaggattgtgagagttaccatcctccctcgccttggtaacaatgatgacattaggggggtggcttggcacgtcatcgatgccatcattcagggccatcaattcgacattgtgtctcttatgatgcaagagattgccatctctaaggctacattcactcagggaatctattatgccccttacatcatgaggttgattcaagacaagcttggggctgttgggcaaaatttaaagaagcacaagcagtacaagccccgccttcagcttggagctccccgtgctcctagggcggcaccctcctctcatcctggagctagctcaagctcagcacctcctcctcctcatgggtatgatccaaatgcttttttctatcctcagtatgcctactttggaatgcaaccaaacgaatactttaacccggtacttggggctattaataccctaagtgaaagcattcaacgcttgtccaccgggcatgaagctttgcatgagaatgttcgtggattgcgcacagatgttggagacttgaatgcttctgtggggagattgcacactagagtgggtacattggattctcgagtccaaatgttggagagctcccaagcatttgtgtatcatcgtcgtcgtgatgctcctcatccttccacttcggcgcgtcctcctcctctacaagagtgaagacctttttggtgcttgatgccaaaagggggagaaaagtgtgttttatgtcttgtgggttgggactagtggtagtgaggttagtcacctcatatttaataagttaaggaggtttgggctatattttgtatgggtatgggctattactctatattgtgtgttctttgtcgttttgttaaactctatgtcatttggacccctcgtggtcttgtaatagcctatgtttatttgtgagcccttttaggatgatttgtgacttatgtgttttggatggttaagtgatgtgaacttgtgcgatgatggatggtgtatgtgatattaatatatgtgaccatcttatgcctatggattgaagttcacattgatatattgctaatgtgttttgtgcttgttggaatgtgatattgaaatgtgcattggctccatatttattgtctatgattgatatgcacatgtttagggggagcttttgatttccattgcaatatatgtccatgtgttctatgtttgattatatatatatatatatatttgtggtgtttgacatcaattaccaaaaagggggagattgaagcatctaggcccccgttgttaattttagtaattaatgacaagcgctaattgtggactaaccattgctattgagataatattttaagattaggtccacgtcatgtgtgcgtatggatgactatcgatggattaaaattgacggcgcaaagcaaagagaaagaaaacggtaaaactagtgctgtaatttagaattgatcgaggtgtagggcgatcaaatttgctagtttatttgctagtttcgccgtactattaagaggggtaatgacctatcaaagagatgattaaattgccacattaagtcattgcattttcacttgtgctcactttttcatcacacacacaaaaactcacctttgctttcactgagctcggcctgaccaggggcggtcagaccggccacatagtggcggtctgaccggcgtgccctggccggtctgaccggcggcacatgctcggtcagaccggtcccctggacgccgggatggtgctactcagggtgaccgatacagagccgacggagccgtattcggtcagaccgagccgaggccggtctgaccgcccactcaacgccggtctgaccggccaggccgatggggccttctgacagcactacaacggcttgttttctagctattgcagagtagcacggtctgaccggccacatacctccggtcagaccggcagagcacaaagttgggggatttcgcccccaatggctagttttggtgggtgggaatataaatactcccccaccagcagcaaggggactctcttggcacccaattcaattgcatacaccccttgcacctctctcacacccccttgagctttgtgttcatccatctagtgtgttagaggtttgatctagccaagagtcaagtgtaattgcttccattgtagagccagtgtggcacttgattgatcatctccacgccgggtcattgcttgttactgttggaggttgccgcctcctagacggcttgtggaggagttgcccggtgacctctccgagaagattgtggaggaggcccggcgccggtttgtgagtggtttggagttcaccaccttcggagtgaaggaagaactaccctagtgatcgaggcttgggtagtcctctctgtgggcgggctcccgccttgcccatcccttgacgaagggggcgtgcggtggcttcgtggttgagcggtggagttgggctcgcctcaacggggagtaggaaaccggcgagtttccgaacctcggtgataaatctcttgtctccttgtctcatttgattgtcgcatttacatttgtgtaatttacatttctagagacaaacttgagatcatatcaccctaggattgctaaacattgacataggagtgtgatttactttcctagagatataattgagccactatcaccctatgtttgcaaaacataacttagttgcttagttagagttgaccctcaccaagcctagcaacttaggttagttttgattaggtgtcatttagtttttggcaaaattggttatatagcatcgaaagttcacgtttttggttttatagccccgaaagttaccggttcactttaatagcacccata

SEQ ID NO: 59409 - DNA, 6554 bp, Oryza sativa
  unsure (1)..(6554): unsure at all n locations
caaacatctctcccagtctttgctaaaatccaatgcacaagctctcaacatgtcctccagaacctggttggttctctctgtctagccatctgtttgtgggtgataagctgtgcttaacgcagggtaacttcctagggcttcatgtactttttcccagaaatgcgaggtaaactgtgtgcctcgatcagatataatcctcttaggtccaccatgaagacatactatcttggtcatgtataactcggctagcttggcactgctataatttgtcttagcggggatgaatctcgccgtcnnnnnnnnnnnnnnnnnnnnnnnntgttgcggtcttgggcaatccaacaataaaatccatacctatctcatcccatttccattcgggaatcctaagggattgtagcaaacctgccggtctttggtgctcagccttcaccttctggcacacgtcacagagtgctacgtactctgccacatctctcttcatgtagggccaccagtatccttccttcagatcctggtacatcttgttacttccggggtgcaatgaatatgccaattcgtgagcttcctttaggattaatcctctcagcccaccctgttcgggtacataaatcctctttttataccataggacatccttctcgtcggtagaaaattcctttgcaaatcctgcagctagacgttccttcacctctcggatttcctcgttgtccttctggacctcttctatttgggttctcaaaagaggttgaatgtccaaggtgtttatctgtccatgaggtactatatgtaggtttagttaggccatttcctccttaagctcaggagccattccttccgtcctcaaatgattgcaatggctcttccgactcaaagcgtcggccaccacgtttgccttgccggggtgatagtgaacctccaagtcataatccttgattaattccaaccatcgcctttgcctcaagttgagatctgactgggtgaaaatatacttcagactcttgtggtcagtgtagatatcgcaatgatttccaatcagataatgtctccaaatctttagcgcatgaaccacagctgcaagttctaggtcatgggtagggtagtttttctcatgtggtcgcaattgtcgcgatgcataggccacaacctttccgtcctgcgtcagtactcctcctagtccttgccttgatgcatcacaatatataacaaagtctttcctgatgtcagcaagaactaaaataggcgcagaggtcaacttttctttgagctgctcaaagctttcctgacactgttctgaccacacaaacttcttttccttcttgagtagttgtgtcattggtcgggctatcttagagaatccttgaatgaaccttcggtagtatccggccaaacctagaaaactccgaatctcagtcacagatttgggtgccttccattccgtaacggcctcaactttagcaggatccactgctactccaccggctgagattacgtggcctagaaaagcgacttcttttatccagaactcacatttactaaactttgcatataatttatgcttccgaagttcctcgagtaccaatcgcaagtgttccgcatgttcttcctcatctttggagtaaattaaaatatcatcgatgaatactaccacaaatttgtccaagtaatccatgaacactttgttcatgagattcataaagtatgccggggcattggttaaaccaaacgacattacggtgaacacatacaatccatatcttgttgagaacgcggttttgggtatatccctagtcctaattttcaattggtggtatcctgatcgaaggtcaatcttagagaacaccttaggtcctttgagttgatcaaaaagatcatcaatccgtggtagtggatacttgtttttgatagttacttcgttcagtgagcggtagtccacacacattttcatgctaccatctttcttcttgacgaatagcactggggctccccaaggtgacgaaccggggcgtacaaatcccttttcttgcaactctctgatttgctttttaagttcctccaactcattgactggcatccgataaggtctcttggatatgggagcagtactgggtatcagatcaataatgaactctatgtcacgatctggtggcatcctaggtaaatcttctggaaacacatcgggaaatcgttgcactacaggcattcctttcaggggtagcatggtaaatatgcctccggcacgttcggttagtctaggatcttgatccatagttgctctcatatccgatccccagggtgtggtcagggtaacttccctacgtctacagtcgattacccctctgttctttgttaaccaatccataatcaatatgacatctagggtctggggtatcaaaaccataaggttggagggaaacaccacatccctaagatgaataggtacgtctatgcaagcatgactcacaattatctcgcccccaggtgagtgtactatcataggttttctaagtcccactagggttaagttgtgcttttgactagccttcaaagatatgaatgaatgcgatgcaccagaatcgaagaggactttaaccgggacagaattgatagagaacatacccattagtacgccctgatcttcctgggcctcttcagctcgaacatggttcacttgtccgcgtccaaatccgatagtggtcctattagtttgcggagtcttgaatagacctcgtccggcagcaggggtagtagttccacgaacagtcattgcattagcaccagtacggacaggagttttgcgtggatgagggcagttgttggtgtagtgcccatactccccgcaattgaagcagtccacattcttcttggctccaggggcagccagagttggcgtaggggtgcggttctaaatcgcaaccagcctgttgaaattgctaggtgcggcggggcggttggtcgccacaatagggggtttccacccagacgaagtggctcccttgagtcgctgaagcaatccctgaggtgggcgattcatagcaagcctcctcttgcggttgtgctctacagtcctttgatcgttctccagcctaacgaccttgttgattaggctctggaaactctcatgatcttgcccaatcataggtccacgcaactcatcattcagcccttctatgaacttgtcgatcttttcttcttcatctgcgaggtctccaattgcatagcgggcaacctgagtgaatcggttcagatattcctgcaccgttgtgttcccttgtcgcagccttctaaactcgttcttcttcatacgcattaccgcagcaggcacgaagttctcgtggaatgctgcagtgaactcttcccaagtgggttctccagcatcctcttcccgagcttccttgtaagtatcccaccaatcaccagcgggtccctccagttggtttactacgaagatcactttgtcggcttcgcgtacccggacaagggtcagtttcttctctatgatacgtagccaatcttctgcctccataggctcgtctgccatagcgaacgtgggtggcttggtcctcataaactctccaaagctcgatcctccgcggttgctttggttgtttgcaatggcttgcagaagttgggtttgagtagccataactccggccagggtggttaggtcaggtgtctgagtttcttcattgatggttgacgcccgacgtcggctggccatctgtgtaggccgataaagtaagtatcctaattttctaactagctcttatggttttatcccattaagggaattgttttgatgtgaactttgttttgcaagcatggtggaataaactcatttataacacaatagcaataatatcataaataacatcacagaggtccacaaatagtacataaatcatgatgcaattgactgcacacatacgcagtccaaataaggttcgtccaaaagatacatcaactaaccatcaagctactcgtcaatctaggtaagaaaaagggggtgtgtgtgtctcgcatactatccaaaaaccatctgaagcgagatcgaagctgcaataatcctccagtctagtcatccaaccatccgcaggatcctggggcaggtagagggtagtcgctggcacgggcaaacctgagtccccacggctcggaaatagtggcctctggatctggcttgggcttcttgcccgagggtcgggtgctcttgcaggcagtgctaagggtgcgagggcctcggaggaacgtgatgcagggaacgggggtctcatcctatgaaggatcagtgatgtctggctcgatctctggcttggtatcggtcccctctatctcagagtcgacctagatcggagtctccaaactggaacccagctgcggagaaggtgtagagatcagtggagtgtgcacaatctccggcgcaggtggctgtgtcactgtcgggtccaccaagtaaggagctgactcaatagccagcataccaacctctcccaaaagagcgtggaatgctggtgggtacggcgaggtgaggaaaaagtagcggtcatgccctactgctgtggaagtagaagcccctgtggtgctgaccgtggctgctcaaagctgctcctccagctggctgacgtgctcctgactctctctcagctgctcctcaagtgtatccatcatcccgcggcgatcgttgtactgggcagataactgctggaactagtcgccgtggacctggagctgtgccttcagtgagtctatctcactgccccaagcctggtgctcctcttccagctgaagctgctgcgctgtgaggtcagtcacctcggtctctaactctcccacacgcctctgctggtcgtcgatctctaacaaagcctcctcgtaaaagtcgtctactgcctcagcccatcgtgacaatcgggtcactatcgggttgtagcagcaaggtgtgtcctgaactgtgcagaaggagttgctctcctctcgaaacgggtggtgagcaaactcagtactcgccaactcagctaggtggatagagctaagtcggaggaaggcctcccgtgctgcgtcctgcatcgcggtctccagtaagtcgcgacggtggcgtgtcgggaagctgtagtctaactccgaaggaactcgcgtgtgaacctcgacccgaacctcctaaacagatccacactgtctcactcggtagatcggaaatctggggtatcgcagacgcctcatcagccggtgtagctcaatgacgtatccctctaagcggggtacgcccatctcccaggtagcgggtgaatcctaatctgccatctaattttaagaaaaacccaaggtcagctgagagtaaatcttgtttagtgaagaaaatagttaagattaagatgaaaatcgtaccgagttttgtaaacatagtgtttttatttttgaaagtattattaaatgggaatttctcccttggccaacttagaaaaggggtggggcgcctttttggtcttttcctacagtcgtatggctctgataccagctttgtggacccccgtttttataacaggaatcaatcatgtaaatagtaccatttccctggaacaagtagtctggtacacacgaattcatagctgaaataccaagtgcacatacacgagtgtctagtacgaattattacatcataagcccgcaggcatagtcttaaatcatcggaccgagcggtccggaatacattccaaaaacagaagtaggtaaggcagcggagtcaaggcagcggcacgccattgccacaggcaacgaccgtaactaagacctactgagcgccatcgtcttcatcaccctcctggtagtaagcgtagggatcctccgaagcttcatctccgacctctgattaagtttgtatattgcaagggtgagtaccaaccgtactcagcaagccaccacagcaacaatgtatatgacaggggtatttaaaggatggctatggttcttttgcgcaaagcaagttttgtaattcttttcacaagcctaagacctagcacagactgatcaaattttagtagtagtgttcatattaaacaatgacggtattgtccactatccattgtgatcccaaggatagcttcccgccattgagtcgtcatggttttctgaggacgtccacattcccgcctctcaggaagtggctccatcaatatagaaatcatcatgcaatatcccatcccacacaagttaagaatttagagtctagccaagtgtaatacatgtcccggtgctcaataaccgcgagcacggctattcaaatagattaggtttactcacactgtagtggatgtacactttacccgcactccgcgactgcccaacacatgagcctcgtcccaacacatgagacgcgtcacggcaaagcttttcggtaacctcgcattggcagtacccgctccatgaactttacatcctcatgcactctaggcgtacatggtttctagcagtgagagcagttctggcgcacccgggaagggaagactcacacatgcattaagttataattatgtttaaattctctgggctgcaggaat

SEQ ID NO: 59410 - DNA, 63916 bp, Oryza sativa
tacccctcacaagtacaagtgtaatgcatgtcaaagaggggttgaaatgtcatatcatgtgtgtggctggatcattaacgatcaagacggacagaaaaattgacggaagtgctaaaaatgggaacagggtgaactttggatgctattaaagtgaaccggtaactttcggtgctataaaaccaaaaacgtgaactttcgatgctatataaccaattttttcttagtttttaaatcgcctattcaccctccctctagtcgacatctcgatcctacagtagcgcggggtgaccaacgtgcaagtcacggctggcggtgtgaagaccggcacaacgtgtggaggcggctggcaacggcagtaggctatcgcggcgcgtggaggcgagcccaatttagaggcgtggtcgacgacaaagctcgtagtggcatagccggcggtagcgggaggccattgtggtgcgtagagctgttggcggcattgacgcggagtacagccggcggggggcgttgatgcagcagtgtgcacgtgccgacagaggttggcaggtggtagagctttggagctttggctgtcgatcggtagggggcggacaacgggtgtaaacctagcttgggattggtcgggccggcaacgacggccactttgggcgtcgctttccctcctgagagtgttgttgagtcgtcctcttcctctggtggggctgccgggtcaaaaccctgtcttggttctccctaagatcttggcggatggcggcggtgctcatcgtcgccgttctcactggagtcgtcatattggaagcccccttgccaaatcttctctcaagcagttggtgcaggctcattcatcctcttgcggcggcacacaagcttttgcaagttggccacatcggcgggccttagtaggggagtggttccatcttctctcttaccctctacccctcaatcccaaaatcgtggatagaattgagttggtggctggttattagggcttatgtttcggcggtcttggttgtagattccttgttagtctagtggcgaccgctcacacttaacggcggctgtgtgtagacgttgtcagtgcgtggtggtggtggtggaattgtttttcattcctggctattgtttttcaggtcaatagtcttgtattttttttaatgaatcattgcgttgtctggtgctgatcgtaaaaaaaaactgggctttatattatttatatattctaggaactaggcaactagctacggttcaaatgccaaggttaaaccgttgttgatgtgaaaaacacacactggcctggaagatctgcttaacttcagtgcaggtccaaaatcttgcttctaggttcgtgagcgtgctagttgatttgatcctggaatcaacaagaaagaaagacaagaaaaccatggttaaatccataaacgacagccgatcggctagttgccgatgacatatcatttatcttcgagccgatgtcatattggaatcaatcggcagttgtgaataaataagatagaactaaatctactcgataggctatagatattaacgacatataattgttccttcgatgtatatttaaactaagtgattgggatagatcgatcgccatgtcgagacagtataaatcacttaagtcgaagtatacattaaagtactgattatatagacgtttatagcatagtcgatcaaatagatctagcatgtatcggctaatactctgataccactctatattaagatattaaaacaagcagaatatatcaaacaagaagtctaacattccgtagatacacgatataatctaaattaataatgaaacatgaccctataggtcactccctaacagtaagaaccagccgataacaacttatatagcgcaactaataaagattacaacgtatatatgataacttgacggattacataaacaagattagagtgtcataaagttggaagcactaatcccgagaacgcaagccgccatgacaagtttacctctagttgaagatcgaatcgatgcagctcaacccaaaagcaagaactcgtcgaaatagaatgaaagtaaaaaaggtggcgatgcgccgagagtgtattgaactgttgttgtttcttacattgggttcgggccatatttatacccgagatacaaaatatctcctcgccggatacgactcttatccctaacaaactctaagataccataagtctttgcggcagacttttgcccaaacatatctctaaggaaataatacaaaatatcctaattaatatatacaattgcctttccgcgagctttatctctattgtggcaatccttgtgaagcacgttgatcgactctagaaacagccttgaagccattaccgtcagaatcggctgcaccacctctatcggctgtatcggctgtcttctgtccgatccatctcagccgatgcagactccagccgatgccttcacagccgatgcatactctgttcttcgaatccatctcttttctgaatccgcttcgtttccaatgtcgaacttggttcatattttaccaaatttggtcgtgaacacatgccccccaagtccgctatatttgtaatgttgcggatttgctcaatttccctttccgagctgaactagggtttctaaaaccgattccgttttggccgttaccgtgctccccttttaaatagtaaccaccgctcttctcgtttcacggcgtcacttccgtttaaaccgctcttagccaaaactttccccaatcctccgcctcgagctctccggcgacaccttcaagatttccggcaatccaagggcgaccctccgcgacaccaatcctctccgtcggcaatgttgaactccgccagtccaccgagcgcatcatccgccgaatatgttgaggtaagtgcccatcggctaaactcccttcttattgcgcaagattggttcttttcccgctcaatcctcgatttttcttcttctgtagcatctcactcaccaagttgcgatccctagcataactgatgagttccagtttttccttggcccaatcggcaatctagaccccacaaagtttatcaatggagaaaccaaccgaattccttttagatttgccaatccagatctaagctcctggaaaaataccttcaaatcttggccatcggctgaaaagagttggcctgcctggtataagaggatgtcggctagcaaatcaactcactgggaagaaatcggcatatcccaagccttggccttaactgtagcagacatggcgagagatgaatctatgatagcagctgctacttacttctggtccacggccatgaacaccttcctcttctcccaaggagcgatgaccccaactctcttagatgtcatcatgatcactgacctagatgtcacctcatcggctaacctgcctagcttggatacccaactcacccatgagttcaaaaccaggagcataggtggttggttaggctatgttgtgaagaacatgggaaccgggccaatttctccaagggaacatgcagcctttccttatgatgtggcttgaaaaattcctgttctgcggtccaagctgtggtcctactgcaaactggcaacgtgtagctgagaatttggtagaaaagaagcatttccctcttggaaagtatctgctaggctacctatatcaaactctcaatgctgcaataaacaagatagtctctggaaaatcaattggcacagggggtccatggtggttacttcaaatctggttgaacctgcacaccaggatggttgccgatcgaccagcgctagccgatgcaaattttccaaggtttgagccgatcatcagagatgatggagaaaggagtactacacgccgatgtatgtccttcgaagaagcagcatcggtcagtaccgcatccaagttatcggctgagctcttcaaagaatggttcaacaacttttatgatgggttcgtgttgacagaaaacacgaggcctgggagatctgcttaactccagtgcaggtccaaaactcgccttcggatgtatgagcgtgccagttgatttgatcttgtaatcaacaagaaataaagacaaaagaaccgtagttaaacctataaatgatagccgatcggccaggtgccgatgacatatcatttatctttgagccgatgtcatttgtgcatcgatcggcaatcgtgaataaataaggaagaaaaactaaatctactcgatcggctgtagatgttaacgatatatactccttataccgatatatacttaaatcaagtgattgggatatatcggtcgccatgccgagacagtataaatcacatagaccgaaatatatattaataataggactatataagtttacagcataaccgatcagatagatctagcatgtatcggctaatactccgatactactctatatcaggacattaaaacaggtatagaatatcaagcaaaagcctaacacattcaaatacaccaatatcttggcataaagggcatatttaacatatcagtgaagcaaatagagataattatagttaaatcagatacgaccggctgaaactccgatgctattctaatcggcaactaggtggcaggctagagatcaatattctaagcacgacttaataggtcaaactcaattgatgcagcattaagtatgaaaagaagaacaatatctagataatcaagccgctagaagattcatagaatggtagatatcttatataatctggatcaacgtaaagatctaacctaatcggctgtcttctgcacacagatgttggccgatggtgtattagataacaatattgctgaagattatataagatatatgataacttgatgaattatacaataagattagagtgtcatgaagatgtaagcactaatcctaagagcacgatccgtcataacgaattttacctgttgttgaagatcgaaaccgatgcagctcaacccgaaagtaagaattcgtcgaaataaaagcaaaaggtggcgatgcgcctgaattgtattgaatgtgtcttctttcttttacatagggctcggggtctatttatacccgagaaatacaagatatgtccatattggacacgactcttatctctaacaaactctaaaatatcacaagtctttgcggcagacttttgcctaaacatatctctaaggaagttacataaaatatcctaattaatagatacaattgccttctcaggactctatccatgcgtggcaatcatcttgaagcacatcaactcgaacccaatgttgcacacgggtcgtattgtcggaaccggctatatcagcttatctagttcaactcaatctcagccgatcctagctgtagccgatcaggactccagccgattcctgctctgttccaaaactcgatctccgcctccaactcttcgttgatcaaatcccctttcctgatacacatggtaccaaatttgattgttaacacatgccccccaagtccgggtattcgataatgttccggatttgccgcaagccgactccgagaaggtttcgcactttaccgttttccgaccgttacctccttgctttaaatattaaccatcacccccgaaaaaacttcacaccgtgacttccgttttcaccgctcaaacaaactcaatcccccttcttctccggcgatttccccgacgcaaaggcgactcccaggctattcccctctcgacgagatccccacccgcggccatgtcttcttccgccagcccatcgggtgcatcatcggccgaatacgctgatggtaagttctcatcggctaaatccccttccttagcagcagatcgatcttctcttatctcatatcgctttccttatttcggttgctttgaatttatagcatctttctcaccaagtcgcaattcccagtctgacgtatgaaaatcactactttctcggcccaatcggcaatcctgatcccaccgagtttattgttggtgaaaccaatagaatcccctttagattaaccaacccagatctaggtcactggaagaatactttcaagtcttggccatctctggaaaaagttccaccagaaaagagctggaccacatggttcaaacgtgtatcagccagcaagagggctcactgggatgaaattggaatcggccaagcacttgaccttactatagcaaactcagccaaagatgaacccctgatggcagccacttcttacttctggtcaaaactactaatgcctttctgttcaatcaagggccgatgactccaatcctcatagatatcagtatgatcacaggtttggatgtcacctcatcggccaaccctatgagtttgaacacaaagaaccaatatgacttcaaaaccaaaagcatacgaggttggtcaggctatgtagcagcatacatgggccatggttcggtcacccctcgagaacatgtggcttttctattaatgtggctagaaaaatttcttttctgtggatcaagttgcggccccacaaccaactggcaatttctggctgaagctttagaaacaaagagacaattccccttgggcaaaattctcctcggctatctataccagatgtggctaagatagtagtcggttcagtagttggagcaggtggaccctggtggctgctacaaacctggttaaacctgatagtcatgaaggttgtcaatcggccatccgtatcagaagctgagttcccaagactagagccgattgtaggggatgatgaagaagagcgtactcatcggagatgcacatcatacggcaaatacgcttctacaccaactgatgccggagcaaaactatcggctgaactgctcaaggactggttttgtagcttctatgaaggctttcaaaaagatgctagagtctggttcctttatgaagactctgcacaacttgaacacccagtggacttcaaattcgaagacatcaatcatgaagtataccaatcatccagggaaatcttctcggctgcaatcagcccatgcatccttcctgttggcattcatcaaggaagaaacatccaaacttcttatgaattctatcatccaatgagctcagctagacaactcggaatgggccaactcccgatcagcttattctttgctgacaagatccaatgccgaggagggattttgtcaaccctgatgatggatcggctgcttagccttcaaggaccccctctgggcagtattgacaacatagaactggcaacattcaggagcaaaagcttcgacaggtggtggggtgaatggaaactgcatttattccaccaaccagcttcaatgtacatgacagacctctttcccgatattgtccctcaagtaagtcttcaactttgctcaattttagttaaataactgtttggccaattgatcttaactaatcatccttttgatttgcaaacaacagaatcttcctctcctcatcgcagcaacagtggcaaagacatccaatatgccccaagtttaattcctaacggaggtgggctatctcctccagttatcggttatgatgcccccaagacctcagctcttcttcaagggcttaccagagaaccagctgatgccggtaagaaaagaaaaaccagatcatcggctgtagacatcttagccccggctccaaacaagaagatcaaaaagaaagctaaaccagctgatgacctgcctgccctagatccatccattgaacaagctctggatgaagaggaaatcggagaagatgttgatcaagccgtagccgaggtaagtgatattgaaagaacaccatcggcttcacctaagcaggcccctccaactccttctgctctggttcacttctcaagggtaagtgcctctctttaatccctttcgcgattattttatcttatggccgatcattcccaagtcttataattgtagaaaaagaagactgcggtgaagaagaaatcggccgcaacaacatctaaaccagctccaccagtaagatagttttaactttcattagttaatttttagccgattctattaaacactcgctttcttttcagccttcacctcctccttctccttctgctcaacaatcgtcaagtgaccagaccccttcagctgcaggaagtcatcatgttgaaaaagaagaacaaccagccgctcctgctatcccagtaagtttcttctaacaaacattcagattggctacaattatttaacctctaatcgtttctaaattgtcaccacaggtcctagccgatcttttctcttttgacatcaaagactatctcgacgaaggagaagaagatgtcacaagcaaagcattggctcctttatctgatgatgtcaggaaaactctaagaagtatcttggatcggctagaagcatcatcgctagatagcttggtagtcgactgtggtccaatcagggctcggctgcatgaaatccaagctttaatcccagatgaattagctgatgtccttactccagctgtttaccttgagcagcaccaatacaagctagagaaagccaaattaagactggccgaacggtgagaacgtaaggacattgaggccactatccaagccaaccgtcaacttgtgcatgaagaaaaatccaagctcgatcaattatctgaaagtccaatcaaatctaacattgatcggcttgaagctcgcaagattgatctcttagcacaacttgaagaatgcaatgctgagctggatatggaacgcaagaagctagtcgatctcccccagtccattgaagagcagaaagctaggctcaaatcggctattaagcatgttgctgaactgaccaagtccttaaaagttattcctggaaccgatgcgcaagatgctcaagccatagaggaagtagagcagattaggcagcaagctatatcggctatccagcaatacttatcgtagtaatcttactgtaataggacattaggtagcaagctatatcggctatccagcaatacttatcgcagtaatcttactataataggacttagagcttctgcaatcggcttaacattctgatacttcatcccttaacatccttctgtgccgattaatatgactgtgagatttgctcaaaaaaaaattttgcactatatttactgcattgtaacagatatatgcccccctagttttacaatgtcaacagcagtgataaaactataaaacaactaagggtgatataacaatatcggccattgtcaatcggcaaacctcagccgattacattataaaacaactaagggcgatataacaatatcggccattgtcaatcggcaaacctcaaccgattatagcataaaacaactaagggcgatataacaatatcggctattgtcaatcggcaaacctcagccgattatagtataaaacaactaagggcgatataacaatatcggccatcacaaggcgatgtacgcacatcggcgacattagtagccgatcacgagttgatccatacactcgggtaatatttcttcaagtatttaccattaagagctcggccataaacttcaccatcaagcccttgcaacatatatgctcccttagaaacaaccttatgaatctggaacggtccttcccaattcggcgaccacttgccgaatttattatcacgagtaccaatcggcaaaatcaacttccacacaagttctctttccgaaaaaaccttaggcacaactttattattataatgtcgagcaacacgttccttatccttagtaaccttcgcaagggctcgcaattgggactgaaccaaatcctccctctcatcggccataagattgtaatactcatcggctgtcaaatcattttgcaactccgttcgtcgagagccgattctaacttcccatggcaacacagcctcatgtccataaacaagtttgtaaggagtaacttggatgatccatgacaagccatcctataagaccacaatgcttcggccaatcgcgtatgccattgccgaggataatcggaaatcttccgcttgatcaacttaatcaaactcttattagacgcctcggcttgcccattagcttgtgcataataaggtgaagaattcaacaacttgatacccatgctatcagcaaactaaacaaactcatcggacacgaatactgaaccttgatccgtagtaatagtttgaggaaggccaaatcgatagattatatgttcttgcacaaactgaatagcatcccccgaatcaactttcttcaaaggaatcgcttctacccatttggtaaaataatcggtcgccaccgatataaatttatgtcctcgacttgatgatgggtttatcatgtcgatcatatcaattccccaacctctaaacggccatggtttaattataggattcatagccgacgccggtgctcgctgaattgctccaaacttctgacaatcttgacaacccttataatatcggaaacaatcctccaacatcgtcggccaaaagtatcctgcacgtcgaagcaaccacttcatcttgtgagccgattgatgagtaccacaaatcccctcatgaacttcaccaattgcaactttagcttgatcgtcgctcaagcacttaagtaataccccatcaatcgtccgataatagagctcatcacccagcaacgtatacttcaatgccttatatcgcaattttctggaagccgattgagatggattgctcaaatacagcacatcatacctccagtcatcggctgacattgccgcaatttcaaccttaacatctttgaccatcggcttatactccgacgccccttgagccaaatcattagcttcaagattttgttctcgagatacatacttcaaagtaaccagccgaaattctttcattaattccaggcacttctcattataaaccaccaatgtatcactcttgcattcatattcgcctgtcaattggctgattactaacaaagaatctcccatgatttcaatggtatcggcttcaacttctttgagtaattgcaaccccttaagcactgcctcatattcagcttgattattagtctcatatgatttaatagtataagcaaactcaaaacatgcccccctaggggaaattataactaagccgatgccacaaccatgagtgcataccgatccgtcaaagaataaagtccatggtactatctcaaccgagccgactgaatcatcacgatgttccacaataaaatcggctatagcttgtcccttaatcgcctttggtgattcataccgaagatcaaactcagacaaagaaaatatccactttccaattcgtccctttaatattggagccgacagcatatatctgactacatcggctttgcatataacagtgcactcattagataatagataatgcctcaacctcgtacacgaaaaataaaggcacaagcataacttttccataggggaatatcgagtctcagcatataagagccgtcgactaagataaaacacaactcactccttcccttccaattcttgaatcagaactgagctgattgacttctcaccagctgataaatacaacctaaatggtactcctttgtaacatcccggcctagggcttaataggattaatagaatactcatattaacaagttgcaacttcttttccggaagccaatctccagagaactccagggttaagcgtgcttggcctggagcaatttgggatgggtgaccgaccgggaaattcttcccgggtgcacacgagtgaggacaaagtgtgcacataagacatgtgttggtctgtgagggcagtctatgacctatgaaagctatcggatgtaagtgggcccggcctggggaaaggcggaacgttacatcctttctgtgggggaatcaaaacagttcagagaactgagatattccttgatattatccaaaactttttgttgctctgccccccaagtgaattgttgatcggctttcaaccgcaataagggtgtaaaaggttccaaccttccagaaaaattagagataaacctcctaacaaaatttatcttgccgatcatttcttgtagctcggttttattttccgggggcttaattttttggattgcattaacgctcctttgggttacctcaatccctctttcatgaacgagaaatcccaagaactggccagccgatacaccaaaagcacattttgtcggattcatcttcaagccatacttcctggttctctcaaaaacttttcttagatcagctatgtgatcatcaacttctttggatttaacaaccacatcgtcaatataaacttcaaccaacgagccgatcaaatcgtgatatatatagttcatggccctttgatatgttgccccagcactctttaagccaaaagtcatgacaacccactcaaataagccgattgcaccaggacatctaaaagccgtcttatgtatatcttcctcagccataaagatctgattataacctgcgttcccatccatgaaactcaaaatcttattccctgatgcagcatcgacaaggtgatcggctactggcattggatattcgtccttcggtgtcgctttattcaaatcttgaaaatcaatacataccctgaccttgccattctttttaataaccggaactatgctagaaacccactctgcgtatcggcaaggatgaataaaaccagcatcatacaatcgcttaatctcagccttaacaggttcgagcatatcggctttacatctcctcggaagttgctgatgtggtctaacccttggttttataggtagccgatgttcgacgatcgatcggctgagtccaggcatttcataatactcccaagcgaggcaatctctaaactcttttaggagctctatcagcttggctctaaactctaaagacaaatgtttactaatgaatgtcggtcttggccgatcacctggacctatatctatctcttccaaatcatcggccgacataaaaccttgaccttgcttgtcatcgagatcatctattgtatccttagcgtagacatctgaaccctccacaacgccctcaaagtaatagcttgggttctccatcttcgattggttgtatatcagaatcggacacttttagaaaatctccatcccagacttttccagataaacaatcaaggccatccatctcccaaagggctaaatcagcattggcaacattaactgacctgtcggctagcacaaccttatcttgtcaccttgccactgaatcaagcactgatgcatagttgaaggtatgcaacaattagcatgaatccaatctcttccaagcaacaaactgtatgaccccttaccatcgatgacaaaaaacgtggtaggaatagttttactgccgactgtcagctccacatttaaaacacctttggtctccgatggattaccaccaaaatctttgagcaccatatttgtcttgataagatcctcgacattcctacccaacttcctaaaccctacccaacttcctaaacgtagcataaggcatcaaattcaccgcagccccaccgtcgaccatcattttagacatcggcttcccattaacgtagccgtttacatacaatggtttaagatgccgattctccgttccctcgggcttctcgaataccgcctactctggtgataggactaacttggccgattcctcctctacttcatcaacatcggcctgattgattccgaattcggctggcagcgtaaagaccatgttgattggtgctgtaacaacactctttccttttgccaacctcttcgcctcatcggctgcagcatcatcggctgtaggagcttgattcttaacacgtcacacctgccttggtcttggtttcctcagccgatgattaatgtcctcttcagaattatgccatttacaatatctcctcttgcctaattctttagccgatggaatcatatggccggtaggaagttgaatctgcttttctcggagtagcaaatcgaacatcttatcggctttggtgatatcgaagtcatacttttcctcctttccaggactcttcaaccattgacacggtataacctttttgctcctcacccattccgctgcagctatctcagaatcatcgtcttcatcgtccgatccatacatatacgggcaaacgtgattaaccttcctggagcttctcctgacgtcagccgacctatgctcacgcaaggttaccttttgtatcagatgcgacaaactatcgaagtctttggacaagaatttctccctgatcggaggaatcataccctggaaagctagatcggctaactgggcatcggtcaaactcaagctaaagcacttgttcctcatctctctgaacctctggatatactcgtgtaggggttcatcatacctctgcttgatcgccgttaagtcagacaacttcatctcgtggaccccactgtagaaatagctatggaattgcttctctaaatcggcccaactattgaccgacccatatggcaaagatgaaaaccaagtaaaagctgacccggataaggataatcggaacatcctaactctcaaggcgtccacagccgatgcttcaccacactgagcaaggtatcggctgatgtgctcataattaagttgacacaccctcttgccctgagaacttggagaaatcagggattttaaaccgattaggaaggggaaccctttcaaaccacttgggataagactgccgatacaaactcccagtctcttttggtctaagcccaaattgctccctcattacatcagcaatgacatcagcccatggtcgttgctgagctgctccttgtggttgctgctgcatgggctcgaactgaccaaactgaggagtgaactgttgctgggccgatcccgctggttgatattgggcttgcggggatggaagctgacaatgatagctcaagtttccccctggtagttatgtagattcggctgaatgttgcgcaccaagtgctcaggaaccatctgaggtaccacggtgccatccggttgtgcatgatgaaccaaatgctctgggataacttgattcacaaactgctgcgcaggttgccccccatgtactgcaaatctagccgatgcattggccggccccaggcgctaaatcggctgaacgacctgcagtcgtaccggagtctgctggatcagctgaggtcgttgccttggcggtgtttgctggattggttggagatgctgctgcgttgatggtgcttgctgaactggctgcacgacctgttactggatcggctgtaccactggctgaattggtggtgtctgctgagctggctgcgcgacctgttattggatcggctgtacaaccggctaaattgatgacatctgttggatcggctgctgctgcactagatcaacaattggtggtggtggaaaaaacatagcagcaacctgatcttgagtcggctgattcgaggtttgtccagcaagctgtggatgttccctcattagcaatcgagggttgatcggctgagctgacgccgtggccgatgtagcaggtaagggcgttgatgctggcgctgttggttgagtcgtggatgcgacagatggagccgcctgcacaactggctgagcatcggtgatcaaagttcgataattcagaaaaacgccttcttgcaagtacaccgggcctgtagcctgatgctcagctatcgagccatcggctatcgttttcatcatgttcgacagtgtattgactaagacctcggattgattgatcaaagcatgatgcaccgcgtaatcaacccgatcttgaaagttgttgaaaaaatcttgtgctagctcaatattctgattaagatttcctccttgcggcccttgagcagaatcacctggagctccgtgcacttcttgagggttatcgccttgatttcctatagaaccaccgatagcacccttgttgctcggctgatcgagccatctggggcttgtttcacttctccatccttagaagaaccggttccagggctatcagcaaccagttttaacttgtacttctgaaccagcattcccttgcgggtttgcatgaacgagctcagatactgatcccgtgcttgctgcatcattgcttcaaactcctgcttctagtcaggcgtgaatttcttgggatcgatcggcaggacattgtcatcaatgatgtcagttaatcccggcttcggtaatttgcctttaactgagcctgggcttgatggtagtggtgcttgtttctcggccatgaggaagaactgacgcctgacttctaatcaggtcccaccgggcgtgccaaaagcgtgttgacagaaaacacgaggcctaggagatctgcttaactccagtgtaggtccaaaactcgccttcggatgtatgagcgtgccagttgatttgatcctgtaatcaacaagaaataaagacaaaagaaccgtagttaaacctataaatgatagccgatcggccaggtgccgatgacatatcatttatctttgagccgatgtcatttgtgcatcgatcggcaatcgtgaataaataaggaagaaaaactaaatctactcgatcggctgtagatgttaacgatatatactccttataccgatatatacttaaatcaagtgattgggatatatcggtcgccatgccgagacagtataaatcacttagaccgaaatatatattaataataggactatataagtttacaacataaccgatcagatagatctagcatgtatcggctaatactccgatactacgctatatcaggacattaaaacagatatagaatatcaagcaaaagcctaacacattcaaatacaccaatatcttggcataaagggcagtgaagcaaatagagataattatagttaaatcagatacgaccggctgaaactccgatgctattctaatcggcaactaggtggcaggctagagatcaatattctaagcacgacttaataggtcaaactcaattgatgcagcattaagtatgaaaagaagaacaatatctagacaatcaagacactagaagattcatagaatggtagatatcttatataatctggatcaacgtaaagatctaacctaatcggctgtcttctgcacacagatgttggccgatggtgtattagataacaatattgctgaagattatataagatatatgataacttgatgaattatacaataagattagagtgtcatgaagatgtaagcactaatcctaagagcacgatccgtcataacgaattttacctgttgttgaaaatcgaaaccgatgcagctcaacccgaaagtaagaattcgtcgaaataaaagcaaaaggtggcgatgcgcctgaattgtattgaatgtgtcttctttcttttacatagggctcggggtctatttatacccgagaaatacaagatatgtccatattggacacgactcttatctctaacaaactctaaaatatcacaagtctttgcggcagacttttgcctaaacatatctctaaggaagttacataaaatatcctaattaatagatacaattaccttctcaggactctatccatgcgtggcaatcatcttgaagcacatcaactcgaacccaatgttgcacacgggtcgtattgtcggaaccggctatatcagcttatctagttcaactcaatctcagccgatcctagccgtagccgatcaggactccagccgattcctgctctgttccaaaactcgatctccgcctccaactcttccttgattaaatcccctttcctgatacacatgctaccaaatttggttgttaacagttccccaagaacactagaatctggtttgcatatgaaggacatagcactttcgagcttcctggtgatttttggtttgacgagatcaattccaaaaaatatgacaaatccaaagaggtattctcaacagccatcaacccttgcatcatccctgtcggcatccaccaaggcaagaacatccagatgacctacgagttttgtcatccgacaagcgccacaaggcaatttggcatgggtcaactgccaattagcttattcttcaccgacaagatccaaaacagaggggaaattacatcactactcatgatggatcggctactgaaccttccaggacctcctttgggcagcatcaataatataaagctaaggatgttgagaagtgcaactttcgaccgatggtggatagagtggaaaaaacatttattcgatcaatcggcttccatgtatctgacagatctctttcctaaagttgttccccaggtaaacatcctctaatttgtcaattcggttaactgcaatctgatgtatcaatattaactttgtgtaaattctctcttttgcagacaacagatttttctcctctacatcacagtaatagtggtgtggaaatccaatatgctctagggcttctgcccaatggtggtggattatcccctcctgtcatcggctataatgcccccaagacctctacattgctgcacggcatgcctcgtgtgccgattgctcctattgctgggaagaagagatccaaatcggctactgccccatcggctgcaaagaagaaacccaagaagcagaaagctactacctatgacctgccagccatagaccaagatgtagcaaattttttggaagattaagcaatggcagaagatatagacgaagcggctgaacaccttagcggtacaagggaacaaactccaccagccgatccacctggtcctcaaagaacgccatcacctccagtacattccacttactagtcgagggtatgcatctctttttcacttgttgttcttatatttaaagctgatttctaaccttgtactttgcagaagaagaaagtagccaccaagaaaccacaaggggcagctccaccggttaacttccttaatcttgtcaactttctttttccagtttttaaccgatgctaacttgtacttatgtttttagccccctcgacccccaactcatgtttctgaatcaagtgaaaacactccatcggctgtaggaagtcatcatataggagaagaagaagaagaagttatagcaccagctccagccatccctgtaagcttctatcttcaccttttcaaatcatattggctatcatatgactctaattaacaatatatagccgtattcttttccagatcttagccgacatgttttcctttgacatccggcagttcatggatgaagaagaagagaccacaagcacagctttggcacctctagccgatgatgtaaaaacaatcttgctagatatttcaaatcggctagaaggttcgttggagactctggtaaccagctgtgggtctattagagatagactccatgaaatagatgacaaaatcccagatgagctagccgatgccattactccaacggcataccttgagcaacatcggcttaagcttgaaaaagctcagaagaggattgctgatcgacgcgaaagaagagaccttgaagcaaccatccaagctaacagagcttccatcaataaagaaaaggctaagctggatgaactggaggctggtccgagtgcaactcaagcaaacattgatcggctgaataatcagaagatacagctcctagccgaactagagcaatgcaatgcacaacttgctcttgaacaagcaaagcttgccgatttgccaaaagccattgaagatcaaaaatccaagttaaagacttctatcaaacacttgactgagctgaccaaatctctgaagccgatctctagcaccgatgcaactgatgcccaaataatagatgaaatagatcaaattaggcaaagggcgatatcggccatccaaagatatgtatctggatgagctaagtcgtataaattcaactataaacttgcaaacttttgggctgtaatgaattccaagttaaacttttgcctttaaatttcgcttttgaaatccaattccaagttaaacttttgcctttaaatttcgctattgaaatccatgtttttctatatctttgcccccctaattttgcaatgttgaagacattgataaaattataacttggactaagggcgatatgttaaataccggccatcatacatcggcaaaacataaccgattataataaaaaaacaactaagggcgatatgacttatatcggccatcatacatcggcagaacacaaccgattatgataagaaaaaatagctaatggcgatataacatatatcggccatctgaaggcgatgttaaccacatcagctttgcatgtatcggtaaacctcagccgatcatgaattaatccacacacttggatagtatttcttcaagtacttgccattaagcgctcatccataaacttcaccatcaagtccttgcaacatataagctcctttggatacaaccttatggatttgaaatggtccttcccaattcggtgaccatttgccgaattaactgtcacgtgttccaatcggcagaatcaatttccaaactaattctccttctgaaaaggatttattcaccacttttttgttataatgacgagcaactcgttccttatccatagtaacttttgaaagggctctcaatctagactgaactaggtcttctatttcatcagccatgagattataatattcatcggctgttatctcatcttgtaaacctatccttcttgagccgatcttaatctcccctggtaaaactgcctcatgtccataaacaagcttataaggaggaacttgaatcgatacatggcaagccatccgataagaccataatgcttcagctaatcttgtatgccattgccgaggataatcagaaatctttctcttcatgaatttgatcaaactcttattatatgcctcggcttgcccattagcttgtgcataatacggagaggaattcaacaacttgatacccatgctatcggcaatctgaacaagttcatcggacacaaagattgatccttgatctgttgttatggtctgagggataccaaatcggtagatgatatgttccttgacaaattgtatagcatcccccgaatcaaccttcttcaaaggaatagcttctacccacttaagaaaataatcggtcgcaaccaatataaatttatgccccttacttgaaggaggattaatttgaccaatcatatccataccccatcctctgaatggccacggcttgatgataggattcatagccgacgctggtactctttgaattgctctaaacttctgacaatcctgacataccatgtaatatcggaagtaatcctctaacattgttggccaaaaataccccgcacgccgaagcaaccacttcatcttatgagccgattgatgagtaccacatataccttcatgcacctctcccatcacgactttagcttgattggcactcaaacatttaagcaacacgccatcaaccgttcgataatatagctcatcatccaacaaggtttacttcaaaaccttataacgcaatttccgagaagccgattgcgatggattttgtaaatattgatacacatcatacctccaatcatcggctgctattgaggcgacttctacctcaatatctttcaccatcggcttatatccagatgccccccgagccaaatcattagcttcaacgttttgctcccgagacacatgctttaaagttaccagccgaaatccatccatcaattctcggcacttctcgttgtagaccatcaacacatcattcttgcattcatattctcctgccaattgactgatcaccaacaaggaatcacccatgatttcaacagcatcggcttcaacctccctgagcaattgcaaccccttaagaactacttcatactcagcctgattgttagttgcgtaaggtttaatagtataagcaaactcaaaacttgcccccaaggggaaattataaccaagccgataccacaaccatgagtgcacaccgatctgtcaaaaaaaaaagtccaaagcacaatgtcgaacgagccaattgtatcaccatgatgctccacaataaaatcggctatagcctgccctttcactgccttaggtgactcatactgaagataaaattctgtcaaggcatatatccacttttcgattctcccttttaaaaccggagccgatagcatatatttgatcacatcgactttgtataccacagtgcattcattggataacaaataatgcctcaactttgtgcaagagaaatataaacacaaacataacttctccactggagaataccttgtctctgcatccaagagcctgcgactcaaatagaaaataactctttccttgccttcgagttcttggatcaaaaccgagtcgattgacttctcaccagctgacaaatacaatttgaaaggcactcccttctatggaggaatcaacactggaggagaactaagatattctttaatattatctcaagccttttgttgctctaccccccaagtgaattcttgatcggctttcaaccttagcaaagatgtaaaaggttccaatctcccagataggttagaaataaaccttctaataaaatttaccttgccgatcaacttctgcaattgtttcttgtcttctggaggtagaatctttttgattgcattaacactcctttgagttacttcaatccccctctcatgaacaagaaagcccaaaaactgccaagccgatacaccgaaatcacacttcgtgggattcatcttcaagccatatttccttgtcctctcgaaaaccttcctcaaatcggctacgtggtcatctacctcttttgatttaacaaccacatcatcaatgtaaacttcaaccaacaagccgatcaagtcatggaatatgtaattcatggctctctgatatgtagccccggcgctctttaagccgaaagtcatcacaacccactcatacaagctaattgcaccaggacacctgaaagcagtgttatgaatgtcttcttctaccataaaaatttgattgtaacctacattgccatccataaaactgataatcttattccctgaagcagcatcaaccaactgatcggcaatcggcattgggtactcatccttaggggtagctttgttcaaatcctgaaaatcgatgcacaccctaagcttgccgttcttcttgatgactgggactatgttggaaatccactcagcatatcggcaaggtctaataaaaccagcatcatataagcgagtaacctcagccttgatagcatcatacatatcggctttacatctccttggaggttgctggtatggtttatatcctggtttgataggaagccgatgttcaacaatcgatcggctgagtcctgtcatctcgtaatattcctaagaaaagcaatatctatactctttcaaaagctctatcaacttggttctaaactctgccaataaattcttgctgataaatgttagccttggcctatctcctgggcctatgtcaatctcctccaaatcatcagccgacatgaaaccctgtcctaacttgtcatcgagatcatccaccgtgtccttggtgtagaaatttgaaccctccacgacgccctcaaaataataatttagagtctccatcttcaattggttgtatatcacaatcggatacttttagaaaatctccatcccaaacttttcgagtcccactgggcgcgccaaaagcgtgttgatgtgaaaaacacacactggcctggaagatctgcttaacttcagtgcaggtccaaaatcttgcttttaggttcgtaagcgtgccagttgatttgatcctgcaatcaacaagaaagaaagacaagaaaaccgtggttaaatccataaacgacagctgatcggctagttgccgatgatatatcatttatcttcgagccgatgtcatattggaattgatcggcagttgtgaaaaaaataaaatagaactaaatctactcgatcggctgtagatattaacgacatataatcgttccttcgatgtatatttaaactaagtgattgggatagatcggtcaccatgccgagacagtataaatcacttaagtcgaagtatacattaaagtactgattatatagacgtttatagcatagccgatcaaatagatctagcatgtatcggctaaaactccgataccactctacattaagatattaaaacaagcagaatatatcaaacaagaagtctaacattccttaatgcaataagatcttaacataaagggtggatctggcatatcaatcaagcatataaaatataaagttgctaaatcaggtaagatcggctgaaaccctgatgctatctccctcgatgatcataaaacaagccagatatcataattatagatattacttaatagatcgaactcaaccgatgcagcattaagcataaagacaaatataagatctaggcaagatgatgaaaacttctaagagatggtagatacatgatataatctaacttaataacgaaacataaccctatgatataatctaacttaataacgaaacataaccctatcggtcactccctaacagtaagaaccagccaataacaagttatatagcacaactaataaagattacaacatatatatgataactcgacggattacataaacaagattagagtgtcataaagatggaagcactaatcccgagaacacaagccgccatgacaagtttacctctagtttaagaccgaatcgatgcagctcaacccgaaagcaagaactcgtcgaaatagaacaaaagtaaaaagggtggcgatgcgccgagagtgtattgaactgttgttgttttttacattgggttcgggtcatatttatacatgagatacaaaatatgtccttaccaaacacgactcttatctctaacaaactctaagataccataagtctttgcggcagacttttgcctaaacatatctctaaggaaatcatacaaaatatcctaattaatagatacaattgcctttccgcgagctttatctctattgttgcaatccttgtgaagcacgttgatcgactctagaaacaaccttgaagccattaccgtcagaatcggctgcaccacctctatcggctgtataggctgtcttctgtccgatccatctcagccgatgcatactctgttcttcgaatctatctctttgccgaatccgcttcgattccaatgtcaaacatggttcatatcttaccaaatgtggtcgttaacaaccattaaagctacatcctccattttcagttttcaattcagcatgatatttttttatgttattttcaaaatatcaccatattaattagtattcattcccctaagtttgttttttatatgtgcataagtgtaaatggatattgatgcatgctttcacgcacacaaccctttagaaccaacatacaatattttgatttgttctatagtaagtagtggaggtggtacatgcatcgagtgtattataagagtaaatatagtatggaagagttacttgtcattggatattatttatttctcaacatgaaaaactcctactttggaaaaagttagtaaatgttcagaaaatggaggaatgaggggaagggaagggcacggtggaaaccctaccacagaaacatgaaaaaggacatcactataggtgtcaaaaatgcaaaaatcgacatcccgtctgagccacacgcctgtgaggcgtcatccggtagaaccggcactttttagagagatagatgctggtttttaataggaaccggtacctatgatttttagagagatagatgctggtttttaataggaaccggtacctatgactcctaccagataaaggtgttggtttctattaaaaaccgatacctttatgtcccatcaaagtagttgtcagttgggctaggataaaaatgacggtttttcaaaagaaccgacactttcaggtgaggagaggagccgaaccaaccggctcgatcccgtttctcgcagtcgccgttcttattgttttctccgcctcctcattctctatcttgccactctcattctctatcccggcctctctccaaaccaccacctcacctcctcttcctcctcctccccttgcctctccgctcctccccctcgccgccaccgtcaccaacacagccgccaccgcacttgtaggagcaacgtgtcatctccggcggcggcaacaggggcgctaattctatgccgggggtgacggcggctatggcgtggggcgagcgtggagcctgattgacgacaacctggacgttgacgggggcttgtcctcgcctgaaccgacgacggggacgcgtccatgctaggggcaacaacggtgtgggtgagcaacccctcctctctgccccttcccaccggcgcttggggcggccaaatccgatgcctcccaacccagctccacgccctcttcggcccaacgcgacgtgcgaagcaacttctccacgatgatgagtgcaggttactccacgacgtgcggatggacttcattttttttctgatttgtttatcttgtacttttacctttgatgcatgcaaataatttgtgtcatggattttgattggagtgatggaattcttcaattgagccaaaatttctttgatttgtgatgcagatggatgtgggatggatggatggtgatatgtagatgtgggataggagctgctcgatgcatcggctagattcgagccgatgcattaagcctgattttttttcatattcatgtagtccaccttaaaggtggtctgtgaggtaccagttaggaaatccggcaactaagaagtttctttagtagtgaaataagacgccatgctgtggagcaaccggaggaaggtgcttgatacgtggaaaaccttcccattgttaggtcgggacacacattgtcgaaggaagcaacgccgggttgccaccggctgccagcgcagaggagcctcggagtcggataccatggaagagtaaaggactttgtgtggcctttttttttcagaaaagccctctatttgactgtatatgattttagactctttatttaataggaaaaagttcaaatatagtttagatggatgaaaactttaaaaccgaacatccaacccgtgaattttacaataccatctatgttactctttaaggtggttttgcatatctggtatcttaaacaaacggctttaaataagtattatagtatatttacgtatcattaatcctaggttgtcaatttatatatatatatatatatatatatatatatatattgcaatgtcatactattgttacgctggtatttttcttgtgagtgagagtgaacaagggtaaaaagatatatttaagtgaaaatttttcatatttgtccaatgagtatgtgatgtgatcaaatcttaggcaacttatatgcaaagaaaataaaaactactttgtaaaaccaccttaagggctgtacgaatggtattgtaaggtttaaagggttgaatgtccagttttaaactttaaggtgatagatggacttttgatcaaattttaggggattatttgaactttttcctattaaataaagttcatgagttcgttagaaaaaagggtaccagtgcaagtagttcagaaagctagagaggcctctctgcgttcagaacaacattgacagtaaggcaaagtaagagcatgcatatgttgctgaatactgcaggcaactaagattaaaccaccatagtattggtaacttgaaatgaaatgaaaaggagcttcagtgttgctgtttgtcatacacaaaaggttaacggattaattctcttttttttaaacacggtacaaaacacagacactcacaatacgcgcacactcatccctataagcacacactcactatacctatatgagtatctccagaagactggacagcactactacacaaacaatttttttataaggccccatgatttttgtaaatggaccataactagtcgcgtctggaaaaatcgagaggcattttcccatacggctccttaagtggcccgcatggaaaaatcgattttttcatgcaggcctcttaagaagtccgctgcatgtggatcacttaagagcccgtatggaaaaattgattacgggccatttaaggagccgtatgggaaaataaaatttgaaaaaaaaaataaaactagtttatcacactcatataaattccaaattggatgattctttttcctaaatgtttctaaaatcatgctctatcatattattgtgttcttactgcatgcagttattttggctatttttttcttgtgacttcattttatcaactaaaaatttgaatttcaaaacttcaaataatattttgaagaagtaaatgatttcagctgaaaaagtcatcaacaataaaattgtataacttaccaagatttataacttctattttggtcatttcttcatccgacaaagtgatagtaatattttcacaaaatttacatatctctcttatatgttataaaactaaataagagatatgtacattttgtgaacaatgttacaaaccactttatcggatgaagaaacgaccaaaataaaagttatagatcctgatgagttataccactttgttgttgatgattttttcagttgaaatcatttagtatttgaaaatattgtttgaagttgtcataatttgaaatttaaattcaaactgttgaaacaaagtcatatagaaaaatgaccaaaacaaaagttgtagatcttgtttcgttttacaactttgttgttgataattttttttcatttgaaatcatttactaccaaaaaattatttgaatttcttatattttaaaattcaaattttatatagttcaatcaaactcggatggtgaaattaccaaaagaaaaatggtagatctcaacgggttctacaactttgtttttgacaactttttcacatgagttcatttagtatgataaagttcattgagaatggcgaagtcatcatagacacatctctgtcgacaaaaacgttacttaccgctgagagaataattagccgtaaatatgagtatccgtgttaaatataagacttgaactcgggtgtgttggtactaccataagtaaactaaccgactaagggcatgtttagatcccaccccaaaattttacgccctgtcacattgaacgtttgaacacatgcattaagtattaaatatagactaaaaaataaaaataactaattatacagattgcgactaatttgcgagacgaatcttttaagcctaattgctccatgattagacaatatggtgctacagtaaacatttgctaatgatggattaattaggcttaataaatcgtctcgcggtttactgacggattctataattagttttttatttagtgcccgatcaatccatgcgacaccctatataatatccgatgtgacacgccaaaactttacaccccaagaactaaacaccccttaagctatactcacttcgtgaattaattctgtctgtatgaaaatagagtaaagattcaacacttccagaaggaaatatcctattatctagggacttgaggagtggcagacatgatggatcaaaccgactaccccatagatgtctccattggtcactatcacaagcaacagtgactttaaatagccagctaaaacatctagcagttgatattttcaaacagctaatatcaggttaaaagagaattatgtgggacttaaaaattccactaaaaatcaagatttttatgtggtttcttcacaagaaagtaattctaacgaaaggtaacctggctaaaagaaaataggggggagacaaacattgttctttctgctatgcacaacaaacaatccaacatcttttctttgagtgtcatgtcgctcagtttgtttggagacgtgtgttttttgtttttaatatccccccggcccaccccataacgccaaaaacatttttggtaattggcttagagaggtatctaggtccattaagaagatgattctaatttgagctagcgctgtatgttggtcaatttggcgttgtcacaatgataaagtttttaatggtaaacaattatctaaccctatacaggttatcttcatatcttcctactggctccacttctggtctacaatgctaccacaggaggagcaggatactatgcgcaatggtgctatactcttggaatcggtagccaagggtctcttatttcactatgggtggcgtagttccataagaattgctagctaaaatattttatgtgatttaacgctagttaataataaatgggagttggggatttgtcccatcaccttatttctcattttgatttacttttatcttacctttttattactattaaacttatggttgtgtgtcttataacagaagccgaagatggaatctatttccattatctaaaaagtttaaatagggttacaacagctaaattatttataagagtaaataggtaggtcctcttcaacctagccctcttcgaagatagtggcagctatacagctgtagcaggggaaataaaaccttgacaaaactataggccggattgaccaatatgacgccggattggtgtcgccagtcgccaccgatatggacacagatcgacgtgtataactggtcaaatcaagcactaagtacgtcctaattaagtatcaacaaaagctgcattaatcggccacagacctctagaaacccctagcttcgtgcgacaaactgtcgactcgaaccaccttcagccgagaaattccataccttccaccgacttttttgtgtgtggctagaagatgatgctttccaataccgattccaataccaagtacttttcttcacaatatatgaagcccataaaaccgaaatcgatccaaacaagtaacggattgagcacactagcacaaaaacgttagctcgtgaaatcttaacctatatgctcaaaccctgagctcacacttttaatgtttcgaataaaaagtttctcgattttaatgggatttttcctttccgattaataataagtttgtcaattaaaacaaaaggtttaatctgtgtattcgtgcacgatgattcacatgttagaaatgaatgttttcttttagattttttttagcttttaggttaaattagaaagtgttggtagcatcagataagcaaatctacatggaacacgggatatacaactattgaagggacattaatttcgttcttgccattgcactatctttattttttttttcctttgcgatggacacggaaacaaaatgcaccgtttgtattgctcttgtagctgccatttgttaggtcattgaaattgactcggtgacataacaaattaaaatcgtgattttagcactactatgaatatgcatctctggcggccaaatcaaaatttctcttgccgttggctgctatgactgctagtctgctacttcctccgttttgaaatgtttgacaccgttgattttttagcacatgtttaaccatttgtcttatttaaaaatttttgtgaaatatgtaaaattatatgcctacataaaaatatatttaacaatgaatcaaatgatagaaaaagaattaataattacttaaattttttaaataagacgaacggtcaaacatgtgttaaaaaatcaacggcgtcaaacatttcgaaacggatggagtactaattaatggccaaagagaatacagtatttttcattggcggtagtcaactacacatgtgggatagaattttcacaatcaggcgactattgccagcagcttgtgaaaatgatcttcgcagccggacagtgacgaaaagaggccacgcgatttgacctgtgatattttcacatgaggctaatatatattacatcaatgtacgtccgtttgtgatgatttcacgttaaatttgatttaaatttgttgacaattttaattattttcttggttcacgtactatgaattttgaatatatagaaatataccatcaatcttcaccggcatacttaataccactgaaagatatatattagagcggtataaaacaaaagagagcaatccggtatataactattcatttgatcataccagagaatatacaggagttatttttcatgaacaacacataaaaaaatcatgtctgatggccattccatattaattgtcctgtactctacaagatatttatcccgttagttgctgccactagcaaactctcgtcctatatgctgcaactttccttagttcttgatcagaattccaagaatctcttatcttatcgtatatacctacataattatgtaattgggaaaaaaacccgtaccatattggaaaataaccagtggttcacttctagctaggcttaatcacaaccatcaaggtatatcgtgtgtgctagccattttgtatcaattatacctttaattttcattcatcattccattatctcacctttaacacaataatgcttttttttgaagtgctattacgtggtatcaaagtagtatttctatataattagaaaataaaaacttaatatgcattgggcaaagaagaccagttggatcacgtccgtgtgtttattatttacaaccatcagtatgttctgggctaaccattatgtattaattatatagcttaacatgctttgattatttaatcacctcacctttgatttaatgctgcttgaatcaagtgttattggaatgatttataaaatctcactagcaacgtgaattctatagttacaacctaacatgtataaacaggatatatccctatccactagcaattattataacttaaaacttgttgtgtcatctataatttgttaactttttagctcaacgtggaagcaaattgaatcatcatttctatatcattatcataatatttcaatatatattgattgatcatttctataatatttatcacatatttatctatgtatttcacagcaaagagtagaatataatctactatacttgtataatttcccccaatagaaacccaatttaaaacatattatactgacttgattattataagataaattaaatatttttaagaaataaacgtaataaatggttgtgttcttttccatgagttcccaactcatctctttcgtttttcgcgtgcacgttttttaaactattaaacggtgcgtgttttgcaaaaagtttatataggaaagttgctttaaaaatcatattaatatattttttaagttttttatagctaatacttaattaatgatcacgtgttaatctattgctccgtttttgtgcgaaggggaggggttccaacccctccaaaagaacacaccagtgttctaaagaataaagaatacagtgaaagatttttctttttacaaaacatattttgagcttggagccacggactgaaaagaacttctagtcctagcactcccattaattgtgaaggataaaggccctgtttagtttccacacaaaagttttacaccctatcacatcgaacgtttgaacacatgcatgaagtattaaatataggctaaaaataactaattgcacagattgtaactaatttgcgagatgaatttctaaggctaattgctccatgatttgacaatgtggtgctacagtaaacagttgctaatgatgaattaattaggcttaataaacttgtcacggtttactgacggattctataattagtttttttttattagtatcggaatatcccatgcaacaccctatataatatttgatgtgacacgtcaaaacttcttaatgtaaacacccccaaagttatgagttctctgaaacaaatcaagttacctacgcttccacggaaacacacaaacatgtgagggcacaccgtgtactgtactcggtgttacaaggatttataagggtatgtatggtgcattcgtgctgctgaacaaaaacccatccaacgcgaactaacgcgtgcacgattaatcctagaaaaaagggaaaaataagcattaattccactatctcctacttaaaattttgttttattttacaatttagatcaaattttctgttatgccataatttgctatgatatattttttctcgtcgtgatacaagttttttttccacatagcatagactcggatgaaactagagctaccccgatcaaacggtagatggccactaggttttttatgtgttttatttatggatgagtgagagattgaatgacactgaatgaatattattgtcgaatgattggatctagctaaaccggttgagctacatgttgtattccagatcgccagacacgcatgcaattagaattaaaaaaactaattaaagatggatgaatgtgtcctgtacacggtgttataaggatttaattataagggtcaggcgtgcacatgcagcacccggtatcgtcctgttgaaccggaaactcatccaccgtggactgacgtgtgcacgattaatcccaaaagaaagggcaaaataatcattaattgcactatcttctacttaaaattatttttttatttctataatttatatcaaattttttgttatgctataattatatgttatgatatatttttctcgttgtgatacaagcttattttccctaagcatagactcagatgaagttagagctatggaagattgccgctggggtttttatttgttttattcgtggatgagtgagagattgaataaccactaaatgaatattctcgaatgagtggatctagctaaacccagttgagctgcaccagagcgccagaaagcaagacacgcatgcatgtaattagaattaaagaaaactaattaaagatggatggaccgaagtagatgaagttgggcaggagggcaatatcgatctctctcatcaatagtcccttataaaattagcatgcagctcgctataaaagggatggccaaacccaaatactgagcatccttgaagccagccagctcgctcgctctagactctacctttttcgctttttgctagagatctagccactttctttgatcgacatatatatccatcgagataaaaggagatagtgacaagtaattaacttagttttttccaataacgaaataaaatagtttctacgtcttttccacctctgccagcagaggcgcagccaagtaacttttaattatagttataaattaatacacagagaatgggtagccaagaatacattaagcagggcgggcagcagctggtggcggcgatcctgggcatcggcacggctgttccaccctacgttctgccccaatcctccttccccgactactactttgacatttccaactccaatcacctccttgacctcaaggccaagtttgcagatatctgtaagcgtacttgtttgtcgttaaatactactactgctacttaatttctcgttttaaatatatattacattattgacatgttgttatatcaccatttattttatttaaagatttaaaatcattctaaagctggttatactccgtaacaccagctaaataatgcttacacttttattcaagtaagataaacagttcactgatcatgcctagtgcctcaattatcatttttagcatgtgttagggacgcgcacgtatgtgtgtacgtgtattgtggtatgagtgtggtgtgtgtatgtgtgttaccctcttaagataaagtaaaatattatgtcaaaagttaagggcatcatatatttaaaaatagagatagtactgcttagttattacatatttactatcctctccgttctactgtatgatgtgttgaattttttcataatgtttaaccattcatcttagtaaaagaatatgaatatcatttgttgtaacttgttttatcattaaaaactataatcttaacttatgcttttatagagaaagtgtattcatccatcgaggggatatcccctagtttcatgcatgtcgtttaaatagttataaaaaattaaaataaattgacaaaatagattaatatgaaatatatcactccacaagcatacaagttaaaattcaacttatataaattatatcagaaataataaatatttttagtttaattttttttcgttgcatcttggaaaagtcaaatttagccttgcatgttcgtggagtgatatttttcatattaatttatgttgttaagtttacatatatatatatatatatatatatatatatatatatatatatatatatataactatttagatgatatgtaagcaattaggggatattctcttgagggatgaaaatccaaatccgcttttatatatatgtttgtaccaggggcgaagccaggattggggattaggggggagtggggtgaagataaaccatgagaccgaataactaatattaatagcaaaggaggtcaaatagtcaccgtcaataacaatcaatgcgtaaagtagtcctttaaaaaaacatgaattttagctctttaatgatatcattgaaagtttgaaactagtctttattgctaaattcttttaatgtaaactattgaataatctcacaaataagtaccatctattttactttgaaaaagatgagaattcacaaactaattttgtagatcatgtttcttgctaatatttttagacttgctaactaactaaactgataatactttcaagctatacaaaaacaaactagataaatatacttatcttagctaaccttaatataaagtaaaaatatgaggggtgtagtggtggtggtatttggatagggcctttggcaacccccttaattagctgcgctacttgtttgtactaaacttttaataaagtaaatgatcaaatattatgtgaaaaataaactgccatatagtttaagacaaggataatacgaggaactcttgcgccatacatacatacatacatacatacacacatacatacatacatatatatatatatatatatatacatacatatatatatatatatatatatgtatatatattttccaataaatgatgagctacaaaaggattcgttttttttcgtgtcacagctgattactcctttttttccattttaaagagtggcattcgatgtccaatatctcgatcgaagtatggaggtcagaataaatagaataatgatatctttcttcggagcagtttcttttcccgtcctcctcaaaaaagggcgtggaaacagatagaaactcttgaatggaaattgaaaagaaatgtagccccagttccttcggaaatggtaagatctttggtgttgatttggcattattcaacaagaaaaaaatcttatatatatatatgacactatataggacactcatatggggcaccatggtattaaatgcacaaaatcactcaaatttttcaaaattttcaaattgtgagtatatacctagttataataattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtggttaatgttaatacctaagtaattgaaaaagattcatactcatttaaattgggtatatactcaatttcaaaaatggtgcccgggcaccatggagcaccaaacaaatttactatatatatgtatatatatatgtatatatatgtatatatatatatgtatatatatgtatatatatatatatgtatatatatgtatatgtatgtatacgtatatgtatatacatacgtatatgtatatatacgtatatgtatatatatacatatacatgtatatatatacgtatatgtatgtatatatatacatatacgtatatatatacatatacatatatatacgtatatatatacgtatacatatatacgtatacgtatatatatatacgtatacgtatatatatatatatatatatatatatatatatatatatacacacacgcacacataatagaaggattttgcaggtgagaagacaatgatcgacaagcgtcacgtgcacatgtcggacgagttcctgaggagcaacccttccgtggcggcgtacaactccccctctatcaacgtccgccagaatctcaccgatgtcactgtgccccagctgggcgctgccgccgcccggctcgccatcgccgactggggccggccggcgtgcgagatcacccacctggtgatgtgcaccaccgtcagcggatgcatgcccggcgccgacttcgaggtggtgaagctgctcggtctcccgctcaccaccaagcgctgcatgatgtaccacatcggctgccatggcggcggcaccgcgctgcgcctcgccaaggacctcgccgagaacaatccaggcggccgtgtgctggtggtctgctccgaggtcgtctccatggtgttccgcgggccttgtgaatcgcacatgggcaacctggtagggcaggcgctgttcggggatgccgccggtgcggtggtggtcggcgcggatccggtggaggctaacagtgagcgcacgctgttcgagatggtgtcggcgtggcaggacatcatcccggagacggaggagatggtggtggcgaagctgcgggaggaggggctggtgtacaacctgcaccgcgacgtggcggcgcgcgtggcggccagcatggagtcgctggtgaagaaggcgatggtggagaaggactggaacgaggaggtgttctggctggtgcatcccggcgggagggacatcctggaccgggtggttctcacgctcggcctccgcgacgacaaggtggccgtgtgccgcgaggtgatgaggcagcacggcaacacgctgagctcctgcgtcatcatggccatggaggagatgcggcggaggtcggcggagcgggggctgagcacggccggcgagggcctcgagtgggggctgctcttcggcttcgggccaggcctcaccgtggagaccatcctcctacgcgcgccaccatgcaaccaagcccaagccgtctgatgtgattctctcatccatccatcctccttccgttcgtccgtccctccaatatttggaaaatatatttttctcctaaactatttatccgatcacaccgttatattcgttataattaaacttttacaacaaaatatcatatgattatattccaataaaataaaaatatttgtttcaaaccattaaaacacaatgtttcatgtttcatatgtaatagttatatctttcaatgtgtatcatcattgtgttcctcaaaattcacagaactacatgccactactctctcctctctcttcactctaatcttcaaaatgatttttctcttaaaaaacttattcaatctataatctgatcacaccgttatattcgatgattaaatcttacaataattaagatatcgcatgactatatttgatgaaagaatagcaaatgtttcaatccgctaacacttgtgtttcatacgtgatcaatgtgtatcttcaccgtgtttcataaaaaaatttaaatgtttcagttttttttaccgtatataacttaatgtttcatttgttggtcaactgcaacatttgacattccaatttattttagagggattgggcgatcgatacgtagcttcctccaagtatttgctccaatatgtgtataactcacagcacatgcctacgtgtgtacaatacatgccaaaagtatatatatatatatatatatatatatatatacactagcaaaaatgcccatgcgttgcaacgggtaaaaaaattctaataataatatacgtttttcacgcataatcatgtcaatgacaatatttctattttaatgagcggcttgttttttataaacagtgttttttttcgcgatttctcaaaccatttttcagaaatggcgcatttctttctaacagtttttactaccatgtttttttatgctttttttacttacgaagaaaaccatatttttctccctttttttgctttccttttctcgtgtgtttttttcttgttttctcacatgtttttttgcttgttttttttcgaaggttattttttgcttttttctaatacatgagaatatatgacgaaataaagccatgtagtagatggcaaaaaatcgatggatcctatccgactcaagcgtccatcaatttagcttttttctgacagttttttcagagcgattttttttaacagacggtgtttttttcttgcatggttttttaaaaccatttttttagaaatggcgtgttttttcgacagttttttccacgcatgttttttaaaaatattttaccgacaatggaaataatttttctcgcgcgtctttttatttttttattgacgatggaaaacctttttagcgtgttttttgagttttttttctaacttttgcctcacacgttattttaaccgtttttattttctcatgcattttctcttttttgaaatagttagattagagatagagaagagatatatactggttagaaatcagattttgtttcgccctttccattttttttctctcttgcaacttttattttatacgaaccagctttttattttttacgaaccattttttcgccattttcttagggaatcgaacgaacttttttagataggaatcagacttttttttccgtttttaaaagattcggatctagcgttttttttgtcaccactttttttttgccttttatatgaatcagattttttttccgtcggatctacagtttgtttttttgccactcaggggaaaaaacttttgttgttgttgtttttctttattttgttttttgtgcagcttttatttttatttttatgcacctttctgcctttgttctctttctctttttttattttttttaacaaaaactacctcaagtcctcgagtagcttgttgcaagattatagggactcaaatgtaaatataaaaattacggggactcaaatataaaagtaaaaatccaaaaataaaaatcatattaaaatggaatgctctcgacatgtagattccgtttttgcaaacagatcttcaatctggcacatcaatttttttcaccaatctgagtaagactttctttttggcttttctttttctttttatgcatctttctgcctttattctctttctcttttattattttttttaacaaaaacgacctcaaattgcttgttgcaagattatagggactcaaatgtaaatataaaaattacaaggactcaaatataaaagtacaaatccaaaaattaaaattatataaaaatagaatgctctcgacatgtcgattctgttttttcaaacagatttttaattcgacacatcaatttttttcatcaatctgagtcagacttttttttttttgtaacagcgaatctgataaaggagtcggactttttttttcactattacggatataggagtcggactttttaattttttttgttattttttttacggacgaaggaatcatcttttaagtagtacataatttttggttttttttgccccttttttttggatcggacttctttttttcgtccggtttttttatcggacaaacctggtttttttttcatccggttcaaacctggttttttttccatccggttcttttggtttttcacccctttttttttctggatcggacttctttttttcgtccggtttttttatggataactttggtttttttttcgcccctttttttctggatcggacttcttttttttgcactttttttcgcccggttttttatctgacaaacctggtttttttccgtccggttttttttcccaccccttttttggatcggacttcttttttcgtccggttttttctgcccggttttttttcacccggtttttttacagacgatggaagcacttcttatttattgtttatttattttttaagtagtagagatgtatactaatattgaacgtacatgcacgcatataataagagcatctcataaaaaacaaaatgcataagactacggaggaggggatcgagtatctgtcatgtgatgtgattgaaactatgtattttctttcagaatataaaaagctttagagtttgacacgattttaagaaaatagataaaattaaatagggagaggtcatgattggttgagaaggggaagtaggtgaaaaatatgaatggtggagaattaggattggttggggagggaatgttggtggataagttgttatatttggggataaatcttaaatattaaaagttgttatattttggggtggagggagtatttggttgaaacctatataagcaggatcgatcgatctctgcaaaatttgatataggaaaaaattaaacaaacccacttcatccagccaaaccctcttgccttgcattggaagctttttccttttttttaatctaaaccacttatgcgcaatactgttcaatttctagggtacattatattttgtattatagaagaaaaaggccattaatttcaagccgtttggatagcattggacgtgttggtcatacatgcatgtcaaacacatagaagagcccaaacagagagagagaggggggtggtttgatcgaatcatttactttatttctttctgccatttaatctttctaatttttttatttttaggagtattttatagacatacgtgatatatatatcaatgtatagttagtgtacttgcttcaatgtacatgatattaggcgtggagaaaaaaaatccgaagaccgagaaccgaaccgaagaggcggtttgtccggtcatcggttgattgttattttcctgtagttcggtgtttggctttttcttcagtgaaccgacgagaccgaagaatccgatgagtgttcagccaatccaaaatgctcgaggcccactaacaaacgtgcgcatcaagcccaacttttactgtggcccaaaaaatacatgacagctaacagatccaacaaattctattccctctctccaaatcaagcacaggccctcgggcagagctgggtaggccgtgtgtacttgcgggaagtcgaccgcagtgtacggcataggttttctcggtaaaaactgaacaccgaaaaaaaccaaaccgatattttttggtttattttgctcggttgatattttttctagaacttcctttggtttgcattttacaaaaactgaatgccgacacaaacaaaaattgactgagctttctgcacgccggactgggacatattatttggatctgcttacatggctgctttatcctcatcaagtttggatcatgctcctcttttcttggtgggctgtgaacagagggaactaaatacctcttttcgttttgaagcttactggcttaaattccctgagtttttggaagtagcctctgaatcttggaatagaccaattagaggatcaaatccctttgcaaagctcaacttgaaactaaaaagactagcaagagatctgaagagatggagcaaatctcggattggacatcagattgcagtatgcaatcgcaaatgaggttattttccaacttgacgtggcccaagaagagagagctcttacagacgaagagcttctgctgaaatctactctaaaatctagagttttaggccttgcaacactagtgaagataagaataagacaaagagccagactaacttggttaaaatgtggtgatgttaattcaaaattcttccatttgaaagcaaactcaagaaaaaggaaaaacttcattccagctctaaacactccctcgggtatagctgtaaccacagaacaaaaggaggctgaacttgagagatatttctcccagagattagggcagtatgtcccatgctccttaactcttaattggtcagaattaagtctcccttcccttgatctgtcggaactggaggaagatttcacagaagaagaattaaaagaagcaatatcaaaccttcccccaaaaaaacacctggccctgatggctatatagggcttttttcaagaaagcttgggtggtgattaaatcagatttgctacaggccattaaccatttcagctctctgaactcagatagattggaagacctaaatttagcaaacatttgtctaattccgaaaaagggtgaagcaacaagggtggaggacttcagactcataagcttaatgcacagcttcgccaagatattagcaaaaatgttggccaatagattggcgcctaagcttcatgaactcgtctcaccaaaccaaagcgcgttcattcggaaaagagcaatacatgacaacttcttgtatgtgcagaacatgatcaaaaacttcaacagaaagaaaaaaccgatgctttttataaaggttgatatttccaaagcctttgacatcgtaaactggccgtatttgctggaggttctgcaaaattttgggtttggacagagatggagaaattggatttcaaatattttaggaaattcaagctcgagaattatcctcaatggaatccctggtaaagcaatttggcacatgcgaggtctaagacaaggggatccactctcaccgatgcttttcatactcgcaatggaaccgctacatcagattttcaaagcagctgaagaagcttctcccttggcaaagatagacccaaagcgtagtagattccgatgttctctctacgcggatgatgtggctttattcatcactccatctgagaacgatctgatagcggttaaacgcattcttgagacttttgcacagatcagtgggctacatacaaacccgggcaaaactgagatttaccctattgcttgcaacaacttagacctcgacaatctcctttcctctttcatgggaaacctgaagactgtcccttgcaactatcttggccttcctctgcatacaaagaaactgagaaaaattgatttgcaacctctcttagacaaggttggagcaaggataccaggatggaagggacgctttttcacgtcagcagggagagaggtcttagtaaaatcaactctttcagcaacaccaatttatcattttactgtgctgccacagatgaaatgggtgtttaaaagaattgatcgttacaggagagcttttctttggaaaggtgacgacccggagaaggttagtgcaggcagcagccttgtcaactagcaacaagtttgcaaacctaaagacttgggcggtcttggcattctaaatttggaaaagtttgctagggccctgaggttacgttggctctagttcaattggaaggaggaccaaaagccatgggcaaatatggatcttccatgcgatgagatggataggtgccttttcaaagctggaacgaagataactgttggaaatggaatcaaaacatctttctggaatgataactggatggatggacaatcgccaaaggatatagcaccagcaatctatcgattagcaaaaagaaagtcaaacagtttaaagaaggaattagaggataatcactggcttgaaatgctccacccgatcacttctttagtggaaattgaagaattaatccaactaggaggtttgttacaacacattaatctagttgctggacaaactgatgacatttcctggagatggacagcgaatggacaatattcagcaaaaagtgcataccttgcacagttccaaggatccaatgctttaactgaatttacacctttgtggagcgcgtttgcggaaccaaaacatcgtttctttggatggcttatccttcatcaacgaactcttactgctgaaaatttgcttcgacgtcactggccatgtgattggatacgtagtttgtgcaatagtgcctttgaagatgcagcccaccttgcaaaagaatgccctttcacagtgaccgtgtggacgcagatttgtatttggatgaattttcagctgcctcaacatcatttgcaaggaaatctatcggactggtggagcagtttctgcactatttcgccaagacaaaacaggaacaaggttctgagagctctcatcacaacatggtggaacgtttggctagagcgaaacagaagaatttttcaacagatttcaaagaatgaactccaagtcgcctttctggtgaaggaaaatatcgacctaattgagcaatctaggatctgaccccgtcatgatcccctttttcaagatgtttctcaatacttcatgttgtagctgatgctccttccctccccacccctgtgttcacaggattcttgtttgtactttaactaaatttttattccttctaatatatccggcaaatctccagccatcttaagtttcaaaaaaagaatgccaggcaacccaaaaaaccgatccgattaaaccaagcaaacccacccctacgtgatactatcatatacccctgataatttcacaaaactatttgtgcagttgtgctccttagcgtgggagatgctgtgattagcggtagcggccggcaaggcccaaacaacattgtctcccttgagtagcctggcagcaatcgaatatagtataagtatatgctctctccgtttcacaatgtaaatcattctaacattttccacatttatattgatgttaatgaatttagacatatgaatgtgggaaatactagaataacttatattgtgagacagagaaagtagtatacatgaacccactacagaatcatgaacattaaatccaattgcgatcaacatcttgacaaattgttcaccacacaaaagtaaatcaacacaatgatttcacacagtaatagacccgatatatggagaaaagtacctaactttgttttcctgtcatcagatggaatggatcactactagaaaaaaagatttttccaggcggcccaaaaccattttcacaggaggggaagaggatcgccgctaccatctcgactgtgaaattaaaccattttcgcaagcgcgcccgtggcccgccagcgaaaatcatcccaggaaaataaaaaaaaccacggggcaccgccggccagggctcccctccacccgtcgtcgtcggcgccgtcgtcgtcgtcatcgtcaccgtcatcgtcgttgtcggcgcggcggcggagggggcgaggagatgaagcggctggtagaggcggcgaggagggaagccggcggcgcacggatctggagccgtcgtcgtcgctcgtcgtggccggcagcggagggatgcggcggcgcgcggacgttgtcgtgaagggagccagtggcgcggacgtgggagaggagggagccggcaacgcgcggatctggagccgtcgtcgtcgctcgtcatggccagcgacggagggatgcggcggcgcacggacgtcgtcgtggagggagccggctgcctggacgtgggagaggagggagccggcggcgcgcggatctggagtggagggagcagtcggcggcgtcacggtcgtcgtcgttgtcgaggagggaggccgccggtggcgaggagggaggcggcggcgcgcggacgtgggagaggagggagccgggcgatttttctaagtgtgggggagagagagagagagaggagggggagggaaatgagtggtggggaggagaggataaggatgagatgactagtttttttttggtaggtactatttttgcaggcggaccacataaggcgtcgcttaagtggtctgattttcgcaggcgccgcttaacagtgaatttcatgccggtttatatttttttaggctgtcatttggctccaagagtcatgtccgactgtaaaaaataagacccccacatcgggggaaaatgccttttctagtagtggatattaggaccaccaattgacttgcttgctgttatgagccatttcttttagtagtctctattgacaatactctactactattattatcaccaatagaagttatcttaattgttgatttatgagttctaattaatatcagtagaataaatgattctattactgtacttgtgaggtgacagtataaattgatatgatctattggattagaaaaaatgaacgacctagattgattctactacgagcacagaccagtataaagaaaacttttaattatgtgctattgcttcttgtaatgttggggaaaaagaccagctgggcttgatagtgatagttactcctaatttatcagcttctccaacttgctgtaatttgtaagcatgcatgcatcgacaatgatgaaatttggaaatatgataatactaatataatatgaattgccttcttgttttggacatgtgcttggttggtgactagggtaattggcttgaacgtaaagaccagactgaaaacttttgaaaagagttgaatttggttcaacctgccgattatatattctggaatttacatcctgattattgatacaattaggcagcagcacatggacatgatatatatacacatctactacttagaagaagcaggcaaaaacacaagatcggtggaggaactatgattgaaatattgaattaaccaaagtaaacgcaatagaagcttcattattgatggtccaggagagatgctctttccagtggccaagggggtaccttacttagctagatgtgttaaatcagcaaccaaacttgacttgcagcgtctttgccgtgtcttccccgtaagtgtcgtgcatatgccatcggcgttttcattgatagatacagctctgcatctactctcaacctcaatctttggacactgctgtatattacatggggtatatatatatcctctctgccttccttctcccagttgcagaccaaaggagccagagcagcacaaatattgagaaaataaggagaccggccactgaagagcatgccttctctctacatattccttgggcttcttctcttctccctgcaggctcctccatgtcctgctgcaactgatactctgaaggcaggacaagtgctctctgccggtgacaagctcgtctcgaggaatggcaagttcgcgctcggcttcttcaacccaagcgcaaacatcagtaagtcatctgacaacatctcctccagttggtacattggcatatggttcaacaagatcccagtttttactgtcgtgtgggtcgctaatagggagaggtcaatcgctgagcccgacttcaagctaacacagctcaaaatatcacaagatggcaatcttgccatcgtaaaccatgccaatgaatccataatatggtccactcgtattgtcaataggacagaggccagcatgaacacaagtgttcttctccacgacagtggaaatcttgtcatacaaagcacatctaatgcagtgctgtggcaaagctttgactacccaacagatgttgctcttcctaatgccaagattggctggaacaaggtaaccggtctgaaccgtgttggtgtttcgaagaagagcctcattgatatgggcactggctcttatagtgtacaactatacaccaatggcaccagaagggtgaccctcgagcaccgaaacccttcaatagagtactggtattggtcgccagatgaatcgggaatgaagataccagcactcaagcaactactgtacatgaatccacagaccagaggtttagtcaccccggcatatgttaacagcagtgaagaggagtactacagctacaattcatcagatgaatcatcttccacattcctcttgctagacattaatggccagatcaaattcaatgtttggtctcaagacaagcactcatggcaaagcctatatacccaacccgttgatccgtgcaggtcatatgatacttgtggaccattcaccatctgcaacggcaattcacaaccattttgtgactgtatggagaatttcactcgaaagtcacctcgggattgggaccttggtgatcgaacaggagggtgttctaggaatagtccattagattgcaccagaaacacaagttcaacagacatcttccacccattaattcatgttacattgccccgtaacccccaaaccatacaagaagctaccactcagagcgaatgtgcacaagcttgcctcagctcctgctcctgcactgcttattcctaccaaaatactagcacttgctctatctggcatgacgaattgtttagtgtaaaccaagatgatggcattgaaattcattctcaagatgttctttacctccgccttgccgccaaagatttgcagagtttgagaaacaacaaaaggaaaccaaatgttgcagttgttattgctgcaagcgtaattggttttgtgttattaatggtcgggatgtttttactgatttggaggaacagattcgagtggtgtggtgcgccattacatgacggtgaagacagcagtggaataaaggcatttagatacaatgatctagttcatgccactaaaaatttctcagaaaagcttggagcaggtggttttggctctgtgttcaagggaatgttaattgatctaactaccatagctgtgaaaagacttgatggtgatcgtcagggagagaaacaattccgtgctgaggtgagctcaattggattgatccaacatatcaacctagtgaaattgattggtttttgctgtgaaggccgtaagaggctacttgtgtacgaacacatgttaaatggttctctggatgcccatttgtttcagagcaatgctggtacactaaactggagcattaggtatcatatagccctaggagttgctcgaggattgggatacttgcatcagagttgccacgcatgcatcatacactgtgatattaagccacaaaatatacttcttgatgcatcatttactcctaaaattgctgactttgggatggcagcatttgtagggagagattttagcagaattctgacaacattcagaggaactgtagggtatcttgccccagagtggattagcggagttgctgttacaccaaaagttgatgtttatagctttggtatggtactactggaaattatatctggacgaaggaattcacctaatgaatacactagtgataattaccatgtttcgtatttccctgtgcaagccatcaacaagctacacgagggagatgtgcggaatttggtggatccacaattatgtgatgattttagtttggaagaggctgaaagggtttgcaaggttgcatgttggtgcatccaagatgatgagcatgatcgaccgacaatgagtgaagtggttcgggtccttgagggtatgcaagagcttgaaatgcccccaatgccaagattacttgcagctttaacaaaatgctctgatgtgggttcaatataatagttcataaatacttgtatttcactatatttcggaataatttatgatgctaacgtgtggcaggagaaattaatagaggaagtcaaacctgcaaatattgttgaattttatggtatggtgtatgttttccccccgttctgtttgtaatgattacctattatattctgatgagcagatacttttggaaaatatgccagtactagaaacatgtgtatattctccaccgtactggagaaaaagaaatatgtctatgtttatttgatggaagcactgaaatgtatcctcaaattgaaggaagttcatgtatgatatatgccattacttagtgcttgaattagagatatagcatttgtaaattgcctattgaaatatgccaccacgtagttatccaataaagtgccagactaatgtagtactacaatatttccgaacttcccttaggatgatgccatgtactattaacattttgtatgcacagtgtaattccgttcgcatcctgggtgatctcgatgcccagatatatatagtaagataagaggccaacaaggtcactcatgaggaatacctgcttcatttgagccttgaacatgtcgattttttttttttttgctgctgcagccggtgctgatgagattgtcaacgtacacgccgacgatcaaccgcgaagctcggcacacgtgtagatgctgtgttctgagtcgctcctcctgaaaccaagtgacaccatcgaggagtctaacttagcttggtataaaaggtccttactattttttttaagtaaattgcactagcggtccttagacttgtaagcaaattttatctagatccatgaacttgcaaagtgtgtatcgaagaccctaaacttggtttattgtatcatcccaatgaaagtctcatttgaccgtggtcttacttacgtggcatgacatgtagatgacggcatggcacatcatcatcatcacatgtagatgacggcatggcatcatcattattattattattattattattattattattattattattattattattattatttctttgtttctctcttcttcctctttcatttctctcttcttcgacctctttgacgcgggggagctcgaggtggctctagtggaggaagaagataaaagaataggaggaaaaagaaaaggggaaatgaaaaaaaacgccatgtcatcgtccatgtggcgtgccacgtagacaagaccacggtcaaacaatgctttggacggggttgatatattaaaccaagtttagagacctcgatgtacgctttacaagttcgtggatctaagtgaaaccttatgacaagtttaagggccactagtgcattttattctttttttccatgttgggctcaaattcacacactactacgaaactcctgataagaaacgccctaaacttggcacatagtatgagactttttcggtcctcccgacccttcaatgggtctaaaagtaaaaaaatgacacctataatattatataggtgccggtttattaaaaaaccaacactaataatataaatgacggttttcctaataaaccgacacttaggctgtgtttgaggaggagatagagaagattggaaagatacgcaaaacaaggtgaggtattagcgcatgattaattgagtattaactattttaaatttaaaaatagattaatattattttttaagcaacttttctagaaatttttttcaaaaaacgcaccgtttagtagtttggtaagcgtaggcgtggaagacaaaacaaacaatctcacaatcacccagggccgaacgcagccttatatgtgagatataagtgcgggtttttaaatcaaccggcatggacgcgagcgagcagagccaataggacgcaagcactctagaaaaatctacacgagactagtcttctctccgccctctctcttgtgcgcgcttttctctgctttcttcgcccctctcacattcttcgcctccctctccggctccagcacatggctgcttctctgtgtcgtcttcctctagcacggtggccttcggattcagtcgagaggatagcggaacaagcgggaggagtctccgtcgaggccaccgaatttaccccatgccacctcctccaacacaccggagaggagagggaggaggcggcgcaagccaaccgccaccatcacgagctcaggttgctgtagccagccatcacgcgcactgttgccttatgtgcaccgttgaggagaagggtaggtacacgtcatgcaggggacttctacaccaccactgcccattcactagatctggtgctcaacattttttttctgatatgtttggttttttcttgttcatgttgttctttcccttttgacgcatgcaaatgatctgtgtaattgattttaattggaggaatgatggaatttgttcgtttgtgtcaaaatttgtgatttggtttatatgatttgtgctattgaagaacaatttgggattcatgaagaataatttaggattattttgtcattttctttactgcaagcataggctcaagacgagctgactttttttttggaatcgtgcaactaatcggtaccggttctcaattcggcaccgatgagccttctgatcagtgccgcctctgtgatgccggttggaaaatacagcatatatgtaggtttccatgcggcacccattagattttgtgtagtagtgacatttgaatgggctttatcgccctaaattgatgccctttttgacccaatttggttggaaaatagtgtggccttggaaggtcacaattatgtcgttgcattaagcactgacgctcttgtcccggttatgatttgcacctttttctttttaataaaaaggattaaaatccgatctttacatccaacctgatgtagacagccaacgcaccatctttcttatgctggccatgatctatgttgctgtttttgcattgtcattcgtttgctcttatcccttggctgtcccatcgtccatttcaagttctgcatatgatctctccatatatatacatacagctgagctgatgatggttatcgttctgaacttctgatgttgctgttcaaatttcttgtatatcttctaaggcatgtacgcgatgggctgctagcctacatcctttgaaacgacaatacatatatgaagaaaaccgtatagtctctccaatcaaatttatttgatgttgaaaaggtactagtttactacctccccaagtgtatggtagtatgctgtttcagtttggcatctcagtgtttttttatatacgtatatcgcaaactccaccaaccatgcaaattcctcatggttgacttgagccagccaaacacatgttgtacttgtttaagcaacaggagataatggccaataaaagtggccacccccacccagtgctgtcttaatctgaatttgaccagcatgcatgctcagcgtcgttgccgtgtagatattccccatcagatcactcgctctcctcttattccttgtcccaactccaactgcagaggaagctaccagcaattctcgtctccatgcgtccccagagctatgcatttcttggccttgttcttctcctcttctccctgcttcctcttgctccatgctctgctgcaaatctaaataatgatactctcctggctggccaagcgctcgccgtcggtgacaagctcatctcgaacaacggcaagttcaccctcggcttcttccagccagacgcaggcaccagtaagtcatctgatactagcaccaattcccctggctggtaccttggcatatggttcaataagatcccagtttttactactgtatgggttgccaacagggagaggccaatcactatccctgagctcaatctaacacagctcaaattctcatcagatggcaatcttgtcatctttaaccatgccactgaatccataatctggtccactcgcgttattatcgatagtcataggacacaagaaaccagcagcacgaacacgagtgtcgttctattgaacaccggaaaccttgtgatagaaagcacaacaaatgtagtgttgtgggaaagctttgactccccaacagatgttgtgctccctggtgccaagtttggttggaacaagatcactggcctgaaccgtcaatgcatctcaaagaagagcttgatagatccaggtcttggctcatacagtgttgaactagacactaatggtaccaagggggtgatcctcatgctccgcaaccctcctaaagtgtattggtatggtctaacatcaccaactcttataccagagctcagatccctgctagcaatggatccacggacgagaggtttgatcatccctacatatgttgataacagccaagaggagtactacatgtacactttatccaacgaatcgccttcttcgttcctctcactggacatgtctggtcagatcatgctcaatgtatggtcagaagctaaccagtcttggcaaatcatatatgcccagcctgctgatccctgcaacccatttgctacatgtggaccttttaccatctgcaacggcaattcaaatccagtatgtgaatgtatggagagttttactcgaaagtcgtctcaggattgggaccttggtgatcggacaggaggatgctccagaaatactccattagattgcactattagcggtaacaggacaagttcagcagacatgttccaccctatagctcatgttaaattgccctatgactctgaaagcatacaagatgccaccactcagagcaaatgtgcacaagcctgtctcagttcctgctcatgcactgcttactcctatcagaacaacatatgctctgtctggcatggggatttgtttagtgtaaatcagaatgatggcattgaaaatcatttcgatgatgttctttacctccgccttgcagccaaagatttgcaaagtttgagcaaaaacaaaagaaaaccaattgttggagttgttacaaccataagcattattattcttgtgttactaataatgctcatggtgttggtaatggtttggaggaatagattcaagtggtgtggtgtgccattacacagaagccaaggtggtagtggaattatagccttcagatatagtgatttagaccatgctactaaaaatttctcagagaagttgggagaaggaggtttcggctccgtgtttaagggagtgttgagggacttgactgttgtagcagtgaaaaggcttgatggtgcccgtcaaggcgagaagcagttcagggctgaggtgagctcaatcggattgatccaacatatcaacctagtcaagttgattggtttctgctgccaaggtgacaagaggctacttgtttatgaacacatgttaaacggttctcttgatacccatctgtttcagagcaatgctactatactgacgtggagcacgaggtatcaaatagccataggagttgctagaggactttcctacttgcatcagagttgccacgaatgcatcatacactgtgatattaagccacaaaacatacttctcgacgaatcatttactcctaaaattgcagattttgggatggcagtatttgtaggaagggattttagcagagttctgactacatttagaggaacagttggatatcttgccccggagtggattagtggtgtcgcaattacaccaaaagttgatgtttacagctatggtatggtgttgctagagatcatatcaggaatgagaagtttacctaatgtacacagtagcaacagtcatcatgctgcttacttccctgtgcaagccatcagcaagcttcatgagggagatgtgcagagtttggtggatccacgtttgagtggcgacttcaatttagaagaggctgaaagggtttgcaaagttgcttgttggtgcattcaagataatgagttcgatcggccgacaatgggtgaagtggtcctggttcttgaaggtctacaggagtttgatatgccccctatgccaagactacttgcagctataacgagatcttctaatgtagctgagatgtaaaaacaattcaaaatcctctaattgctaaaatgtactgtataatgctactcttgtatttacatttttttttctttaatgacagacttttgtaagcaacggttgtcgatgcacagtgagaaatgtgttttttgttgacggtatagttgacataatgcttaaattgaaataggaagttggtatattggactgcttactgcttgctttagagataggtccttgctttctctgctagaaatgaacctccatgatagattaaaaaaaatagacacataaatgggatgaacaaagaaagctcaaaacaaagccactttcagcttattaactcttctcaataaaaaggtttcatcctatcggcccatttaggccttgtttgcctataggggaaattttccttaggttgatccacccaagagggcagattgggttgatcccctcctaccatccaacccccctccaattcccctcccctgagtattggtgttttgtctgttggttcatgagtacacaatacaacaagcaaaggaacccattgacactgtacaaactgcacatccaaaagaatggcactaagaagagccattttggatgttaatacatcacagcagtaagcataaaaacattaaaaaaaagcatataagatttgggggctaaaatgtgcacaagaaagctgaaatatggtaacaggaaaattactaatagtgaatggtaagaccatgactatttgttatatacttgtactgtttggtagtaggctagcagctcgaaacagtgtatatttacttcagttcatgccctatgataatatatgttacaagcagggagatatattatttgctgatcttttaagtccatgtggtggaatggcaatgaattgcaagttgcaaagcgctacagtatactctttattatcaaaacctattaacagaatgatatattcattattaatgaattcattcaagatattcatatagatatacaaaaaaaaatagtcgtctctctgtgtgtgaagcacaccatagaagtagatgagcaatctgatagagttagcatcatgcgtccttagactttatgaaagatagtgttttgccagaaggtgttgtaggttataacacattggaaaataaatggaattgaagaaaatattgatgttggtacttggtagtatgatccaaatgaaacagtgataacaaagaaaatattgcataggatttcatcgttaacacttttaatggtcttttcttaaggtgattaactttgcacaaaagtgtgttggagaaagaacagaacaagcagtggcattgctcagataaaaaaaatttcaggaaaccaattgatggtctagttgaactgtaaagtagagcttgtcataataattatcccatggatcaccattctaccaacattgataagatggagcttaacaagagaaatccaggactgaagatacaaaatgaacgatttactcaagtgcatttcgttattaggtggagtatatacttaactcactgcggtgatttcagtgaatttagtgcatgcgatccggatctcccgcagctcgcgtgtatacatacagatccagatcctgcactaccgcaccacacaacacaacccccaagcaatataatcaccataataacactgaagaatctaggggggggggggaaagaaagtaaggggcaaatgagagaggagtgaatgatgaatgcggcggaaaagcagaactcacggggacgggataggagattcgcatccggggaggaaaaattggaagaggaggcaggcagacgcaggcatggtttactgcggtactggctctacaggaagagaggcggcgacgatggcggagggaggaaggtggacgcgtggtgttgccactgctacgactaaaaaacaacaaggcaagtcaatcttgatcttagagcatcacaacaatatccttaaatgaaacccaattttaaaattaaaatttattttataaaagaattgctccaacagttccatagagatgtatccaaaaattagaatctcattctcctccttactcgctctccacaagtcaggagacactctcactttcaatttccttcgctctctacaagtcggtcaggagacactctcacttccaatttccttatagcaaaaggagatggcgacaagtggagagatcgcgcgcgtgggaggggatggacaaagcgattttctttattatatgttggtagttcagtgtgggttcactttttattattggaagttaatttaagatatttgttagaaataaaaatctatttacaccttaaaatcaaattaggaatttcaaaaacagaattttaaagataaaagatttttgggtatcgtgctctttacccccatcaacttttacaatcgatctatctttaatcctatcttactataaagttatcctccactaactccttaagcttaacatgcaaagatgccacatcatcatccattaacaagatgccacatcatcatccactaacaatcatcacatttaaacatcatgcaaacatgctatatctttatagttttttatagtttttataatttaagagcttttcaaatacaaacatattaaattaaattatcatccagtataattcacataatgtttcaatgtaaatccttattatgtttatgatatcctatatacttatatagttcatcttcacttagtgcttaaatgattaatctatggtctaaattatctttctcctttttttcccttaattaagtcatatcacatcaattgtttttagcctttagattattaatctacggtccaaactatctccctacttttcttcttccataaagtcataccaccttactttttatttttgaatcaccattctacattttatttaaatttaaattatcataaaccgcattaatttacttaatctgatgttatctagctatcttacatgttatttttttattgttatcatactaaattcccgcagcaatgcgcggggtttcacctagtatatatatatgcctctcaacaacttagagcatcaccaacaaactaggtaaattccatccccaaaaatttaaatttgagaatcataaacggattttgatatgtgaaaaagtgatccttccaagggattgagtaggacttattaaaaccaaaacgtaggcccatactatacactactaacggaaatcactttatattcctcctcccgcatgatcacaataacaaaaattaagttggagaattttttttccttacgtgagatagctatgggactctatctttacttaaagctttaaatccaccagcttataaatcatataaaccaaaaaactaacttaataaccaaaaaacaataaaactaaactaatagaagacttttgttatcaaacaaggccatagtccatgaaactattgatgctaacattacgttgttgcgaatggtacgagggttcagataaaacgctaccactggatagcatattgcaacagtgatatccatagatatcatgttatagaacgagtaaatgcatatagtagtatttctcatttttaaatttgaaaatatatgttaggtagaccttttgacatatgttgttagcagtcgtgaaaaaagagctagctgggtgaccaaaggcgatgaagagacatgtaaaattaatcgtgaaaccaaattcctcaatttttggccaaagattgttttatcgtatagtacaaacactattggagaagtgatctttacccaaatggcaaaaatcacattagtcccggttcaaataaaccaaaagaatatgtttagtccaggttcaaaagccagacgaatctttttttatctttaatcccgttaccaaccaggactaaagatcatttttaatccagcttcaaacagttatcaggctgtgtctggccccaactatccttagtcctgattgataacactaaccagtactaaaatcaacactttaatccttgttgttcataccaaccgggactaaacaataaaaaaaacggaagaaccgagccgcacgggggagagagctgcgtccttatcttctctttctctccctcgcgcgtccttatattcttctctttcttcttctcctcctccccctccccttgtcctcccctcatcctcttctcctcgtcccgtcgggagcaggagcagcatgcctggcccggttcttggcagtgggtgtggctcgagaggtcgtcggcttcggcgcggcagctagggcgcggcggcgggtcgcggaggcgcaagagcgggagggcgatcgcctccgtcggtagcggcggcggtggtggtgggctagacgatgctggcgtcatcgtctcgccaggtggagctcggcatcggcttttgccttggcgtggcagctggggcgcggaggcgcaagagcgggagggcgcttttttccgccgccggtggtggcggtggtggtgggctggacagcgctggcatcgagctgcattcgatctatgaatgaataatggatgattttgttgtgatgccgttgcatgtagacctgtggtttgtagactttttttagatgttttttgaatttgtagatgatttcgttgttgagtatgttcattcgattttgtggatgattttgttgttgagtatgtttttgtgaatttgtggatgtcaatttgatgtggggatttagggatgttgggagcaactggcatggctcaaaatcaatacacaagtagtaaaaaataatgaaaataaaaagaaaaaacatttgccacatggcgctacaatctttagtctcgattggtgttaaaggggttgtaaatcgggactaataacgatggattccctagtagtggaagcatgagatgcaaaaggatcacgcttgtgaagctagcaattctcataaaattctagtcaaatttcctataattttcctcgttacgacaacaaaaatgatgatggagaagctgttttgcaggccagcaaccggttgatgccccatcattttcctctcccttttgtttctttcaacatatacatattgctgccttcttattttcttccattttcttatttagtatactcagtatatattagctttactagcctgattagactaagacatactaccttcgtccaaaatatcaaattttaattatatatctgagcatgtgctaaaaaaagtatattatgggacaaaaaaaatagtttttgccccaaaaaatgcccctttttaacaggtctttgctttttatcaggtcttactagataatttattaattaatatattcagtcaagaccacgtcaatataacgatggtatatcagatagggaaaaggggagaaattctagtccatttgcgactagtagcatatcgctagctacggcacctgcatggttcgttttcagtgaaacaaccaaagtgttattgttaaaaaaaaagtgttgaagtggaaaaaaagagcgagatatcgatgcatgtcatgtgtgtgctgtagctaagtaggagtcgtggctacacaaattaagtagtacgtcacaggaaaaagatcattttttttccggtgggctgcatgcttcagaaaaccacaatcgatcagaggaaaaattaggtgtgtccaactgtccaaaataagttaaggaccgtgaaagcaacaccctgcccaactctcttcctgctttatatgatctttttcttccatttcctctctatgcataacttcattatatattgacaacattttagttcgttttacgcaacgttcttttcctattgatttttatcctcatttctggccatacatacaggatacaggttagtacttagacatcacggtctttttaaatgtatggttggtcgcttctaatattttgttgtgatattattagaaacaccgataacactgaaatattaggaattgccaatgcgatatactgataaaatactcctatcttctattaatatattagtcaaaaaactaatcaacatcattaatataataactgaagaagggagtcacgttttttattaggtaatagtttgtttttaccccggaactggatgagaatccattttccttagtaaaaacagtctatttttcagcatgaatatttcttttcgttgtagacaccgccctatttaattagagctaattaacacaatcgatatttccaccaactttgattgacaatgttcttgaaaatgtcatgttgaaagtgcttttgttaaaccatcattgtagttccctgtccttgtctccatctttctttttaaaaaaatatcttacataagagaaaacatatatgcgagcgaacaaatcatgtgttccagctgaacgactttgctatatattacgtatgtttttttcatttgacattggttagtttaaaagaggatggaggtcgtattacacaacatatttttaacaggcgcagtgctccgacaacggggaagtgcagaccctcttttgaagatttgattagaggcaggttgtgactgagagtgatcggtgctaagaagtgtgaaaaaaaatatacaaagaacgaaacacagggagtatacaggtttaggccacccggaggtgtaacaccctactcttataattttttttctactatcaacaccgaatgatacaacacgaacaacaacagtagggtgttacaaccccgattggcctagacgtgtatactccatgtgttttgttatttgtatatgat

SEQ ID NO: 59411 - DNA, 12480 bp, Oryza sativa
ggatgaatcttgatgggagtccgatggatctcgatgcatggatgtcgatcgcctagcgccgtctattgggtggctgcctgtaccctcgccggcgtacccttccgccgaggcctctgtgtgttccctcatgtgatctatgtatgagtggatggatcgatctcttcttgtggttctacatccatgttcctcctccatgatcaatctgcaaaacgaaagagaaacaaagaaaaggacggagctgtactcgccgccggtgtgctggtgtagatgagaccatgtccgtgtactgcttctctcctcctcattctgcccacagccgccggctggcgcgccgtgtcttctcaccgggcagagggatggctggacgaatgtcgatcgcctggcgccgtctcttggcagagcgcctgttggctgccgccggccgtcagcgcacgcgttggcgtgcccttctgctttgtgttcttgttctacatatgtgtggatggatggatgtgtgttttatgaatgattctccatgccctggctggttagctctcgttggcttttataagcgctgggaaaacttaacggacgggcgcgcatactccggcgccgacgtggctgcacgtgtttgttccgatacctccgggcgacgttgctgcagatcacgctaattcgaatcacctggataagacgaagtttgttggttgggtttatccggcgctagccgcgcacatcagtagcttgcagttgagaaatcccgcgtacgcatgtattctgatacaatcgcatatatacgatgaaaacgcaatgtgtctatgggctgccggcccacgtgcagcttcacatttcaaccgtgtagctagatgttgcttcttaactcatagaaaccacccggtatttctgtacgtatacatgcacgtacggtgaatacatatatagtcacgagcgctcgtttatgagctgctcacatgtcacttaggtctccttgtgcatgcatgcttacgtatagattagctaagcatgtatatatggctgaacacatgtacccatgtatagccatataggaggacatacatatgccagtacgtgcatggctcatgcatcccatgcaattgagcaagctatatacagagtcacatattaatgaatgcgacgatcatagctgctcttttgtttgcttgtcttgataatacaaataatccttggatttataagatcacaaaataccgtcaaacaaatgccccccagcaagtggagtttgcgcaagagaaacgcggtgtgaactcgacttggtgaaccctattttcctaaaattcggctcaattttgcactgctgcctcatcttgattatttaatatagaagggaataaaagaatttagtcccattgaatttagtcccactactaaaacaagcgtatatcaaaggccgcatatgcagcatcattgtgaatatgacaagccaatgtcatgcaaacacatcacttcatgcaactatgttgtttcaagcgacatcaaaacgggttttcaaaattttaaacattggtacattaacaagtttcatatatagatattaatttgaattgaaaatcatctagttgtccatcattcttgacaaaaggaagtgtataataaattcttgagttgagctctcgctcaatttgcatcatggaacaacaacgtaggcataattatttctgtacagaagcaaaacatgcagcggcaacaatgggggtgaaaaccgaaaagacagatttgtgatgttcttttggtttattctgtcactgtagagtgactataaagaaaatgcacccttcttccaaattcaaaattatgtgatgtcgtacttaaggaatgctccaagacattgaggttgttcttgctgacaaactctttgctttgagtagtttattctagcattgaaagtagatagtctcactgcaaacaaaatggataataaacctcatgtttcagcaaaattatattggtgatctctcgtaaatatctcgaatggtgattttaggcttcagcgctaacttaattcttcctacaatcaaatcttcactaccgcatcaacgaaacaataaaatgcacctgccgtactataattttgtcattcctgttgaaattttataattcaagatgcatgaggccgcgcgaccttaaagttcaacgtggcatgcagtagtgaaaaaatagcttagtaaacgtgataaacatccctagataaaagattcaatcctcacgaaacaaacgcataaggtgagcgatgagtcatatcgttatctttcttgcctgctaaccatcatgatggacagaaaagttactttcatgatgacaccaaagcggatttgttggggcacctaatagaacatacatccaaatgacatgactcacttagatcctaataggacatccaagcaaaactaacacactaaagcaaccgatgaggaatcgaaagaaaatccgtgccagcgcatctataaatggacaaactccatgaaaaccctcctcatcgctcgcacaattcaagcattatacaacaaaaatttaaaagaactagtgtcctgcaacaatgaagatcattttcgtctttgctctccttgctattgctgcatgcagcgccactgcgcagtttgatgttttaggtcaaaatattaggcaatatcaggtgcagtcgcctctcctgctacagcaacaggtgcttagcccatataatgagttcgtaaggcagcagtatagcattgcggcaagcaccttcttgcaatcagctgcgtttcaactgagaaacaaccaagtcttgcaacagctcaggctggtggcgcaacaatctcactaccaggacattaacgttgtccaggccatagcgcaccagctacacctccagcagtttggcaatctctacattgaccggaatctggctcaagctcaagcactgttggcttttaacttgccatctacatatggtatctacccttggtcctatagtgcacctggtagcattaccacccttggcggtgtcttgtactgaattttcacaatattgtagttcggaagtgaaaatataagctcaggtatcatcgtatgtgacatgtgaaacttgaggtgatataaatagaaataaaattatctttcatatttaaatagcttgcctctataaggatatatcctagtgcattgtcgtagctaattaccatgattggtactccacaattttactgtgcgcttaaatttgattcgaagctacttcgtattttagatataaatggagtgtataaaggatgtccatcattttattccaataagaacaaacaaaaagcacatatgaaaaatactaaatccaccacaacaaaatcgtataccatacagaccacgtaaagatgcagcaatcaactttgattctccatccacgactaaaacaagcgtatatcaaaggccgcatatgcagcatcattgtgaatatgacaagccaatgtcatggaaacacgttacttcatgcaactatgttgtttcaagcgacatcaagacgggttttcaaaattttaaactttggtacattaacaagtttcatatatagttattaatttcaattgaaaatcatctagtcactactagaaaattgatttttcaagacgttgctctattattttcactggcggaaaaatatgaaaaccgccagcaaacttgtaacgagggggtgaggggcaccgaccgccagcaaaaatgcattttcgctggtggcccatctaatgcggccgccagcgaaaatatgtctatttttgctggcggtcaattaggtgcaccgccagcaaaaatagttaattttcgttggcggtccaatttttcatggcgaccaataaatagaaccgccagtggaaatccaaccaaaagtatctgtcacattaaaacacccacctacccatcctcatcctcttctccacattaaaacaccacacatcccctcctcttcttatccactcctcttctctctcctccctctcctccttcccagcctctccacctgcgacggaggcgacggctctggcggcgacgaccggcgacggcggtggcggctctagaggcgacgaccagcgatggcagcggcggcggctctggcggcgacgaccggcggttccccgcgtcgcccctgccctcccatcccctcctctcccatctgtccgaggggaggaggccgccgccggtggcacaacataggcggcgacggggaggacgtgcagatctgccccggcggtggtgcggggagcacgcagcgcgggaggcggcggctcgtccccggcggcggatggcggcggctcgtccccgtcagcggatggcggcggctcgtccccgtcgacggcggcggctcgtccccggaagcggatggcggcgacaacagcggctcgtccccggcagcggagctgacgacgacgaccgtgaccgtggcgacgacgatgaccgcgacgctgccggcaagcgtgtttttgtgtgttttggttccgtgaccggcagatggcagcggcggtggctcgtcccgatggcttcggcgactagggttctctgtgcttttgtgtgtgttttggtttgtaaggatgtttgttaggttaatctgtgtttgttctgttgatgatgtcaatgttgtatttggattgatgccaatattatgtacatatttgtgatgctctggatttggattgtgtttgaatgatgtttatgtccattttcaaatatggattgttttgaatttggccgagtggggaattttgaatttggggtagggaatttttggcggggtgggttgattttcactggcggttctctttaagcaaccgccagagaaaatgggttttcgcaagcgacactcaactgctagcaaaaatcgtttgtccacttgcgaaaatcgattttcgcaagcggaccgaaaccgttagtgaaaatcgtgtgtccgcttgtgaaaatagattttcgcaagcggaacataaccgccagcgaaaatattagatcttcactggcctttgctttgtggcggctccaaattccgccagcgaaaatctaaaatggccgccacgaaagatggttttcgtagtagtgagttgtccatcattcttgacaaaaggaagtgtataataaattattgagttgagctctcgctcaatttgcatcatggaacaacaacgtacgcataattatttctgtacataagcaaaacatgcagcgccaacaatgggggtgaaaatcggaaagacggatttgtgatgttctttagtttattcagtcactgtagagtgcctataaagaaaatgcacgcttcttccaaattaacaatgggggtgaaaatcggaaagacggatttgtgatgttctttagtttattcagtcactgtagagtgcctataaagaaaatgcacgcttcttccaaattataaattatgagatgtcgtacttaaggaatgctccaagacattgaggttgttcatgttgacaaactcgttgctttgagtagtttattctagcattgaaagtagatagtctcactgcaaacaaaatggataataaacctcatgtttcaaaagtttattccgacaccgaggctgcaaggttggatttggttgagtttgtgattttgattttcttgaggttctggtacttgctatacttctacttgagtgtcaaacttgtgccattctatcctttgttttttgtcaaaatatgtccaaatttctggcaaaattatgtcaaattttgaaacaacattttatccatagtctgtcaaaattgtcatacttgtcagagtttataaaaattgcaagctgcatgtacaaatggaagcaaatacacaattgataaaaaaacagtgtgaaatgtgtaatagtagggaagggtatggatgtctttttgccaaagatttaatatcgtcaacatgtccatccaaaatagttttaaattttagcttcgtttcaaaaataaagggggcaaaaaccataaggactttaactagcaagttctaggaagtaatcatcatcaccgtgtgatagacgaaccggtaatgacgaaatccccattgtttgcgattatcttttgtcatgggtacatatcttatcaccaagacctcctattgtcgctaagatggaccgttagagaatttaatgttgattttatcacgaattcgttacatattaatgaagtcgtcacagggaatcgtcaaaaagcctatatctgttgtagtgcatgcaactagcgagaggacaagctttttgggtatactatgtgatacctcaggatttgttatgagatacatggatgaaaatatgttaaatattatagaaattataaatattaaaatactataaaaaatgatgtgaggatgatcatttaacatacttatatgctaaaccctatgcatcagtacattaaaatacttatgtgaagatcatttaacatacttatatgctaaaccctacgcatcatttaacatcattatatgcttctatctttggcaggacagatatacaagtacagtgatatcgttatttaaatggatgtaattttgtggttcacatggtatatattttactacacatcatcttctaccctataattcaccaactacactcctgtacaatcctcattcatcaaatccgacgatccagaatcatcgaatccaacggctcgagattgtcccacgtctcccctccgtatgcacccctctcccctctctctctctctctctcttgcacaccctcctctcggtcgctcccctcaaccatagccgcctcctcgatccatgccgccgccgcctcgagccacgccaccgccggcgtcaatcatctgcgactccgcgtgaccgcctatgatccaggcaacggagatcctcctcggctcctcgcgccccgacggctgatacactgcggtccgcgcgtcaggcgaagttgggagaggatatcctctgaggggacattggcggcggtgatcctgcacgcttgtacgaatgacttcacagctagaatgactgacgaccacgtccggccaccgtgtacggatgacttcacaccttgaatggatctgctgctgcggtgctgcccaaacaccttgaatagggtgtgtttggtttggggaccaagtgggatgggttagacccatcccagttttttgggatgggatggttccagttgtgtgtttggtttatggtatgaaatggttatagttttttgtttggtagaagggattgaggagggatgggatggacaatttttcacggatgttagggccgtctgctcccagtggctagcttccaggctgccggtgagattagggacgaaggagctcgtcggcgcgagttgaggagctcgtcggcgcgagcggaggaactcgtcggcgcgagcggaggagaggcggaggcgggtcgcggacgagtggcgacggtcgcgaaggtggcggcaggcgcggacgagcggcggcggtcgcggagacgaggcgagcgtggatgagcggcggtggttggtcgcggacgaggcggcggttggtcgcgaaggcggaggtcggacacggacgaggcggcggcggtcgcagaggcggaggtcggacgcggacgaggcggcggcagtcgtggatgtggcatgggcggtcgcggaggtggagggagcaggcggaggaggacagagcggcgccggaggagggagcaagcggaggagggacaggccgcggtcgcggaaaagcagcggccggtcccagaggcgaggcgaggcgcgggcgagcggcggccggtcccggaggcgaggtgaggcgcggacgaacggcggcggtcggtcgcggacaaggcggcggccggtcgcgaaggcgaaggtcggacacggacaaggcggcggcggtcgcggacgagcggcggcggttgcgcggaggaggacggagcggcgctggtggagggagcaggcggaggagggacgagcggctgtggcggcgccgcggcggagccgagcgggaggctgcgggagttgacaccgttctctccgtcgaagtgggatggattggtccggccgattttggtggaccatttcgtcccggatctgagaggaatattcctctccagggaccatcccatcccactcacctctcaaccaaacacccctaaaagtgggttcatcccatccttgcaaccaaacactacctatattgccaggtaacgaatgatttacgcgtcgacattgtccatgtggacatgctgcagtcgaattaatgtagcaacacagagacccagaacagacattgctctgctatatatcctcctgaataggttactgtattagccctttgcactgtacatgcttgtgaaaatgcgcataagcattgtagtaatagatggaattttggtgcacctatcactctgttaagtaatagatggaacttttctgatctgagagttaagttgatttagtttgtgtactttctttctactttggacttttaggcaaaagagaactgtgttaagctgtgtatgtgtcctatatgattttgactgcttattcattcaaaatatccatgttacttgaaacagaaatctgcatgggattagtgatgtttgttgacgtacttctaatattttactctagaaaagtgaagcatacaagaaaatcttactgtttagtaagaattttctgatttgtgctttggtgtatgctgcaatgtaacatatatgcagagagcggaagtcttttattttctctatcacctgatcttttatgttagctacagttctatatatttttttgttggttaggagttgaaagaatgacaacagtgatcgatcatactaggaaatacaaaaatagattaacatggaaacgttgttcatgtgggcatttcattccactgcatgggatggacaactgtttggcctcctctgctgctgttgctatgctgagtttgcgattcatctgctcttggtgcctcaattcctcatgaaccaatttgtctaacaattttgaaatgttgttcaattgatagatcctcctgcaccttcatgtagtatgctcaggacaatttgagattgactactgatcatttttaggaaatagttttgtcattacagatttctgggtagatttgaatatcataaagtgactgtaattactacttgcctaccttttctttgacggataagccaaaacctgatcttggaaaggattcatttagtctttgtgcatccattttcttattatttagtcaatccgcgtcgccaaggaatcatgaccgctgcgagatgaaaattttcattatgtatataagagtagcaaagagaacttggatttgaacgctggtgttatacttctcttgatctggcagttttttatttcttaaaattaatctcattttatatattgtcttttggttgcttaatataaatattaccgtagcgttagtacgggcatgctactagtcagtatataagtaggcttgctatgcctttctaaaataggtacataagttgtttaaaaattacgaagaccccatctcttatagtacctctaattacactggaacttatgcacaccttgaagcaatcttactaactggacacacattcagactagtgtgtttagcagcaagaagttcaagtgcctcccgcatatcaagatccttgtgcaacattccatttggcaacttccaatcgaaatgataaagaaggttagccaaggcaagctctatgttggccagcccaagatttatgccgggacatatcctgcgtctagagccaaatggaagaaactcaaagttattccctttgaattatatattgttggtttcgaacctctctggcatgaattctttggcattctcccaatacttactatccctgcaaattgcccacatattcacaaatattgatgtacccttaggtacatcataacccatgatcttgcttgtctcatggcattttcgagggatcaagaagggcgccgggcaatgtagtctcaaggactcctttatcaccatcttgaaatagctcaattttccaatatcgtcttcagtgatagtgctctttccttgaaaggcttgacgtagcttagcttgtaccttcgccatcactctcagcgacctgatgagctttgccatggtccgggtcagtgttgttgacgatgtatcgctgccacccgcaaaaatgttctgaaatgatatatttttgtaattaattattattcacctgaatttttttatctatttttgcctaaacttgtataataggcatacacatatatgctacacttaactctatttttttcgttactatatactccttccatctatttttgatagtcatatttccaaatctaaaaaataaaatttttgataggcatatttcaatccaacaacctatcaatcttaatgactttctcggatttaatgtgtaactctccattcttccacacaagattgtctgcatgagcatcgagaaatgtaaatattaatgaatcgcttgtttacgaggaatgactagtactatgtttaaatagatgataagtagaattacttatctttggtctgtgtgccaagatgaaatatgactatcaaaagtagatggagggagtatattttcttgtgtaaactttgcttagttcatctcataggaggttttatcccttacttaagactattttttttatctaaaacattatggttttgtatcctaaagatacagaggccaggatgataggatgatagaacttcctgattcttttttaaagaaaaggtttactaatgtttctatatatattttgtagatgtaggttctccgcccatgggcataaccaaggatcgatattgagccagctcggctctgtgcggtttggctcagtaggataataccatacgctttgctgcttaatatatggattaatatatggatgaatacctgttatatattttagaaataataaatgtatatattcaaataatgtgaaaatgatgcagagagtatgatctgacattacttgcatatcaatttctaaacatacaataaaatcataataattattagtggatgatgatgtggtatatttacatgtgatttaaattactttaaataataattgctagtgagtgatgatgtgagacacttatatgattagtttcagtagttagtgcgcattaactttataagtaaaataagacgagctggctcgacacggcacattatccggacaaggcttaagctagtttagctcgcgagttggggggagtagtgggattaagttggctggcgctggagttaagatcgacttggagatggtgaagcagagccgcttggtggcatggagctggagttatatggacattactggcctggcccaccactctgctttaattatctcctgataggctgataccaatgcttgttttcttcgctctattatttgtgccgctaatccatttccctgaattggcctcctgggctgtcttttttatccatatatgcataatataataattactactctctcctttcaaagtccaagtcatatttattttctcaccaagatcaaagatatagttaacccattcatcatacgataaaaccaatgaatatataatcaataagtactaagatgactttttggttttgatcaaaaatttattaattaagttacgtagtgattataaatagaatttagacttttaaaaaaaccaaaaagtaaaatagaaattagatttttggaaggagtgagtacagttacgtgaggcttgcgtaccatcaaaagcacgacgataacttggtttgtaattggaattggcgggccgccttccttctggagcctgagcaggtcgtccagagagcatgacttgctctccaccgccgccgcctgatcgccgccggtgtccgtctccatttggtccttgcgttcctggatgatctgctctatgatgcgctccatcttcttgcggttcgccagcgcgctccgcggccccatcgcgaccatggacgccagcttcgacaacgggaagaggtcggcgatgctgagcccggatgtctggcgtaccatggcgtgcagggcggccaggtactcttcccggtgcctgcaccggctccccacggagcaccggagcacgatgtcgttgatgagcctggctcccatcccggtgaggttcacggcggcacccgatgcggcggcggccgacacgtcgcgcacgagccgcgccacctccacctcgcggacgcgccggaacgagcgcacccgcgccgcggtcaggagctcctgcgtgagcagcttgcgggagctggcgccaccgctcgccgtatggggccggcacgacgtccctgccgccgaagctgaacgcctcggtggcgctggtcaggtggcggtcggcgaacgccaggtcctttctccggaggacctcctgcgcggcctccggcgacgaggcgaccaccgtgggcacctcgccgaaccagatctgcatgacggggccgtgcgccctggccagcttccgcatcacgccgtgcacgctctcgctc

SEQ ID NO: 59412 - DNA, 10869 bp, Oryza sativa
cccccccccccctctctcaaggcatactactacctttaacaacaacatcgcgtgttcatcattttgtaatcgctccactttgctgcgatctcggcgaacgattgatctggctggcttggtacttcagtccggttcaagtgaggttcgccttcaacagagagaaagtcgagccggttacaaaccgacattatactgttgtagggcaaaaaccctaagaaagaaatataaaaagacaagaacctaggataagcctactccctcccttaaaaaaacaaaccctggatatgaatttggacgtacaactggacatgatgcatgtacaaatttatgctcagggtttgtcttctttttttgagacggagggagtactctatttgcttgaacactcctgcctccctccaagatcaaaacttcgggtgtgtttggttgtcggccacattttgccacaactaacgttaggcaagttgtggcagccacaaaagtgtggtggataaattgctagccacaaagtgtggcaaagtgtggtggataaggtgccgtcaccacgcgcggtgtttcgtgttcgtgggcgtggcaacgacagacaaatcaatagcctggagatcaacggcaaatcatcaaacctataggaataggattagtccaagcacagcttcatgctccgggccacttacgtgttctgagtcacgattgataaaggctcaaaactctgctcttaaactcaaagtcacgatatgtcaacaaaccgatctgttccggtcggattcggttttcggttccacggaactagccgtgctgccgtggtgacggaatatgcgtcgcgcgagttttaatcatttcttgctgttccacttgtgtccaataatccgtttgacccagcttctgctcttgcctctttgcgagcactgcaaatgtttcggtttcttttgcggtttcgggtaattcgtatcgcgtcgcggccgtgggctgcaggtcgttgtcgatgcttctaaatacttgactttgacaatcacctcctccttcagtccttctcatggcagcagcaacagtgcaagagcgggttcggtttgccactgttcgattcggttcggtttgcggttttttttgagaattaatattatttttatggaaaatcgcaaaagtagtggccaaccggggaaaatcgcgaaagtaggtccctgtcgaacgggtgcaattcgatagggcacctatcgaacgacgggcagtcgacaaacccctgtcgaacggctggcgttcgacacgctcacctgtcgaacggagggagttcgacagggcccaccacccggcgccgcgaggcctgtcgaaccgggggcgttcgacagggccctccaccgaccctgtcgaacaatgggcgttcgacaggccggtttaaagccccgtcccccaggccgcgagttcgatttgttttgaggaccacatcgccagccgccgccgagagtcaccacatcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagagttatttaagtaattgtacggttaaattagttcttagttagtacatattattgatatgttgtgtgttaaaataggtagaaaggtgttatattttatttggattattaaactagttgtttgttactaatagttgtaaattagtacacggcaatatagtataagttgtaatagggtaattatcgaatgattaaatgattaaacgtgagactatttgtcatgttttatcaggatgtcaggtgatatgcccattcgtctgtattatggcgatgctcctatataaatatgtgatagcggggtggatttgactgtatatgccttccatgatactagtctgaatgcaccggagcatatgggtttgaacgacgtgttagggtggttgtataatatgtttggggtagatccaatgcacgataaatttgtcataaatgccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgagggaaagaagtagtagagggtaatacacaaggagaggtcattgttcgtggtactaatcgtgaggccaatgactcggacgatgaagaaccggattcgcctatgcgtgttgatgcagcggaggagaatgaggcggtagtggatcagatggaagtggaaaacgaggaataccttgcacttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttagagagtgcatggttacaagccacaacatgacactttatgggtagcttcgagggttgagcaacatacgtgtttgttggagaatacccgtctggtgcacagaaacctgacagcggcatttgtgacacaaatggtatattcaaaggtggttagaaaaacatctttgtcccctttcaccataatgcatgacgttgagaaagagtacagatatgagatatcgtacgacaaggcttggagggcaaaacagaaagcattggagatgaggtttggaacttatgaggattcttatcacaatcttcccccactattggaggtgatgcaggcaagaaacccgggcacacacatggctattctcgatgaggtgaatgaatatggggagaatgtttttcgtcgggctttctggtcatttgggtgcatgatagaggcctttagaaattgcattcctttgctctgtgttgatggcactttcatgacaggcaagtacagaggaacaattctaaccgcgatcggagtcaacgcggatagccatgtcgttcctgttgcttttgcatttgttgaaagcgagaacacatcaagctggctatggtttttgcggcacattaaaatgtgtgttgttgaaaacagaccaaatgtgtgtgttctgcatgaccgacacgccggtttgctatcagcgatatagaagcttcaagaagatgtcacacagttcgtgccatggccagatttacatagcagatggtgcatgcgacattttggggctaatttttatagacaatttaggagtaagagattgatggacctgttcaagaagttatgcaagcagaattaacaaagaaagtttgatgccatatgggatcaactggatcgtttgaccactacacacatggaagaggttaggaaaaaacctatagttgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagacggattgaggtatggtgtgatgacaacaaatcttgctgaagtggaaaactgggttaataagaaaacccgaccttttaccatttgtggttatcttgaagggcatcccaaggggtacacagaagtatctctgtaaaaggtattccatggctagtctgaacctcagcaaacctaggttaagtatagccccgctattacacagtacatgggatgagaaaagtaagaagggaggaatccacagagtgtggcctgctgggaatagagagttgttatttgagatacgacttcgtgacaagagtggtgtcggcattgggactactgacatcacattggaatgcacgttgtggccagagtatcacgcttgcaaatgcaattgcaacaagccttacctgttacatcggccatgttcccatgttcttgctgcttccgcaaaagggggtgttgatggaaacatttttgtttctccctactttagaaaggaatcgtgggaggcaacttggcgtggtgaattgcgtggttggcgtgccgtgtgcgatttcactcgtcctcctccagggcaagctaattaggttcctgactcaaatttattagttgatactaagggtcgtcgccagtcgcgcaggatcaagaaccttatggatgaagctgaagtgaaagatcgttctcgtcgtaagaaagcttgcattctttgcggggagaaccattcccgtaaagattgcagcatgtacaatgtagggcaagatgccacaggcgctgatgttcgtcgcgttccaaaggggaagtcgaagaagaaaaataattcttagttcgctattatccttggtggactccctactttgaagatcgttatcgttcaatttatgtttagtgcgtctgtaattttaatttgaactttcttgcacttttattacccgaatctatttgtaatggccttgtaattttcattttgaactgcactgcacttttaatatcgtcatgtatttgtattggaattgtaatttaaatttcgaactgcactgcacttgtaatatcataatatatgtgtcctgggcttgtaattttaaattgaaatgtactgaactgttcttatctgtatctatgtgtgctggtactgtaattttaaattgaaatggcatgcaaatttgttacttgaattatgttgcatacatttactgtactgttaccatacgtgcattgtactaatgtggttttcgatctgcaggtatggctgatcaatatgatgggcagctgatagacaaggagattgataggaaccatcgatcgcgacgtcttagtacaggaactttctgcaatgtgctaaagatgcgaggaccggatcaatattggcgtattgatcctctttgggttccaaggtgtgtgaaaatatattgtttttactaatacaaggtgtttatattttcatgtattaataacttgcgctctgtcatgttgtaggctgagagcagctgggttgttgacgtttgcacggttggtcgagccttcacgtgcaaggtccgaacgaatccacattgacgcggcgcttctgagtgctcttgtggatagatggaggcctgagacccacactttccacctcacagttggagagatggtgcccactctgcaggatgtgtcttatttgttggggctgccgatagctgggccagcagttggcccaacaatggtgaatgctggatgggcggatgaccttctggccagttttggtggtgtgctgcctgttgcactggaggatctcacagatgggcacgggcctacgaaaagttggttaaatcagtttcgacaggatgtcttccctgatgaccaggaggagtggatcgtgcagcggcacttagtcgcttacctgttgtggttgtttggatgggtgatgttcacgggaactcacgctgactccgtggacaagtacttcatccactttgcggagcagattgcagagttacctatcgcggagattccacagtacagttgggggtcggcggtacttgcggcgacatatgccggactgtgtgatgcttgcgtgaggaacagcaagcaaagttcactccctggatgcccgttgctacttatgttgtgggcgcacgagcgcttcgacattgggaggcctcagcttgactcgtacgcaaactacggtttgcgagagatgtacaggtctggtgttgatgacatcgacgatcgtcccactatgggatccttgtggacacaccgtgaggtattttttgttaaattcgtttatgttatcattatgaatactagttcacaaactttccttatatgactaatgaaaactactacttgttacagccgcagtgggttagcgggatgacacgtcgtgtctacactcagtttgtagctgactttgatcagcttacgcctgaccgtgttcggtggactccctacactcagcacgatgtcaatgatcgtgcaccgcacggtctcgcggatctttgcacgcgagatatgcaactctggatgacaacttgtcacctcgtggtggacgtgcacgtcgagccacacaatgtccacagggttctcaaacagttgggcatgtatcaggacttccctccgagagatggtcgtcctttggctgatagtcttcataggttagttcacatcacagttgtttaatcctacattttttaaaataaatcactacacaatattttttctgatgtgtgaatttgttgttgtgcaggtactccagaaaggggctcgggctttcctacgagctagttgttgtgaccacggttcagccgacggtacaagagtgggagcacgcagctgataacttggcacttcagacacctccagacgatgggagttattatggagcttaccttcgttggtatcgcagtgttacatgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagtatttataaatgatgtgcaactggttcattatttctaacaaatgtgcatcttgttaaatactcttaataaatgtgcaactggttaaataattttaattgccttgattatttgtggaacaggcggaatttgttgagcacgttcacgtggagtccgacaccatgctgcaaagactagaggcgagacctccagtcgtcaggcctgacgacgtggcgagcatccttcgcaacttccgtgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacggtcgtccttacctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcatttattgaggacttcttgtcacaccccaatccggcaccgccacacaacggcacctgataggagcgtgtcgtaggaaaaacggcgcgaatcgcttcctacgaaaccgcgatctcggtaccagtcccaggacatagtgctggtacccacggtgacaaatatgagtcattgcaaatccttaaaatagatagaggacttatttaccttaacttaggttgcagctcagaacaacccgagaatgcaaccgacgacacggacgaggaaacaccaacaacagcagcagcagcggaaccaacgaactaacacccaacaccacaggcgacggctgggaaccaggacgaaaccctaatcttcacttcactttatcttctcttcagggcggaggaactatatatatatttatatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttgggccgaaaagagacttgcgtctcgattcgactttaagaggtgcttttcaacagctcatttagtaatgtaccgaccccccgggtcagatcattacttctcggctcccagagccattccacttgattaatcggcaaccagagcctttttcattttctcggactcccagagtccagctgcccagcagcacaacagtccgcttccactcgggaagcctagtctatgatgcccgcagacatcccaaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgtagaggggtacactttacccacaagatacgaacttattccgaacacccgtcggtatcggaggttcgcaacaaagcctttcccaagccaacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccgacgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggtttttgaaggcttcacaaacccatttcccaagttttcgacaaacaacggtgtatgtgggatatttggtatacgcgctcagagagcacgaataccgaggtaccacaagggtggagcgacaaggaatcagggtagtaagacctacggaaattagtgcgactactgggtaggtccgtcggtttggcacgcaaaccgaggccaagcaagttaagtgtgtgattctaataatgcaagttgtaaacaaaataataatgacttttcaattataggggcaattgatcaaagggtgacttgccttgctcaagatcttcacaaagcttcacgaatcttcgaggaaacccgcgatcgacgaaaatccgataaccgcaactatacgcaaacaatcgaaaacctaaacaaaggaccaaaagaaagatcctatttagactaattagtagtgccattaaatagatctcaatttacggaattattggaagtggaacggagtcaatcggagttgcgaattgggtgatatgaattttgaaagtttaattggagtttctggaataggagagatgatttatggaatttatagaaataatattctcaagaatattattgacagtcattgaatccgggaccaaggaaaatgattcatggaattttggaataaggaattgatttatggaacaagggtggaaaaaggaaatcaaggagggatgtatactagacttgtttcggtggtattggtgcgacccaaaagctaacgcgactcggccgaaccaaatgggccggcgcgggcgcgaggaggcggcccatgagggcgcgcggggagagagggaggcccgtcggggtgggcgcggtccaccgcgcgggacccacatggcggtggttgggttcacggtggggagggtgcacgcggaggcgggcgctagggtttcggatgcacgcggttcgggcgcggcgcgccgggtggatggatggcggcgggcccacgtgcagccgcacggcttgccgtggaccgcacgcacgggagggaagacggagggaggaggctgactgggcgcgacttgacccagtcaagcgggcccgggactgaggtggcgtccacgtggaagccgcgtcggatggggaggcagaggaggccgggcaggctgatccgacggctcacggtgtgcggcgggatccggcgaacggcggcgagccggaaggggcggctagcactggcggcaggaggaggagaaggggaactcattccacggctcggatcatgaagaggacgcgcgacgacggccggcggcggcggccaatctcgccggcatgccgacgtggccgcgcgcgaggagagcgaagggtgcgcgggctcgggcttagccgaaccggtatggtgttgcgacgcgcacgcggtgacgcgggacccgatggtcaccggcggcgcacgcacggcggcgttaggcggcggcggaagcggcgacacggcgcggagacaaaggagaaggccgacggccttggggcagccagggggaggtcaaggggatccccgggagcgtggcggcgagaggaatcgacgcgagaggagccgacgacggtggattgcggcggcggcaatcaccggagatcaaaagggga

SEQ ID NO: 59413 - DNA, 9524 bp, Oryza sativa
ctcttcaaatgtcccatcggagcttaccagtgaagacacgacaggtgcaaatcgcaacgccctcccttctctcgaatgtcttgatattgcttcttgtggaattaatgggaagtggctatctctgatgctgcaacatgcggaggtcctacagaaattgagtataacctcgtgttggcagataagagggctatcaataggagaggaagaaaatggtcatccaaatcttatgtcagctacagaggcttcgtcgtcaggatatccaagtcgagacgaacttttgcaccttccattaaatctcatcccatctctgaagaaggtaactattagattctgcagtttaagattttatggaaacaaggaaggtttcgctagatttaccttccttgagggcatagcaatttcgcgatgccctgagctgatctcgtccttggtgcataacaacagaaaggatgagcaggtgaacggaagatggctcctcccgccatcaattgtagaacttgagattcaagatgataattatctacaaatgttgcagccctgctttccagggagcctcacccacctgaaaagactacaagtacagggaaacccaaatttaacatctctgcagctgcattcctgcacagagctccaagagttgataattcaaagctgtaggtcacttaattctctacaaggcttgcaatcactctgcaacctcaggttgctgcgggcatacagatgcctcggcgatcttggaggagatgaaaggtgtctccttccgcaatcaattgaggaacttgatatcgacgagtattttcaagaaactctgcagccattctttccaaggaatctcacctgcctaaaaaaattacgagtatcaggcactacaagttttaaatctctagaactgatgtcatgcactgcactcgaacatttgaagattgaaggttgtgcatcgcttgctacattagtgggcttgcaatccctccacagcctcaggcatttggaagtatttagatgccctagcttgcctctatgtttggagagtttgtcagggcagggctatgagctatgccctcgattggaaaggctccagatcgatgacctctctatccttactacgtcgctctgccagcacctcatctcagtccaattcctagagctttacggagatccatacctttacattcgtggagtcgaagtggcaagactaacggatgagcaagagagagcgcttcagctcctcacgtccttgcaagagctccaattcaagtctcatgacagtcttgtagatcttcctacagggctgcataaccttccttccctcaagaggttgaagatcgataattgcaagagcatcatgaggctgccagagaagggtctcccaccttcgttggaagaattgcatatcagcaattgcagcaaagagctagctgaccattgcagaatgctagaaagcaagctgatggtatcaactgattgatgatgaatatgtggattaattattgggtggcttgataagcacacctttttccaccagcccaaatgataccggcagttcggcacacacctttctaagctatacatttaggagtaagtattttctgttaagacgttcaagctgctatacatatcaccgccgcagtgacctgttcaggaccatttcaaggggaaaatatgtaaggcaaattatatatgtagtgaaaacgtgaaaactaccgttggatccataaatggatgtttgatatttgtccatgtcactaaaagtaaaaaaaaaaaaactcccagattcaactatgagtaaaaattttattgggagtaaaatttgtactattgatgatatggacaaatattagatgttcatttttaaatccaacaatagtttttaggtttcctctgtatacgtggttggcactgtatattttcctccatttcaagtgccatataactacatgttgtttctctggatcaactttttttaaggaaaaatattgtaggagagtatcctacagcgtgtgtgtccatatagtaaatttgtttggtgctccatggtgcctgggcaccatgattgaaattgagtatatacccaattcaaatgagtatgaaatttttttaaatgtttaggtattaacattaactactttactaactagttcaaaacaagtttgaactgaatttaaacatgtttttgttagattttgaatctaggtatatagcatccaaacataaaattagttaggtatgtaagatcattaaaattgtatcttccatatcacatccttctatattttaataatatcttccaactaactttacatttgtatttgaagggatatattttgaatgacttaatttaacggtgttatttatcacgataatatttagaaatgagtaaattttaacggatatatttaaaatgagtataaaagcaatgcaagtaacatctactactatatttattctctactagtactactgctgaactattccttctctcttctactagtactactactctacatcgagggagcggtggcgaggggcgggtcgggcgggagagggacggcgacggcagggccaggcgggtgaggggcggtgatggtcgggcgggcgaggggcggcagcggagcggacaaccggagagggcgtgggagaagctacgagcggcaacgatgcctgggacggcgggggcaaagctgcgggcggcggcgatggctgggacggccgagcggcgggggcgacggcgggcgcgggcctctccgccaaatccgctgcctttccacctacaccagcgatctccaccgcgagttccggtacacacctcctttcttccgtcacttccagtagtcttgatggtggcataagttggattggaacatgggtagttggaggatgacgtgaggagagagaaccgccatatttggcttgtgaaggtctccgtttggaggacctccaaatatggcgtgtgtgatggagcctctgctggcccctttttccccttctatacgccaaaaatgggatggaggacgggatagcgctactgctggggatgctctaagagacttgctccggcccggtaccaaatcgtttccaaacgttggatctaactgggcaggatagatatttttagatccaacgattggaaacgatttggtatcatgaggtactgatacttcaaggtactttttgatggaccggagcaaatctcaacaatacaactgcattgagaagaatagacagccacttcttcagatcagaaagcctggtgaactaccagtcagtaaatggctaccgtaatctccacttttcacttatatgtacaaaggacacctgcactatcagaacacccacaaagccagttcactcactacaaactatcttgactaaatccaagcagataccgactcctcttaggccttgtttagatttcaacttttttcttcaaactttcaactttttcgtcacatcgaacttttctacacacgtaaacttccaacttttccgtcatatcgttccaatttcttcaaacttccaattttggcgtggaaaaacacacccttaatcaacttacaaaacaccaacactttggtgtatccacagcaccaatcacacaaggaaatttaccatccacctactcgtatcctactgttagattggccaccttacaccagagaaagggcattgccaaattctgagacgctgtcctttgagctccccgaatctgaacaaataacataaatcagatagaacacaacacaaaaatttccattcatcaagaagttggttgttctaattataaagtggcagtgatgaggacccaccgctcgcgacctcagtatccttctcaatctccactgattggtaagttgctgttggcatttttttcgccgggccggcgaataaccggccgatgtatattaagagaaagagttgctgttggcatttcatccccgatatctacatactcatccaactgctcggcctgtgtagtgatcttgtcaggatccttgctctcctgtaaacaacaaaacacattaaccattataagagctcatttcacacataagctaatagcaaccaagaacaaagcatgctgcttactattgccattgccacgtcaccgttgtccaccatcgtagcggtactgccattcaccagcacataactatcattagccacggaagcatcaatgacatcggcattttcaccattaacaatggcagcccgtcgactcttgttgagcgccttcttgaagttgttgacgaatcgatcaagctcccactgtgtctcgacatccatctcatcaatatccagctcgatctcacccccaaccagctcaggattgccgttcctcttccgcacaatctgcagcacattatgcatcttcttctctggcaagctctccaacccaaccctcagcaagttcttctcctccagggtaatctcccacttgatgacggtgtggtagtcgtggagcccgaggcggtcgacctccacgggggcgttgaaccagatgctccgcttgtccttcccgcagcgtcgccaggatctggtcgcaccgcttccgcatcgccggaaaaggatgtttatctgcgaaaaaaggatggttttgtattctaccgaaaacaaatcaaccatcataagaggcgacgaactgtattttacctcccaacccagcggcgaggttcggcttccccgtggcgagatccgccgttgaaccagatgccccgcccacttgccgttccgcagcttcggcgggatcccggccgctccgcttccgcctcgccggcttgagttccggcggcggcgggggaggtgaggcgacccatgggtagcgcttcggcttgaccctgctgctgcgacactgacgaggcgatgtgtcatgtgcgcggacaaggccgaggcccaactcgcctgcgacgtactctgcgaggcccataagtgttcgtttggactggcagtccattacggacaagaaggccgacggcgcgcgcgatacacctctttgtcttccccgccttagaataagtccacctgaactcccttaaacatacataacaaatctaatccagattccttaatcgcaatactacatatcttaaaccctcgactgtttaagccgatgcaaaatgactctcttcggtggttttgagaatggctcttgctgacgtggctcgttgtgagtctgcacgtgggggctcacgttatcctcttattcccttcttcctctttcctcaaacaacccctccccggttttgcacgagatggttttgctatctcgcgcgcacggcctctccacgcgcatgcatgaatgtgtatgctctttttctttttttctccatcttaattaattttgggatatattaaaagtatcaaaatttctattaaaacttaatttaaaacttttactccaaaattttaaattttgagaattttaaacttttaactcaaaatttaaaattttgaactttaaaattcaaaattttcaattccaaacttttaaactttgaactatttttttaaaaaaaataatgctaattacgataattaatactccctccatctatttttgatagtcatatttccaaatctgaaaaatttatttttgataggcatatttcaatccaacaacttatcatcttaataactttcttagatttaatgcatgactcttcattcttccatacatgattggctacatggacattgagaaatgtaagtattaatgaatcgcttatttacgaggaatgactagtagcatgtttaaatggatgataagtagaattatttatccttggtctatgtgtcaagatgaaatatgactattaaaagtagatggagggagtaataattaccgtaagtagcagcgcaggggcgttttgcacgatgagtgtgggggaggggggtgcgcccactgtgcaagttaaacagttggctcacacgcgcccattagagcaagtctaatcttaggctataaactaattataagcttatatagaagagagagaataaaaaataaaaagggttggctctcatgcataagctagctattcaagaaaaatacattaaatgcgcaggtgatagataaagagaggagaaaaaaataaagataacattatagctcatttatatacatgttaacttaaatataagttataatcttataattggatctagtattaaacttgacccaccaactcctcctcagcagcccatgtctggccggttcagcgtgctcgggtatactcaacatgggtgaggcacgacgacgggttcagcaatgcactcgagcagtcggagctgacacttttaggtcctggttggcacagctccaagcactagctctatctctcctggagctggagctcagccaaacagtttcagctccatctaaaattagagcggagctaggtggactctctcacaaaataaactagtaagttggagctgggtttagactgctccacaactccactacagaccgactccttaagctaaaattagcagttgtagctctattaaaaatgcgaatattaaggaatgatctaatatcaaataattagaaggggtgaggtttcgaacccagatcatctagcccaccatcttatagagctagttggaagacccctgaatgtgtttctgttgtagctctattaaacaagcccttagcagcatcttgtgattcatccgtgtgtttctccggcgcgtcgctttctgtttagagaaaaccgaatagctcgggttcggattcggttcgaggcgagggaaggcttaaaatcatttcatgcacacacagctgcccccttggcatttgcgtgcactgacacgatgccgtctgtcctacacgggttggtagtatgacgaaaggctgcggaaaccgatccagaaaattaaaccgtttggatcattggtttttttgactagtagccatgaaagtgaaattgtccgaaaaggataaaagagttaacgacgtcggtcgagctcaaagctctgcgctcaagaatccgagcacttcgggtccgggttcggttgttcagagtaacttcatgcccattgcccaatacgttgtcctccaccagagtgcatgtgagcagtgatgagcgtcattggagaatttggccattcgtacttcgtaggttgctggcgtcggcgagcgcggcgaaacccgaagcgctggttcggtttcggttaatccgtttcgcggtcgcacgcggacacggccatggtgccaggtcggtgtctcccctcgctgctgcgacgcttgacttgcttattactactattcatcttgtcgttgcagcagaacagcaacgtgcattcggttcggttttgggatctttttttcctgccccttcgctataaatacacggcatgaacactgaagagctcacccatttctcgacgctcacaccagctagagccaccatttctctcaacgcgagacagcaattcgcatacgctaggagatggaggtcatggcatccctcgtcaacatcttggcgctgatctccgaggcatgccgcagcgcggagaagctgccggcggcgctgatcactggcggcgtcgtggaggccgcggcggcgatcttcgtcggtgtgttcaaggcgcccggaggcatatttcaacaccacggcaaggcgccattctacctctattacggcatcacaggaggcgtggccatcttcggcttcgcggaggcgtgggccgggttctgggtctccggcgacctcaacggccggcgcgccgtcggaaagacgatactgtgggtgtcgattttgcctctcgtcttggtggctgcgctcggagggttcgtcttcatgacatagttgcaaacctctgtttcctctgtttgtacgagtgtgtgtaatctcctgtacctctgtgtgtatgcactactactagtttgtacctttgcgtgtaatccataatgcttttagtgtacttatgatattttcagttattatgtgatgtagcagtgtgattgttaacttttatgaggttttatgtatcatacatgaggttgtttatgttcttttatccatgttcctaactccctccctcacgttcttacatgtatgtttcccaaactattaaatggcgtattttgtctaaatttttttatagaaaattactttaaaaaacatgctaattcatttttaagtttttctactctctctgtcccaaaaatataacaatgtttaggtgtattcatagtattaggatatgttacgtccacccagaagttgttatatttaaaaccggagggagtaccatgtaattaattatgtgctaattcatcccatcgttttgtgtgctggctcccaatttgcatgtttttcttgcatttttctagttatgaatgttgtgcaggtctaccttttttacgaggatttcctccaacttttgtttgtctttctcgaaatcatagcagcaatcaaccaatcataatctaaaaaaaattcatggtagaaccagagcaaccaactactagtacgcatttgaaagaacaagcgtttgcatggtgtaggctgcggtgtttcaagcatattgaagaaatcaaacttgtcaggtctttgatggctcgcaactagtagttctcccaaaagagagagaagaagaagacatggacatgcggattaacagaatgcattagcatctcgaaaaaaaagacagaatgcattaaaataaagctgttcggttccgggttcggtttgtgccttgcagtactccagtagttaatcagcggagagcatgtatttttcatcttggtgggccccactgtggataatttttgtgcgtctcttggttttgtttgcaaagaaaccttgcgacccggttgcaggtttgggttcggttcgacactttgcttttgcacaggcgtactgcgtacatgtgccttgagaatgtctctgtcaatccgatttgaaaataaataaataaaaagatgatcctagtgttgttgagatgaaaattgctaatcggcaccgttcgggttcgggttcctgaaagcaatgacgtctcaaggcggaaaacctaattggcgatccatcgcctcgggacgggggtagcgattaatcccccgccccctcccttcctccacctggtttccttttttggcaccacattatttttctattttagtaaatttctatccctaaagtttatacacctcaagtttacacatctaaagtttagacccaaagtttacacatctaagatttagagaccaaaagtttatatgtcaaaagtttatatatccgattcaaatttgaatttgaattcaaatattttctatatatagtatttctatacatctaaagtttatacacctaaagtttatagacccaaagtttataagtcaaaagtttacatacccgattcaaatttgaatttgaattcaaattttttaatatagtatttatatacataaatttttctaatttttattttttaaaaaaaatttgtgtggtgtactgtaataggaagagaagaaggggaggagaaagtggggagaggagggaggagtgtattgagtatagggg

SEQ ID NO: 59414 - DNA, 9861 bp, Oryza sativa
cctgcacccccatcctaaatgtccccatttgcatgtccacaatcctctgccgccttcaactaatgtttcaaaattatccatcaccggagtttcaacgcttccaacggttgagtggtccagaggaatattaagaatcggggttctcgatgattctgatgatccttcggttattgatgagccttctgatcagctgataacgctagacgacaaagtattgtcattccataacctgaggttcctaactgaattggtaatagcaggttgccaaaatctcacgtccatttcattgcaaggtttgaggcaactcatatatttgaggactttggaaatacgcggctgcccaaaacttttctcttccaatatgccaccagagcttgtacgtgagaacatggcagctacatatcacaatgccctcccatctcttgaatatctctttattgctgcctgtggaataacggggaagtggctatctttgatactgcaatatgcgcaggccttacaggacttagatttatatgagtgcgagcagataacagggctatcgataggagaggaagaaagcagtcaaccaaatcttatgtcaactccagaaactttgtcattaggacatcaaggtgactcgccaacaagctcagctcgagatggacttgtgcgcattccgttaaatctcatctcctctctgaagcacatatatattggtgactgccctggtctaacatataatgggaacgatgaaggtttcgctaaactcacctcccttgagagtctacgaattatgaatggcgccaagctactctcgtccttggtgcatggtaatggatacgatgagcggaagaacataaagctcatcccactatcacttgaagtactggagctcagaggttatgatttaccagaagaagtggtgcctgattttctaaggaaccccatccgcctcaaaaaattatctgttatggacactttaagtttaaaatatctacagttgcaatcctgcacggcactcgaagagttggagattgtaaactgtgaatcgcttgccacactagagggtttgcaatccctgcgaagcctcaagaatttgattatatggggatgccccatcttgccacaatggttgtggagttcattagagcaggtccaggagcttttgcctcgactggaaaggctcaagatcaagacgcctctgtccttaccacatctttctgcaagcacctcacctccctccaacgcctaacgcttttcgcttgcaactgggaattggtgagacaaacagatgagcaagacatcgcgcttcagctcctcacatccctgcaagagctctcatttacgtgttgccgcaacctcggagattttcccgttgatctgtacagccttccctcactcaagaggttgaatatctattattgtaaggacatctcgaggctgcctgaaaagggcctcccaccttctctagaagaactggatatcaatgattgcagtgaagagctaaatgaccagtgcagaatgcttccaagcaagctgaaggtcaaaatcaatcagaaatatgtgaattgattactggatggcttgataacatgatggaatagttctatcttccatcatgctatcttcagacttgacgtgtgcttagtgtcagtattgaactaagcattctgtgttcaggcattcaagctgctatacctatcactaccgcagtgaccgctttgaattggagtaccatataactacaagctgctttacttggaggttaagatgatccacggtataaaagggaccccccggaagggtcgcaaggcatcgaatcttattgccaacacacccacacagcctacaaagccgaagtacgcggagccaactcaccgggaggtcttgttgaatacatcgactacgatctcgtcgataccatcgatttcgtctacttccattgtaatctgtgattttccatcatcaatcccatataaactggactagggctattacctgacaaggggcctgaaccagtataatctctgtcttctgtttgcttgatgtcgtattacgtagatcctcgttgcaacgtaccccaataccctaattatccggtctacgagtatcactcgtcgacagaagtgttctaacttcttggcgtccctgtgttctcctgtggattaattatcgcagagctagctggctttggttaacctggcgaaaaggccaatcatgtggttcattacagagaagccagaagtatcagatattggttttcacgtgccaaactctgcactagcattgtctcaccttagaaccccatcctaatgttgttttttttgtaatcatgtattgttacggtgtttcgtattttaatctgtaattctgcgctatgaacctatactatgacttctgttgtactaagccagaaatatccgcaatgcacaagtttttgttttttttggtgaacttgatatctcaggaagatgaacagcgtcgcagatttactagtagaagtctaaaccttgtcagattacctgaggttcgccttccccatgcgcacgacttccactgagggcaggctgttgaaccagatgctcggatgctccggcttgtccttccgaagcctcggcaggatcccgctcgcaccgctgccgcatcgccgcctggatcctcggcggtgggcggtggcgggggaggtcccgtcccggtgaggctggctctgatccgggcttccggcgactagtcgtcttgtcgatgcggagagatggatagacgagagcgaggacttggcccatctcgcccgctaggcactccgacatcgagcgggcctcgtaccaggcctccgctgccggccttccgaatgggatggcctggtaacaagatgggccctgtcgggaaataccatgcaaaactcggattttttaaaattttatttattattaaaatatttacaacttttttattttaaagttttacaaatatgcacctctaccgtcggacttttttatgacgtggcacacggccgttgacatatgctaacgaccatatggaaggtggcatgtcattttgcggacaatccttttgccgtctttccaaagaggtgaagggggccgcctacaaaatatctagggcttttgttataggcagctcccttatcgccctcctatagagctacaagggaagcgcctacaaaatattataggtctctattttataggcagccctcttgttgccctggctgcctgtaaaatgaccggcgttcctccgtgcgaccgttacaacacatcaacgaatgtgtcacgtcataaaaaaaaccttttgagagggtgttttctactaaaggatggtagtggtgtgtgaggacgtcccaaagtctaggtggtgcaatgctccaaggcatgtcagcgcgaaatatctggatggatggggtctcaaataaagtccaaataaatacggtaaccatccaacctcatcgcagaccccgacatgtcttgaagagtgcactacataggctctaagccatcggatatgaaatagaagacaaccattggaatagccacaccagtcatctatgtcatacgcccgtcaaccactcaatggtggcgaccaaaagcgtaccccagagactcgatctcaacaaagacatattccccggttatctcaaccatttcaaacccatcctcatgtgggactagttgcccaggaatgcaacatattctcacataaatcatctcaagcatgatatccaaataataagtggttctaagcaataagcataaataatcttaataagtttctaagtagtacttggcgacaagccataaatattggttcatgcggtaagcgtgctacccaaaagcccataggcaaatcgactagggtaaatccctagttagaaccatcctggaaatctgcaacatcacaagctgcatcaaactccccatccaaacagtcattacctgcagcggggtctgagcataaacaagtaaaagaaagcaagaaatcagtacattaatcaaattaatgtactggcaagtcggaaaacaatcctagcatactacatgttggccatattcaaagataagctgtgtataggttaatttgcataaatgccaattttagttcacaacatgtttcgcaacgaaattttataacgatagtatagagtaagtaaaacttgtaatgtgaatgaataaataacacgcatctaccccttaaggtagatcatcaccactctccatcatctcatcaccatttaccgaactttacccaagtttacaaacaaaacattccaaccattttcaaaacattacaaataaggaattttgaattatattttttttacgaacgttattttgaattattcagattcgtagtaaaagtgatatctacctaacatctcttatattttattttagggcgaagaaacttgtatatagctcttctgcttgccttctccccgaaaacccccgatcctctctgtcttgtgcttaccgtcgcggcgtcggtcgccattatcgcccaagcgttgcgttgctccttttggacggttgggcctgacaaaggacaattctatgaggattatctgggcttgcccatcaccgacctaactggactagcccatcaaccagaagaggacgactcctccgtcaaagtcggtagccaccggggtcagctagcctagcgcgtcgtcgctgcgaaccgaatagctgatgaacattgctactagtctgctagctactcgcacagtaatctgtcctctccttgtacttaattcctcgcacagtaatctgtcttccacttcacctgctagtccgctttccccatcctcttgtcgtgctcacacggtcacgccatcggcgatcgccgatcgaggaactgcctctgttctgccggctgccgcgtctgatggaggaggtggaagccggtttgctggagggcgggatcgggtggctggcggagaccatcctggagaacctggacgccgacaagctggatgactggattcgccaggttgggctcgccgatgacacgaagaagctcaggtctgagatcgagagggtggatggggtggtggctgccgtgaaggggagggcgatctggaacaggtcgctggcccgatcgctccgtcgtctcagggagctgctctacgacgccgacgacgcgatcgacgagatcgactaccacaggctccagcatcaggtccaacgaggaggtaaagcatgtatgcaagacatacgcatccatttgcagaaaatctaattgttgtattctattgtattacatcgactctctcatagagtatatataaaaatacatagaagatttatctctaggactctatatataggagtacattgaagtacaatacaagagtagatttatatctaggactctattttatctttaggattatatcttatctctataatttatatttgactcttatctctaactatatatctatacttctaacgccatggagcacggcgtacgttgatttccagatcccttcctcttttacatggcatagtttactttttggttcagatgcatggcacggcgaccctgatgaaagcgcggatgggcatggagcagagcaaacagggagacctcggaggggcaaggttggtgaagcgagcggcagcggtggcaaaagacggtccgggatatggcagcactttgagagcgtggaaaataatgcgaaagccaggtgtgtcgactgtggcacggtggtcaaatgcggctccgacaatgggacttcggttttgcacaatcaccgcaaaagtggcaaatgtaaaaggacacgtggagcaactgatcaaccgccaaaccctccgaggtggtagtactttaaaaaaaaactagaatcaatcaattactgaaaactcaaatatttctcctaaaacacagatcatgttcttcttgtagtgccagcgagggcggagcaaattcatttgcagctggtaattcagtcggcagaaaaaggatgagaaccgagggtgcatcagcagacaacgtggctgctagtatgcacccttggaacaagactgaactttccaacacgatccaacaaatgactcatcagttacaagaggccatgaatgaggttatgaagctacgtggatcggacaattttgtgagttcaaacttccatcataatacaacttctgattcacgcctaaaaacatcgagccttctccaaaggaaaatgtacggtagagttgatgagaagaactccatcataaagatgataacagaagccaaatctgatggtgtaactgttatccctattgttgggattggaggtattggcaagacggctctcgctcaattcgtatacaatgatccagatgtgaaaagtttatttgaggacaaaatgatctgggtgtggctgtctaacaactttgacgaagagcaactaacgagagagatgctagatgttgtctgtcaaaaaaaacaggaaggatcatgcaacttttctaagcttcaagagatcttgaaaagccatatgaaaccaacgaggtatctacttgtattagatgatgtctgggatgatatgaataattaccgattgaacaaattgttggctcctttcaattctaacaatgcagagggaaatgtgattattatgacaactagaatatggtctgttgcaaaaaggattggcactgttaaaccaattgagttaggtgctttggaaaaggaagactcctggatgttattcaaacaatgtgcatttggtgatgagaaccacgaactatgtggaagtctaagcatcatggggcagaaaatagaagataaattagatgggaaccccttagaagcagaaaatattggagaactattacgtgagcatcacacagttgagcattggaataatattctcaagaccgaagactggaaatccatgcagctcagtggaggcatcatgccaagtttgaagcgtagctatgatatgcttccctaccagttaaagcaatgtttcttgtattgttctcttttccccaagggttactctttcagtaaagaacaactgatacaaatatggattgctcaaggatttgtagaaaaatccagtgagaggttggagcagaaaggtaggaaatatctagctgagttggtggactctggtttctatcagcatgttgaaagaacatcagaacattttgttatgcacgatcttatgcatgatttagcaaaattggtttcacaatcagaatttgcaaccatagatgggtcagagtgcgaagagctaccatcaactattcgtcatgtgtcaatattgaccgattctgcatacaacaagtatgaagatggagatttttctcgtaatgaggagtttgagagaaggttgctgaaagttagatcaagaagtaagttgaagaccttggtatttattggggaatatgactctcattttctcaaatccttccaagatgctttcaaggaggcaaaacacttgcggctgctgcagatcacttcaatgtatgctgattttgattattttatttccagtttggtatactgtacacatctccgttatctgggacttgagaacgagacccagcgaactttgccccaagctctaagcaagtgttaccatcttcaagtactacatattggctcatgtggaactcccaatatacctgaagaaataaataatcttgtcagccttcagcatcttgttgcacaaaagggagtttggtcttctattgctaacattggtgaaatgacctcacttcaggaattaacaaatttcaaggttgagaattctattggctttgagataacacaacttcaacgcatgagcgagcttgtagaactgggtgtgtctcgacttgaaaacgttacaactaagcaggaagccagtggcgcaagcctgaaagacaaacatcacttggagagactacatttgatgtggaagggtgtacggaatggatatgacagtgacgggaactacaatgaatacgacagtgatttgagctatagtgacagtgatatgaactctgaaaatgaatgcgatggtaacatgatacccgaaccttctatgcactcagaaacagaagaggagagactgcaaacgactgatagcaatgatgtccctagtttagatcatattccagacacagcaagtgaggtgcttgaaggtcttgaaccacatcgcaacctcaagtatctatggatatcttggtacaatggagctaaagcaccaacttggcttgccacttcacttacccatctgcaaacactccgtctagaaaattgtggagaatggcaaagactttctttagaaaggctatcactacttagaaagcttgtgttgatcaagatgaagaatgcatcggtactctcaattcgttcaccggaggagattattctaattggaatgcaaaagcttcacactgtcacttttggagagaagatagaaattggggatttcaactattgcaattgacttagctcaaagagcatataaatatgtacaagagaagtagaaatgtctataataccctcaatactcttaacacccccactcaaatgcaatgtgtatgcaataacattgcatttgaaaggtaaactaaacactagaacacaatccaaatattagcctatctccaaagccttgatgatgtcgtcgaagtgtgccaattctaggatgatgaagaagaaaagatgtatccccttctcaatgaactggaccttggagccttcacaaactgttcttcggctcttcattgattcggagatgttgatgatgatgatgatgacaatggaccttcacaaactgttcttcggtcctttgactgatgatgagacattgatgttgatgaaggtccttcacaaactgttcttcggaccttcactgagtgatgatgatcatgttgacaagctccgacatggagatgatgaagtgacaatgaaggccagctccgacggggaactggtgatgattaaagccaactctgacagcgagttggtgatgtagaaaagacgatgaagagatgaactggcatgactttgacgaattgagggtaagcaatggatttggattgactcgataaattgtagagaaatttgactcaatgatagtagcagacactaagtagtagcaaaagagatgaactggtgcagattcaacaaattaaaggatatgcattggagtattggacttggatggacttgatacgaaatatagtaaattgatgaccaagacatgaaattgatttgaaggcttatcgatagtagcggctgcaaaaagaacaatgacagtagcaggaacccattcttcaatcactaattagctgtaacccagctgcataaccaaagagtccaagagcctcaaatctgctcctatctatcctgttgctgcttgaccatgagcttacacgcaacagaaaaaacaaagacggagagaggggttgatgtggatctgaagttcaggaatagcctgggacgatgagaagatgatgacgacgagcatcggcggctggccggctcgatgggtggacggcagcggcttgccgcaatggacgacgagggcctggccggcggaggacgagcacccgcgacgggggcactgattggctgattgctgctcctgtttgtttgctcattggagatgaactggagaacgacaagctcgctgctgctgccgcttgaagacgagaaagcaacaatcagcgatgacgactgcctttgatgcggcgggcggcggcccagatctgggcgggacggatggcgccgcgaccggcggcgatgaccgcgacttccgccgcgatgggctgtcgatggacttgatgacaggagaacgaggaagtggtgctgctgctagaacctttgctgctgcttttgcttcttctgcttcgcttgctgcttgacgagggatga

SEQ ID NO: 59415 - DNA, 1754 bp, Oryza sativa
cccttttttgatttgagattatttagggttcaaatattcaattgttgcatgtggttctacgtatgaaaaccgcctttaaaaatgagagtagtactagtactaaaatataaaagaaaatcataactttcaaatgaagtcggatgatgacatactttgtatgaaaactgtagcccttgatttgatctacaactttgtagatgaaagtttgtttatttcagatcgtttagggggttcgaatgtttgtttttctatctcatatttatttttatagttaaaatgttctattcgttttttattcccagatctattgttgaattgctttcttttaatttttttaaacgaccttgtatagagacatattctatattaaaattgtagagctcaacgacatctacgactttatgtttgatctttttttttcattggagatcgtttaggggagaaaatattcgttagaaactatatgatacctttacttattataaaaattaaagatgtttttgccagaattttggtacgtcatctgtgtttgattaggttttgagtttgtcctatttctctttcgtatgttttttgtcagacactagcgctaggtcgcagcctcacacgggatcggctccgtttccacgcgaatccgccccgcacaggaatacacaatcactccatcatcctggacaagattgtggtggtttcggcatgggaccaaatcggactgatcaaagtagtaaaagctaatccagcccgtttaagttctggccgagtcatcttcgagacaaatcatcacgcacgagcgaggagtacgcatatcgatcacaggtgaacatatggctgctctttgattagttgaggaaattatctgaatagcatatattattcttagtgataaacatgtcggtgaagtatgccttgcaaaagtgtacgtacaacatcttgaatcttgatgattgtataactaattaaaattgatctctatatctatatctctatctcttctctacttctctatcccatctcttctctatctctactattataaaaatcgaagatatttttaccggttttttggtacgtcatctttatttgagtcggtttttaattaagtttgttcgcttttagaaatatagatctgtgtatgagtcggattctaagttcgtttgctttcggaaatacaaaagaagtcgtataagaaatttctttaaaaaaacatgcataataatttgagataaaaatcgggctcctaattgcagctcatgattttcttaaaaaaatattcaagcgaattcacatagtgtatttcatcccagctaaaccgtataacaataataagattaaaatagtattctcccgttgcaacgcacatgcattttgtctagtatatttaataaagcaacatttttttttcaaatgagcttgattggagatatgctttatatcaaagttgtagagctcggcgcggtttacaaatttttagttgatgacttttttatttgatattatttagagtgtaaaatatgtcttgcaagttttatgagaagtggagtaaataaagaatagcatccaactcatattcacgaagtgcttcatatgtgagatggcaaggggactacgggtctgtttggttgctactttgatggagatttgcctggcctgtagcaagcctgagcaacatacagctatgtttggttgtctccctgaagacttgcctgacttaggccaccgaaaatgaatgcctgacttaggcacggtgcatgcct

SEQ ID NO: 59416 - DNA, 14857 bp, Oryza sativa
  unsure (1)..(14857): unsure at all n locations
tggttacaagccacaacatgacactttatgggtagcttcgagggttgagcaacatacgtgtttgttggagaatacccgtctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaacttatgaggattcttatcacaatcttcccccactattggaggtgatgcaggcaagaaacccaggcacacacatggctattctcgatgaggtgaatgaatatggggagaatgttcttcgtcgggctttctggtcatttgggtgcatgatagaggcctttaaaaattgcattcctttgctctgtgttgatggcactttcatgacaggcaagtacagaggaacaattctaaccgcgatcggagttgacgcggatagccatgtcgttcctgttgcttttgcatttgttgaaagcgagaacacatcaagctggctatggtttttgcggcacattaaaatgtgtgttgttgaaaacagaccaaatgtgtgtgttctgcagaccgacacgccggtttgctatccgcgatacagaagcttcaagaagatgtcacacagtccgtgccatggccagatttacatagcagatggtgcatgcgacattttggggctaatttttatagacaattcaggagtaagagattgatggacctgttcaagaagttatgcaagcagaatcaacaaagaaagtttgatgccatatgggagcaactggatcgtttgaccactacacacatggaagaggttaggaaaaaacccatagttgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagatggatcgaggtatggtgtgatgacaacaaatcttgctgaagtatataattgggttatgaagaatacacgacctctaccacttgttgctatcctggagggcatcacgaggggtacacagaagtatctctgtaaaaggtattccatggctagtctgaacctcagcaaacccagtgttaagtatagccccgctattacacagtacatggatgagaaaagtaagaagggaggaatccacagagtgtggcctgctgggaatagagagttgttatttgagatacgacttcgtgacaagagtggtgtcggcattgggactactgacatcacattggaatgcacgttgtggccagagtatcacgcttgcaaatgcaattgcaacaagccttacctgttacatcggccatgttcccatgttcttgctgcttccgcaaaagggggtgttgatggaaacatttttgtttctccctactttagaaaggaatcgtgggaggcaacttggcgtggtgaattgcgtggttggcgtgccgtgtgtgatttcactcgtcctcctccagggcaagccaattgggttcctgactcaaatttattagttgatactaagggtcgtcgccagtcacgcaggatcaagaaccttatggatgaagctgaagtgaaagatcgttctcgtcgtaagaaagcttgcattctttgcggggagaaccattcccgtaaagattgcagcatgtacaatgtagggcaagatgccacaggcgctgatgttcgtcgcgttccaaaggggaagtcgaagaagaaaaataatccttagttcgctattatccttggtggactccctactttgaagatcgttatcgttcaatttatgtttagtgcgtctgtaattttaatttgaactttcttgcacttttattacccgaatctatttgtaatggccttgtaattttcattttgaactgcactgcacttttaatatcgtcatgtatttgtattggaattgtaatttaaatttcgaactgcactgcacttgtaatatcgtaatatatgtgtcgtgggcttgtaattttaaattgaaatgtattgaactattcttatctgtatctatgtgtgctggtactgtaattttaaattgaaatggcatgcaaatttgttaattgaattatgttgcatacatttattgtactgttaccatacgtgcattgtactaatgtggttttcgatctgcaggtatggctgatcaaaatgatgggcagctgatagacaaggagatcgataggaaccatcgatcgcgacgtcttagtacaggaactttctgcaatgtgctaaagatgcgaggaccggatcaatattggcgtattgatcctcgttgggttccaaggtgtgtgaaaatatattgtttttactaatacaaggtgtttatattttcatgtattaataacttgcgctctgtcatgttgtaggctgagagcagctgggttgttgacgtttgcacggttggtcgagccttcacgtgcaaggtccgaacgaatccacattgacgcggcgcttatgagtgctcttgtcgatagatggaggcctgagacccacactttccacctcacagttggagagatggtgcccactctgcaggatgtgtcttatttgttggggctgccgatagctgggccagcagttggcccaacaatggtgaatgctggatgggcggatgaccttctggccagttttggtggtgtgctgcctgttgcactggaggatctcacagatgggcacgggcctacgaaaagttggttgaatcagtttcgacaggatgtcttccctgatgaccaggaggagtggatcgtgcagcggcacttagtcgcttacctgttgtggttgtttggatgggtgatgttcacgggaactcacgctgactccgtggacaagcacttcatccactttgcggagcagattgcagagttacctatcgcggagattccacagtacagttgggggtcggcggtacttgcggcgacatatgccggactgtgtgatgcttgcgtgaggaacagcaagcaaagttcactccctggatgctcgttgctacttatgttgtgggcgcacgagcgcttcgacattgggaggcctcagcttgactcgtacgcaaactacggtttgcgagagatgtacaggtctggtgttgatgacatcgacgatcgtcccactatgggatccttgtggacacaccgtgaggtaatttttgttaaattcgtttatgttatcattatgaatactagttcacaaactttccttatatgactgatgaaaactactacttgttacagccgcagtgggttagcgggacgacacgtcgtgtctacactcagtttgtagctgactttgatcagcttacgcctgaccgtgttcggtggactccctacactcagcacgatgtcaatgatcgtgcaccgcacggtctcgcggatctttgcacgcgagatatgcaactctggaggacgacttgtcacctcgtggtggacgtgcacgtcgagccacacaatgtccacagggttctcaaacagttgggcatgtatcaggacttccctccgagagatggtcgtcctttggctgatagtcttcataggttagttcacatcacagttgtttaatcctacattttttaaaataaatcactgcacaacattttttctgatgtgtgaatttgttgttgtgcaggtactccagaaaggggctcgggctttcctacgagctagttattgtgaccacagttcagctgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcacctagttccttttcttacataaatgtggaactagttcagtatttataaatgatgtgcaactggttcattatttctaacaaatgtgcatcttgttaaatactcttaataaatgtgcaactggttaaataattttaattgccttgattatttgtggaacaggcggaatttgttgagcacgttcacgtggagtccgacaccctgctgcaaagactagaggcgagacctccagtcgtcaggtctgacgacgtggcaagtgtccttcgcaacttccgtgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtacaaacagacgatgagtacggttcggcgtcgacgcatcacggagtgcctgcttactcccctcgcacagcattcattgaggacttcttttccactgatcctccccagggggaagtagggatggattactggcacgcagcacctcaggtcacacagccgacgcaggagacggaggccggtcaggggccagacgtgacaccacagcaggcagctagagataggcacccccctgataatttgacatatcccactgagcagattaggcgtaggaagaagggaggacctagcaagcgtgcgaagggcactgatcgtccttgacttatctatttgtattaaacttttagtcatttatgttctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcacatacatataacattacaaaaatattttcctttcttacacactaaaataaattacatattattaaaaaaaataacttattacaaataaatggagaacgcgaccctgtcgaactgcggcagttcgacggacatcctgtcgaactgcggcagttcgacagcccagcctgtcgaacgggggctgttcgacagccctgcctgtcgaacgggggctgttcgacaggtcctgtcgaacggcagccttccgatctcgtcgccagtcgcgctctggccgttcgataggcgccctatcgaactgcacccgttcgacagggacctattttcgcgattttccccggttgaccactacttttacgattttccataaaaataatattaattctcaaaaaaattcgttattggccgcctgcacaaacgctgcttaaaagtagtggatgatcttgggtcgtgacctcaggtcattgctccactggtgagtggtagtcttgcagatttagtttgtattacaggtgccatgctgtgtgattcgtgatggaatttcaaacctgcagtttctgtaattgtgtgatgtgttaatttatggatgagaataaatgcaattttgttccgtgataagaatattgattctgttggatttgttacaataattaattgttattcatttcatgcaatttcattttttaatggaaaaatcggatcgattaagtcgaactgactcttttttgttttttttctggaaataataatatgtaggtgccggttctcaaatcttcctcccctcattagcaccactttggtagtgtctgcgttagatccggcagtaatagaggtatgaactggcaccgtttacatgttctgaactggggatcgatcattgccgacgcggtcattttcggtgtaaaccacctgaaaatgcacccgttccgcatgtcaagttgctgttactcttcacacttaatgctctttaagttgttgccacctacctatgcattcatgcctgatggcttcaacaaccaagcttgcatgcatgcctcaacgaccaatgaaattcacgcagtcacacttaccgcacgaacgcaaggtagtagttggtagctctaaccacattatgtatatctatatatctctatatgttcggttgtcgctttactcgtataacttcttatgtgtgttaattatcccatattaatataatggggcacttctactcactcctcatgtgcatatggattattatgcttgatgtcgcacgctccggcgacgtggtgctggcgcagactgttatatgcgatagtagtgatatgtcttaccaaatggagagtgtttgcttcccaaacacaacgcctatcatggattgctgcatttttgttatacatgtcattgacatggcaattttaaataatctggagtgcctctgcggcttgaaggacgaacgtgcattctttgataacggtttatccttacaggatatggttgatttctattccagtagtacttgctagggtcagaatcttagaaatgcccagatcgtcgtcgatgcatgcgaaggtacgtaaaattatttccacatgttacccttttttatcatgagtttcatcctggccttgcatcaatccttatcaccattttccctccctttctttctttctttctttttctttttttgaaactttcatctccaaggaagtcacctttcttctgcttctctattaatttgatcaagcgtgcatcgttttctgtgtaggtagggagcaacatagcaagatgccctcgatgtctcagcagctgcacgaaagcagggtccgggttgaggctagccccgccgattcgccaactccgctggtttccccctgatttgctctttggaataattgttagttggggctggtgatcatgtacctgatcagttttacttgagcagccaaggtttttcattcatgcagtttagcgatcagtcgtttcatgctattattcggttattgtatcctgggctccgcccaatctatctttaatcgttttgtcctcttagattagtggaacctatcctcttaataaaggtagtggttttcaatcattaatcgtaagagatgtgcttctatgctctacaaataacaaacagcacaatttttaaaaaagatgagaggcccaaattagatggtacataattaatagtatgattatgaacatcatttagagagggcaatttcatcattgagggagttaatctccgacagccccaccaaagctcacacttttcctgctcgaagccgtcacaaactgaaaaccactaatcaacaatcacgatcaccattgtgtttgcaacgcatcacaaacacaaatcgttcatcagttcaaacggcgagcccgttggcgcagtagaccttatagaggaggtggggagatgttttgcttccggacacaacacaggtgaagcccatgaagaatgaggatggggccgacgactgccaatgttacccaccctgcccatcacaaacggatggttagattcgatttgatacctcgagacatgttggaccgaagcaaatttctacttaagtactcttggataatttaaatagataaaatgaacctctcaactcatgatgcaggattagggggaagttacacatcaattctctaggaatcttcgcagatttgattcgaatcttggaatatttgtacgtcctccaaagcgagtttgtcaggaagactctagtttaccaaaaaaaaagagtatacataaatcacatgaactattatgttcgtaatttaatcttctgagacaataagcattttaggataaacaaaataattggatcaaaattatgataatcaatgaatatgcaatggcatgtattactgaaattcatagatgtatttctaggtcattaagtaatggggtgaaattcattttccatcctgcaagaggccctaagcaatatatgccaaaacaagaaaggtatccataaaatattttccttgggattaatgattagtttatgcaaatattattggcttcgaaatgaggaatgatttatacttgaaatgccctgttataacgcagatgagcccacgttatgacaagatagcctatcatgctcatggagtgaatttgagtgtctaaacttaggcctggtttagttctaaatttttttcccaaaaacatcacattgaatctttggatacatgtataaaacattaaatatagattaaaagaaaaactaattacacagttaagggggaaatcacgagacgaatcttttgagcataattagtccataattaactataagcgctacagtaacccacatgtgctaatgacggattaattaggctcaaaagatttgtctcgcggtttccaggcgagttatgaaattagttttttcattcgtgtccgaaaaaccttccaacatccggtcaaacatccgatttgacacccaaaaattttcttttcgcgaactaaacaaaccctatattaatgtacctaactttgtacgatagatatgggcggatcaactaatcaacacgtgttgaggtgggtgtttttctttttacaataaaataagttatgggatgaaatctcataactaagtaacaattttgatggtttatgcttttctgccttaggaaaatggcaattactgaaaaaaatttgataatataccttcctttttaatgatttgcatttatatatctgtataagaagaattagcacaaatatacccgtatcgcacgatgggaatacgggagcggtacgtaaccgcagccgggttgttcacgcaggttgaacgagcggcactgcggtcccgtgcactgaaagtgcggcaccgcgtcggtgccgtggtctcggagagctggaacgtggtggcgaggcggtgccgcggctgtgtcctgcgggaccgtcgcgtccccgcagattggtgatgcgggatggcgcatgctcctccaatacatgcatgcttacgtgcatatgctttgcacgagccagccaatggaatgccggctcacaggatgctacagtacgcacgtaatctaacttactgctaatgcatgcatgccactaatcccgagcaaccaatccgcggaactgcgtcggttccgcgcaactgtatcgcggcaccgctagactgacacggtcccacgtcttcaagctgcgccgccggtgcggtagcgcgttcccgttcagcgggaaacgtatgtttcgtatatatgtgtaaaactacaaaaaataatgcatatttcaaaatataattcggcaattactccgttagttactcaccattgaagatcatgagcgtacaacgtaagtaggagaaaaaattgaaccatgtgtatagggaagaggctgccctgctctttccagcttatacaccggattattgaaatgaattatttgctctagtttcttaaaaaaatcttgttctaatgacgtttaggccacttgttttaagttatttataaatttattttttaaaatgttttatttatccacataatcaaattaataatcgatgatattaatatgctcagtaattgtaacatacccgaattctaaatcttaaaaaatttcctatcaaaatagttggaagctaacttttccattttcgagagccgaaaattttcatttttaacctaggagtggtcaatctgacttgtactaaagtaaaatttgagaacatattaaaaccatttcatctctaacgtaggacataaatgcgaacacaagtgtagacatgcatactcacatatgatatggtttaacttaagtctttcttgtgcatttggatctttgtttgcatttcatatcaggactcatgagcatgattaaaagataatttcactaagcaaaacctaaaagtgttcatgagtaataatattaaagacatgaaaaggaagtctaatattaccacttcaggtcaagagtagtctaaataaatttcttataactatttagatgcatctaaaaattggaaatgcacatataaagaaagaccttgctaattatctaaaataatttgtgcaagataaaatcatgggaaaattcatgtaggctctaattaacacgtagaactcactgtaattttggtacaatttaataactaaatttgataccttaaataaatcagtcaaaccagtcaaataatagactaattataattcctaatcggctaaaaccatattttgtctaaaagtgcatttaactgcatggaagagcataagggaaataatttattcaaatattaggttaattttaaagaataaatattatttttccagaatttatttcttctgtttagacctcctaaaaattcaaacaaagttctatcgagcccattttctccatttttctaagagcaaactacacatactttttgagtgtaacccaagaaaatggaaactaggtacatacacctacctccagaaaaatccacctgaatttatctacaccacaaattaatccatgaattaacaaatatggggaagagaaataatcctgaaaaattcctgaaaatctctgaaaatcaagtctttcaccactctcacccacggacccacctagcttacatcgacttgggctcacttggcagctacttgggcttgcccactccctatccatctcttccaaccgaccagtagacagaaagagagagatcgagggcgctggcagtgctcgacgtgttgggagcgacgtgtcgacgccttcaaaatgccgagctccttctctactctcccagacgcgtcgccactcttcactttccatcccagtgccgatccaaccgagggtgagagctccagctctcccactccacctctatttcatcgtcggccgccgagaaagagggcgccaccgatcaccaacaagccgtcaacatccctatataattcacgttctattatcttctctccatgccgatcaaaactcgttttgacaacctctcgattcatgcagccaatcgatgggaacgctgccatgcccaccggagctctggagcgcactctgtgcaccgccgcagcgacatcatcgccgttcccgcttctgtggtcagccaggccaagctgtcgcgccaccatcatcgtctcatcactacgaccaaaatccctcaagaacccccaatatttatgggccatggacggagatcggtattgtcttctctggcttcggccaatcgtcgccgtcgccgattccttctcctctggtgagccattgtccgatactttgcacatgaagcatccctgagacctcgctaacaatgtatgtcctcatgaatgccaattagattggtagatcaagccgtcgacatcatcccggagtgaagcgccgtcgccaagccatctcgtgtgctgccgccatcgtccggacctcgtcaactccggccaacacctcggtagagacccaagaacctccaatactcacatgcatgcacccaatgaaccaatacatgactgcggatgcacatgcaccatcacccgaagacaccttccgctcacactcgccatcggcggtactccgatgtcccctaaccaagaaaactagaggaatggaattgcgagaacatgctcttcattttatattttgacctgaactccaaccgagccgccgtttgccgccggcgaagccatggcttagctctgctttatctagagcacaaggacgtctcctgtgaattagattaagtacaggggtctgtatataaatgtagaatcacactgacatatgggcctaggaccgagtaatgatttatgaaactctaagggcctttttgcatattggactgagactgacttagacccataagcttagggccccctttgatttggaggaaaaacataagaattttagaggattttaatcctataggaaaatttcctatgaagccctttgaaacaaaggattgaatcctatccaatcctttgaaattcctatggaatggacaatcctatagagattttggaggaaattttgcaagagcttcaacctcttgctaactttcctttgagtctatctctctcatccaattcctgtgtttttcctgttgttcaatcaaacggtcattcctgtgttttgcaatctctgttttacacttacattcatattaaaatcctacgtttttcctatccctatgttttctcaatcctgcgatttaaagggcccttaaaatctgagaatataagagaaaacaccaaaagcactcatttttcaacagaaaaacatgcaaaattgtagagtccataataaattgaaaacaactcattttggagtaaatcaaatttctgtgaactcaccggattatgaactttaaagttatgaaataaaaacttgcactcacagtacaactttcacctctaaaatttatctaagaaaaattttacataaagcatgcacaaacttataaaatgcttacaaaattcatttcaactcattttggggtaaattcactttacacagattcaccaacttacactcccgtggtaaagtgaaatagaaacatatactttntgccaaatgtctctaaaactaatatcttcaaaataattagttttatgtagcctgaacttttagaagtttatataaaattcatattaactcctttttcagtaaactcaatttctgtacaatcacaaaattatgcacttcaatgatataaaataaaaacacacacttatagtacaataaaagcccctaaatatttatataaagaataaacaaccaaatatacactttagcttaaaaaatttgtagaaaattcatctttagtctaaatggagtgaaccaaatctctattaaccagcaggaaatgaacttcatcccagtaaaataaaatatggcaccttctgtactaaatatatctctaaactttaaattgataaaactatatgctaatcacatattactagttaagcaaattataaaaaatacatccaaacttcaaatgaacccattagatcctagatggaccagagaacctataactccaacctctcccaccaaaacttaaggcacttagctcatataataatttctatgttgacataataaattgctagcatagactagagctcccctagtttataaaaatatgaaccatgataataaagaccataagcttatgaactacaaatggattaattaaccaaattattccttgagtaaattgcatcgccagtacatgaactcggcaggtaggtgcaatctagtgcacaaacttgtaaaatgcttgttttggtgcatgaacttgtccaatgcgtgcggaggaaggcgaaaaggacactagatggctaatcttattgatttaggagctaattaggatactatgtaaacatatatctgagaaggataccattagacatacaactcttcaataaagaaaatagaataggatagagggatagtagaaaaagattacaaaaccaagcaattatataaaggttagaaatatataaaattcatcatttttatgatgaaggataaagtagagaccaaatttataaatattgcatgtcttttgcatactcactacatgtatgcatgttacatcctaatcaacatcaacatcataaaattaacattgccaagttattttggtcctcgttcacatgaactagacaagttcatgtactgaaacgagcattttataagtttataaactaaattacactcacctaacaagtttgtataccaccaatgcaatttactcttattccttttactcaactcaatcaagaagtaacatgttctggacataaaactattaagacatatacatgtaaaacactatatgcctacaacacgctataacttgtaaaatttataagaaaatcattataactccaaaaaatcgtgaaaccaagtatgttagtcttaaaaaatagacaccactacacgcctgtgaagtctaatataataaaaatcacttggcaaaaatatttcataatgctacctaagccaatagtacactataccgacgtaacttctaaaattcataactctctaatgtaaagtgataaaatataaaccctttcacctaaattcatatttgactagtacctattcactatgcacaaatcattcattttagagcattttggatttttcgcatattttggtgtttaattgtataacgtgtactttgtatagatgattgcttaaacggtgaagaagtgatttagatgctgactttttccagttactagtcaagtcccacctccctatctctttgatcacattggtcctatgttttggaggttattgaaaatgtttgcaaatcttgcatgtcatttgtacactaatacattaaaattttgttaaacttgttaaaataacacctattgattgcattatcacttgaacttcacatataaccataaccttcattcctagcccgggctgcggg

SEQ ID NO: 59417 - DNA, 1070 bp, Oryza sativa
caataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctctccggcctgctatcccctcccctcgctccctccggcgctcacggcgacgatgtggcgactctcgacggcggctggcgatgtggtcctcaaataaatcgaacaagcatcgcgggctggggagacggggctttaaaccggcctgtcgaacgcccattgttcgacagggtcggtggagggacctgtcgaacgcccccggttcgacaggcctggcggcgcggggtggtgggccctgtcgaactccctccgttcgacgggcgagcgtgtcgaacgccagccgttcgacagggctctgtcgactgcccgtcgttcgataggtgccctatcgaattgcacccgttcgacagggacctactttcgcgattttccccggttggccactacttttgcgattttccataaaaataatattaatcctcaaaaaaattcgccaataacctatttacataggtgttttcagacgcgcaggtagataatggcctgtagatatcgcatgatttgtgcgggcggaataccgaccatccttgggaattaatttccacaggctactctacccacccttgaaaatgaatttttagttttttgagatatatatatatatatatatatatatatatatatatatatatatatatatatatactcaaaaaatatctcgtattttggcagacatctctcttaagtcacaagtcacacgcgaataggattcgaacctaggacctatcgtttagtgtgtagggtcagtttggttgatgacttgagttatgtgcctgaaaaaaaaggtgcctgtgtggaaagaaaatttgtgttgagttctacctggcc

SEQ ID NO: 59418 - DNA, 11324 bp, Oryza sativa
  unsure (1)..(11324): unsure at all n locations
caaaagtaaaataaagaaccaagaacactttactttagctttaatacaaatgcattattatttctataattcatttttcaaattcatatttttctgaagtggtttattagtcatacaacttaacaacagatgatgtgctttgtgccctatggaacagaaattataagcaagcagatagcaagcaaatatactatgtcaagtaataaacggatcagttaattgatatcattgacacattcaagaggaatgacttacagggttgtgcatctcttcactcaaaccaaaattttccagaatagaagcaaccaatgtggagaaataatgtacagcataggagccaacccctacctgaacatcagaatagtaatgataaacatgtaagaagaattaattgcaatttcctgaagagtatatcaataaaattaataccaggaagttgtgggcataggtaacttaccacagatccataaattgtgaggtaaaataaacttttcctgcccattggtaacaatttcatcccctataacgaaaaataggtcagaccatcaatcaattttttttcgccaggacagaccatcaatcaatttgatagaacacatttttccataagcaaaataaaatacttgttaaaattgagtcactgatcgttccttatcaaaagaaaatgttattacttcttggtcttgtcacagaatttagagttgcttcatgctctattttacaggaaactaagagaaaaataaaactatcttcgctaattagagcaagagatctaagtttagacttgaaaatattatgaataaactcaagagtgaggtgttttagcgaaatgcagtaagttaacaatgtatattactccttaataataaacttggtggaagtgccccaataacaaaatgcagccagttaacttaacaatgttgtattttcatgtctttcaatatgagtctttattgaacagtaagttggtgttcccttagcaagcacctagcctgtctaggaactatttaggcagttgctgctggccagccacaatacgaagtgtctataccaacaatgataaaaagaaacatacaaaattatttgattgagaatacctggaaaaggacaatcagaacaacaagcaggaccccaagagccatagaactgctatagtaaaaaggcgcccatttgctaacaatgggtgataggaatagcagaataaatccaataccgaggcaagctagacgccatttctgaaactctgcataaatacacagaacaagaacagtaattatagggaaggaatggacatagatgctcttgattgtatgactggtagaacaaatattaggttcatgaataatacacaccttcttgaatggaaatactgaacctagtagatgtcttatcagccactttaacatcaacatatttgtttccatatggagactttacagcattccacatgccattttgcaaattttgccattcacctgtctcacattggcataatcccatagaagcattcctgcaaaggaaaattgactcatttctttcccgaagcatgtgtatatttacactttggacagtatgacttacccatgaaagcaaatttctattttccaatggaacttttcaggcattgattgggaaacattcattttgactcgtatttgatttgcatagcttccaatatgtaacttcggtattccagacaagcgaactcgctcgcaaaactgtccacccagggatgaaggaacaaaagtcacctctggattttccagactaacatctgcggaagtaatcaattagaccagcatgttaggtagaagacattggaacacaaaaaaataataataataggacattggaaccatataggcaaacctacaaggggattatcatacaaaaatccaagtgttgtgctaaaaggaacatgtaagtaaaagggctatacatgaaaagaagctcataccaaacacacaggtgaatcggaacaaagtgggtacggtctagctattaagagatgttattcaggtaaaaatcatccatctgtatacttcaaaatgacaatacttatccttcagccaaggccgaaaccactgaatacaaaacaaattttgagacattatcaaaaatgcattggttctgaagtaaaaggagaggcatgttactgcagatttattcgcgacaaaagagttgcaactttccaatcacccctccacaaaccaactccaaaaccctattctataactaagccccatgaaaacctaaaatatgaagcagctaccagacgcatcttacagcgaaaaccccaaaccaccccaaaggcccctaaaccctagatagaacggcgctacgatccccgtgcaaacgcagcagcagtcccaaatccggcccatggtgcaccaaacagcgggcacgattatacctttgatggaccgccccacggcggcggaatcgaaggccgcggtgtcatcgccggtggagatgatgaggagcgcggcgagcgaggctaggagcaggagcgggggagccgtgcgccggtacgacgaatgggaggtggaggtggcggcggcggcggcggtcgagggcgcgctaccggcggaggagccggtggtctccgccgacgacgaggagacttcggcggcgggggccatctcgcgcgggcggcggcgacgctgcaaattcaagcgactcttcttcttcttttttttttgttttattgctattattatctgatgaagaaagcgaggggaaaaggagattggtttttatggcgaaacagctgattgtcttcgatggtaagctacggctattgtcactgacaggtgggcctgttttttgctgactcggcgcttcttaggcttattttattgcgaggaaattcctgatgagtttgtgagggagactcctccgttgaccgtcaagacctccgagcaaagaggctgacacgcgggcccatgcccgccaatccgccatggctaccgcaatagtcggttagcgcgtacttggtttcggtgagtacctaaattttgacaaattgaccccttctcaaaaaaattattttaaaaatggtaaaagattttgttttgaaaatgaactacaaactacaaattcagcgtaagcccgatagcattgagatcaaacgtgcaccccaaattcacattcgcctcacgaggcacgaggggactacatgtaagcacacgaggctaaacatacacgattacatatatatatatataaatgatcaatcgcattttgatgaccatttggacaagaagcaaatcacgggtattagaatcccaattacacagtgagagacagaacgtggaagattttcttgatttctgcagaaaataagcttgtttcattgcgttttctttcgtcatggactagaagagtttgcaggacccgtaaggtcaaatgcgtagttggccaagtcatccatgtactcatcaagagcactctcagatatctcgaagttgtgctcgatcagctgcacgcatgggggaataattagggaaacacaacaagaacgaagccaattcaagcaaaggtaacacgaacaaggtggttggtaccttgatttcactcatcagctccctctccatcatctgtatcacacgtttttttcaagaaaaaacacgagcagaagatgcacataaacattgttatctggaagttctgtatcatgaagttttcaatatctgattaattcaaagaggtgcaaatatgatgatgtcattctacctgcaaatcgtccacagagaaactggtctctaccatctgcaaaggcgcagcatcgatgttaagttgcgatcgcatagaacaagtgcatttgcaggtgtgtcgcgaaaaacatacctctatatcgtgatccaacagcaaatcgttcaacatctgcatcacatgttgaattcatcatgacgatatataccctcaaatcaggtacaagaaggcaaaacttcaattaaagatgaaagaagatttgtacctcgatttcagccatagcggcatcgttgtccctaaccatctcagatgccctgcacatcgcaacatgtttttttgagataatgaatagaaatccggtctctatatccacaagtggatatacacagccaactgcaacatgtttcagagaagtttatggcatgcagcactgtatctttttgaaagagaaaaaatgccatgcagcatgtgaattccacaatctagtttcctcaaacaaccatacagatcaagtgcttccttgcttggagaagtggttctcagcagatcatgatcatgaagagacccaacacctgaactgaaactctccctgtacttctgaaaaacaaaagaaatcaatagcacgaacaatcaagatgcatcaagatcttgtgcagcagaacgagaatgataatagagagaaagaattatcaaaatatctgataaaaagctctgcaacatggcaggagggtacctggaggtgactcttgatgttgtgggtcgtaaggcttgtgacacccatagcttgcattgtctccttcactgcagttggtttagcttctgaagattgcaacaaatgtataacacggcatcagttttttttaacaataacatggcatcagttccatcaacgagtattttgagatcaagcagtgaataacaaacagttttaccatagggacctccatggtaggccacagcctccacaaacatcttatggagatcatcagaccatcgaaggtaactccttgttggctgcatagcccggataaggcgagaaaccagaatgctcgacatgcaatcatcctcttgtgctggctggctgttggacattattctgtaaatcatactcagagcacttcagtaaatataaaagacataaagcctgtttggattgtgtatttgtgtaatcaaacaagacagattcattaaattgtcagtatggagtaaatgtgaggatgtgcccttatggtaagggaaaacatttccaaatagaaatgtgagagatcaaacatgagtaccgatgttttaaaatcctatttagaaatcaagaatgcattagatcagaataagagaaaccagaacttaatacaaatactagtaccaatgtatatgatgaagaaaaaggaattgagactgtgccgtctatttttagggagaagagtgagatggcattccaaccttgaaaggatatcaccccttttatatagttcttcctatcactacactgcctatggaagggacattctacattttgtctagcacatcggtcatcacagttggtgtacatggaaggaaaggtaggcagagaagtacaagatttcaaaatggtaagataacaaaatgaatgattatctcatattaagcatggagtataacagggtgctcttttcgcagcacatgcggcctctgcccaatacatgaatggaagggcatcatagatcatgcaaaatcatgaacgtgataaagaaagaagcacagaactgcaaatataaattaggtacaaaatgaatgttgaggttaacttatcaggcaagctggatgtttatgatgtgaacaaagtcctatcctgccaacacctagcagcagcatggcagcatgaccttgtcttgtcattgtgatgtcatctgcacatttttccaatcaagaaaatatagaattacagaaaatcaatcatccatactaggtgcctaaattttgacactgcaaaacgttgtccatccttcaaatgnnngcggaaaagtagggaacaactccaaaagatctggaactggaagtactatcgaaaattagttcaatcatacatgtatttgcacagatgtatcatgaggtgctctttacatggaagatgaaacatacataaatgcaactcttgtcaaacttgtattctaggtatggttggaaattttgtagaacagtagagatcacaaggatgataagaagtgcatcacatgagcagcaactgaattagtgtataatcaaattgctgatattatacataggagtacatcaccttcttgaaatgccatcggtaatacatgctattttacaaagaatgtaattacaagagagaacaagaaaatgtccctagttctcttcagggttgtaagatggcagcaaaacggacactaatcctcagcaacatacttgttcctacgagcaccaaaagcaatcctctgcaagtgaaatcagggacaatggttattcaacacagtggaattgacagtagttgaggatgtcaaataataacaaaatacagtggagatcttactgaaaatattctggagtaggctttcaagcctgtgagaaaacggatgtaggttggtttcatggactggttagtaggtattgctctgatgtttggaacgagataatccgcaacctatcataattcataataaagttataaaaaaatatattttggaccttacagctaactagaagactcaacgagtgtacattaccatcaataacatgtaaggcaggtaaattggatcactcatagatatatcccgtgttacatgaacctggatgtcattggtggtataaagcactgcccatgtcatgtaaagcttttcaactttttaagttcaatcgagctaacgtattgaactataaacaactagtttttttatgtgtcctatgaaaatattagatggccacatttgttctgatcaaaacaactgaagctgtgcgaataattgttttgcactgaaattaataaatactaagggtatgcatgtgtttcatgacagatgtaaaggtatgcatgatcaacgaggtattcattagcatgtttgaacattgataatgcaagtaaatacgtcaggtttaacttaacccatcgataaagaattgtctcatgattttcatgaacatataaccaggtccagagatcatgttcaagctatttggttagatatttcaagctatttggcttgcagtagctaaatcatgtttgctacttcagtcttcagccatatggaaactagaacaagaaacaacgatatgctggggaaaaaagaaatcaagatggagctcttaccacattagcaggttcagctaatatattgatgaaaaatttggcctgccatcagtataaatccagaatttaataacgatgaactatcttgtcaacaattgttaaaaggagaccatgtggatcactcacctgctttgttgtggcaccagacataagaagatctgttgtaaccatgccaggctgcacagattaatatgtactcggtataattattcttgcatcattattaatcgattatacaagaagaatgcaaccaattaacttgcagagatgcatgattcaaagcttacaggaactaatttgctaaactactccagtgtttaatcatctagttaagtctaaagtagtaagacaccaggaaaaaggttggagttatgtaccgacaaattgtgcaccataacattgttcacttcattcatctgcaactcggcctgcaattagaatcaaattattttcttcctgcaaattctaataaacaagaattccagaaggacaaaaaaaagaggaaatgaaaacctacattgcgagttctccagaaaaatcgttccatttaagaagggaagggtctgaacctcaagactcaagtccaaggattatatggatgattacagctttatgttttttttttcaaattattaatgagtattgagtaactatttgataatcacagctttattgttctggatactgagaaatggtggtaatcaatattgcatcatagttgtgatgtcacaatgcagttaacaatttatatgaagttacaatgccacaaatagtggactatgaataaatgctacactggatatgttctgatcaaaacaaaatgatatgaggttatatcctcacataacctttacctgcagagattttgtaaggtgcaccacacttctcttcgttgcaccatatgcagcaaacctagtcattatcaataataatcagtgtctatttctgaaaggatattaagttattaagtagtatcctggtgtaaccacaaaagcactagttaccaaaatataattatatttaatatcgcttgatacccccaaccccccaacgcgcgcgcgcgggggccaccgcagtggtgtaattttttcatttggttgaaactactgataacagtacagtatatgtctatatggaagccaaattcagcacagaaacttatgaggcacagttatgtggaatcataggtactctcctattagcaattagcaataaactaaaaggacataatacatgatgtgaaatttcatagcttcatactgtatgagaattcaaacataatgatataatgattgaattgcacattgagtgtctacattttactacagaacagaacaaatggaaatgcataccttggggttggccttccatcagaaccagcaccatcgatgttaaatatgtggccacctcgaggttggtttctcatcatatttattgcctaagatggcaagatggcaagaagatgaatatttggaaaatgaatcttcacagttgttgtaatgaaattcagaaagctagtatgagttgaaagaaatacctcacgacaacatatcattaatccaagagtgttagttgtgatcacttccctattaaatcaaagaaagagtggagtttgaatatagcttgaaagcacaattgaatgtatttggtcaagccataaataaaaagacagcatgaaaattacatgagagcctcgtcggaggtctcgaccaacggtttgtaactatatgcatttgatccagcattgttgatctgtgccaaaggaacacaaagataaggagaaaatcctgccttcttatggttctagattttacccaaaaagattcaacactacataactgagtgcttcaattaaattactgaagtttaaatattcaaaaagggtagctgagaaatttcgaacactcatgagtatgtagtgagaatcagcataactttatagccagtgattttcatatttgtacatatgaaaagaatataaacatgagtaagttcatgtgcagatatttgatgatgatggggtgattatgtacccaaatatcaatatacttcatcttgtcacgtgcaaaatcaactagtgcctttacatcctttccttccctaacatcacagacaattccctgcaataatacaaatagaagcagttcagttgcataagtattattgcactgtaaaattttcaacaaacataattataagtggagactccaatggcagtaaaagtatcaagtagctcagcagtaggaagtaggtacccacacatgttgctctccaaattcctttttcaagtcagtcaccgcagattctaccctttcagctgtagaggatagactgcatgtcaaggaaaggctaaactgtaacttgtttgcttttttttttttcattctctcactaaaagtgggctcaagaaaatcctagcaatccatttgtttattcattttaaaatttcatgaaagatcaatttaacaggtcagtcatatcaagcagatgacccctatatagagcacctaatgagcgataatgagcatcaaatgacaaaagctggatagtgcatattttagtgttaggtcaatggatcatccaaatgagaagagaggaaaataaagaaacaggtaaacgagacttgaccatgcaaatcaatttgcaatgcatcttaggctcgataatttatccaattttatttatgtcatcactcaaaaataattactaaaactagcgctacctattgaaagcacaaaatcatttctgtacctgatcttgagcagattacaacattatcgccagccttcaaaaattcctttgccagagcatatcctatacctgtttaagagcaaacaagggtcattgagttgtactacaaaggtttttgaaacaagcttccacaaaggaagcgtttaggagatatacctctaccaccattgaccaaaagatctaatatgtcaggatttaaatatttttttaccacaatacagtatcaaagcaattgctccacacagtttcaagctgatttgcattgtttgattaaaaggtcaatgccgaatgcactgatgttctagttcattttgtcttctaaattgtgtactagaaagtaggaaatgaactaattaagcaggttcttatgctggtagcggcactacccacttccacccctacttccaaattggtgttgctctcttctcggctacataaggcacgaaaaaacaacatcgccaccacaccacaccctgaccatctgaattatttccaacacaagcattcagaatttcagaaatatcgatcaccaccagttcctatatgctcctactaaattgcatcccaacaaaaagcatccacagacatcctacttctttcttgtaagcaagatcaagcatgcgaagcaacacgacgacgagggggggagaactcaacaacacctttcgtggaaccggtgattagaacattatacgggggcaccatggccgccctccgcgcgacccctccaccaccagggacagcctccgcgcggataccggcagcctccggcccgcctctcgccgcaagccggcgccgcgccgtccggccgggcaaccgcgccccagcagcggccgagcccgacggccggagcggagccaggcccacctgcgcctgggcacggagcgggaggtaggcggcggtggccgccattgcggcggtagcgagacgaggggaggggaggggaggggagcggagtggagaggcgtcgtcaactgcggtgctcgccttgccggctcgccgtcgcggagtctggataacgattaacgagcgaggattttagaagggagggggcctgcgagttaagtacggatgttaagaggtggaggtggcccacaagtcagtgtgagcaatcatcctttctctctctctctcttttaaactactagtagtatgtactagtactattttgcaaggtttttttaactattatatgcatgtgctttacaatagttttttttttcgaacgcgcaaaagaattgcacgtcaatatattagtaggaaaagagtttttgttacacaaagcaatcagccagattggcttatgcctaaaggggggacttgaagctaggaactactacgacggttaaaaacgtaattccaaacagcgggagggggcaaagccacgctacactcccaataaatccccaaaaaaagcaacgccgactaaagaccacagctggccctccgagcggatggactccagaaccactgcgaccgaagcgagcgcagagtcgaaaaccctggagtttcgttccttccacagctaccaggagactaggaatacctggagtcg

SEQ ID NO: 59419 - DNA, 3838 bp, Oryza sativa
attcctgcagcccacattaatacaacaaaacgtcaaacctgcatccagaaatgaacaatgtaccagacacttctcatagttcaaaataattttttaggcaaaaaattattatttaaagcttgcaagactggtaaatatttattattcttagtaaataatagtaactactccttcctatatggaaaggcaaaaaaaaaaaagatgtaaaggagcttcagcgcatataggggatggatgtaggtacaagagacgggtagagggtttgcttttttattccgttttccaccgctggctgtaggattttgagctgcagccgagatcagctgggttggacagctacggcccaaaatgccacaacaatcagaaccgatcaaccttacatacacctatcaagaattttttatacaactaaatcccattgttgttttgatatggacttcaagaatataaagtatgcccccaataaccacaaactgaacaatgcgctatcagctatggtagtcaggaactagtagtggttccattgacctctaccattggctagatacacaactttgggggtagcctgcagtgtctatagaaggaacattgattactaggaaaacactgtagtgagaacatcttcgatcctgatgcatcctaaccctaacgttcatcggtaaccaggctaataatttgtgcataaagttagatgattattatcagtacatgtaaaaattgaactagctgtttttaatctgacatgaacaggagacagggcattgtgcgtggttggataaatcgacacttttgcacaaccttctgtgcagttctgatcgaccccttatcttcatctgatatatatatatatatatatatatatatatatatatatactatatggcagccttttcttttttactacactattaattgactctcggtatgcaagcagagtactagcatcatcaagcagggtatactggtactcacaggagtaaactccaactttcctgtaagtattttctttgaatatatatgtcatatcttttcaagatgacaagaagggaaaaattagacaaaataatggagaaatggaggaaatttgatggcagtagcatgttcttggaccatggagcaacttaacggtacaaattcgacgattttttttcactccaatgaactaactaacctgacttgccgggaagaaacatttaacttttcacctttttcaccttttcagagatcagtcctctatgtcacagtgctacaataggtccacatatcgaactatccaatatgtaaaccagaaataaatctatcggtccttacaaattctgattcttcaaaggtcacaaaaacaccacaatatatatctagcgagttcgatctatgtcaccactcaccagtgctaggcatagaaaaagggaagcaatttgtagatctaattaacagatcattacaatgctaacaagaaaaagaaagtaattcattaaaacggtgcaagcgatcaatcaactttttcttcaggtccttccttttgcttcaaatacactgcactacgaaatgattaagaaggaaaattacttagcaaattacccgcagaagctcatgaaaggccgtgacatacctgaccactcccaacttgctttagttccaatgcttaagaagggggcatcaaaagaccaaaacaacgctacgaagctggttgatctctcatgacaagcagtttatcgacattaccatcttgcgaagaagacatggtgccatagcattgatacttgagctgcaaaagcttggttcccggtgcctcctacacctaacaggttacaggttcactaaaacagcctacttgattgacctctaggtgtttcttgctgtgtgagagacgtctgagtgtattaaggaaataggatgcctttggttgtaccctccatgttgtccatatatatagaagggtacactttaaggcggaaaagctacaaatatgttgacatttttttttctatatatatatatctttcgatttttggtccattggttttgtcctaagatttgcgctagttgtctagagaaacaaaacacagtgcttacactatagttacatttcaaagatttttttaaaaaacctatcgcctgatttttagatagtactcaatcaaggacctttaattgccttgaatcttcgctttaacatgtataggttgcttttctgggagcattttctcctatgtggccgtaaatgatgtggtttggtggctacactcttgtcattcatacccgttggattgtttaattatgtgaaggctcgatcttggaacaaatcttcattgtagtaccgggcttcattttatattgtcaggaatgcatgctgtggaacatcggcatcaatatatagaattatctgagatgcaaatcactgaaacaatatcagtccgacagcatcaatggttcgcgcgagggtttgacgacttagccaagcgttagcgaagcgtcattctcatagcgaggcgcttcgagttagcgaagcgagtgctaattgggcttcgaggttggctatacgccaaaaaaaactacttttcccggccctggcataaacctagcttctttgaaacaacataggttcacgtaactagctattaaatacgtatatcttttcagtctctaaacaccatcagtgccaacaagctacattcataactttattattaaggcagatgatcgtacgaagcctaaacatcgtaacaaaaaaaaccgtgtttgttatgataaaagatctgatagtagtatttggaaagggatctagcagccaacctatagccagtgaagatggccacacggtgatgttgaagaagaagtctatttttttgggagttaccctattcggaagtcttagacatccgccaagcaattgacgtgatgcatctaactaaggagaaaggaagccattacttgagtcaaaccagctacactctgagcaaggcagagaaggaaagtatgttgaatgctcgaacaacatcaaggtaccgtctagatactctttgaatatgaagggaataataagcatgaaggaaaagaagatcacaaacctaaagtctcatgactgtcacatgtcgatgacaaagctgcttcctgtgatatctcggggtatctttcctgataatgtccggacaataataacaaagcaatgtgcattcctgaatgcaacttcgcagaacattatcgatccagacagattgacaacccttcaaaatgacgtggtgcaatgtctcgttagctttaagatgatcttttcaccatccttcttcaatataatggcgcatcttctatgtcatcttgtcaaagagatcggtattttcggtcctgtatacctacacaaaatgttcactttcgagaggtacatgggcgttctaaagaagtacattcataaccgttctcgtccgcaagcaaccatcgccaagggtatgtaacaaaggaggtcattgagttatgcgtataatttattgaagaccttcgtctaattggggtccccgaatcaagccatgaggggagactacggggaaaggggactcttggaaggaaaacattaatgattgtacaacgatttattctgtaaatcacattttatggttttgcaacaattttcgttggtggctccttacatcgaggagcacttggcagttcttcactccaaaaacataggtatgtccgatgtccagattacacgccatcacattgatatttttcccgcttgattgcgacaacatctcatgagtaacgagacgattgaccaacaactacccttttggcgagggtaccatcttcctcgatctcgacattttaaggatatgagatcgat

SEQ ID NO: 59420 - DNA, 2743 bp, Oryza sativa
ataacaaataagatgcccgtgcatctgtgcaaaattcatttccgatttatattcccaaaatgttctccggtttatattatatcgttatagtgtttgaaacacaacctataatacatgcccgcacgaatgtgcgggcttcgtaccttcctagttaatcttaattagctaatcaagtcaactagcgatcgcattggcattagaaaagcttgtcttctcggcaatcatgctgttcgaactcgacaccgtgatggtggctaaggcgacgtcggcgagtagtgccgcatggggaaggccgtgttccggtcggcgccgtccctactatattgacgtaatcagtcgttgattttctattgaaaaaccattataagtaagtcgtaaatcgaatataatttcatgggttatacatggcattaaaggatgagtgttcttggttatacatggcattgaaggataagtgttcttgggatttcatatttcattgttcgattaattagatcaatagaagtttgataaaaaaaaaacaatctgccaagagtactcatccacatactaatataaatttttaaccaggttttatggattttgatcaactagcaatcactttgtattgtataaactctatgtacgccattctctatatttaaacgatggcaacgatgattcggtattggaatgattacttcattattgatatatatgtgtgtgtgtgtgtgtgtgaactttctgcaatgctgaataactttgttaagattaccaatattagaccaaggttcaaaattctgtaacgaaatttccaaaatttcggaagtttcggttctgtcggacaaccctatgatattatttcggtcgaaattttaatttatttttatttttttgtaaatttgataacattttgttcaaatctttttttaccaaatcttgttcaaaatttccgaaatttcagtacatcggcaccctccgatataaacgctgaaagagaaatattgaaccctgtattagactacattaattagcatcctgggttatctataaaatgactttgatttctgacacaccctttctttttcagtggtaataacattgctgaagacaatgatgatccaggtacatctgcttaagttggcttcattgattggggtacatctgcttaagttgggctgagcagtgccttataaaaggaaacttaccattgccatcattatggtgaatgtcatctggtgcgtagtatgctatgccatctattccatttcccgtggtttacacacagcattggcatgtgccaggacaaggtactgtactgctcctactatatctttgatccatattgactctttttcttgatttgttgattgctaattgaagctttattatgctgctgtggtgttgcctgtcaaaattatagtataatttagggtctggatctacattttagtgatttcaacatgcatatttgcttataaaaagatagtatatttaaaataaggaatttaataattggtgaaatcactggtaatttcgtgtcctttgtattttgtttacatgtcaggattttgccaatttcgaatcctttgctaggttcttggatgaggactaaaccatgtttttagaaacacaacattgttccaactgcatataatgctacactttttggcagtttaaaaacaatagggcaatcattattcatgcatttttgaaacaacatggcagtacaggatgccggttgacaatcattggatagatgatgtttggcatgacctatcaatgggggttcttaactgaatattttgggatttgacgctgcttgctggaaggggtgacactgtcactcaccaaaggaactcatggcgatggtcagaattaggcatctacaattctacatggcaaagccagcatacatggcaaggtattgatctgatcagatttgatgcaacctgtttggaagtcaggcccctttgactttgaggtgcaaattaatcttttgcttgtctcctagcttagaatcgcatatggactgttgctgtttataacttagaggctggccatacaattacttttgtcccctacgaatcaaaccttgagacatctcatcatttgttcatgaagagtagattagtttaagccatccagataggaataagcctgtgcttaactgaagtttcttcagcaagccctccttcggcctgttcagtattggaatggtggtgtcacaagacttcatcagaaaagattcaaagaaaaaggctcaggaccctcttcttgctggtctgctggggaatttggacggaacaaaataatagaaacttcgagaaagagggatggtcaattcaacgaattgtcgacaaattctttttgacgagatcaagcagtggaccagctacagagcaaaagggctggtacagttgtttttttgttagattgtaattttatatagcctctggcttttgttctattttattccctcctatcaaaattcgtacaaaagacagtcatacccatgtttacaagtaccgataatgttggttatacttttttttacaattacacaggagatatattttataaattttggttgaataaattatttttgatagatatagtttccaaactttcaatgtactcctacgatatattttatgaaaaacgtgcattgcacgtgcacgattactagttagtaaactagtacacgagactgtatgtcttcccctacagggattcctatttactgcaatggaaaaaatgctgg

SEQ ID NO: 59421 - DNA, 18874 bp, Oryza sativa
cgaatcttcaaggaagaagggatctacgcttccctgttgtcggagtaccgcgtccctgacagcttagagcttgccctatgattcatggcctggtttcatctcaagtgatctcccgaatggatagggttgcagggttaaggttaggggagaataaggtcaggatgagaaagtgagatgtgtttgtcggcttagagggatagctaggacgatggttgtgtcgcctcagcagtgggagatgatgaggatggtgggcatgtgttgaagctagagcaacacgagatggtggaggccaacggtgtgggagcattggagccgagtacaaaggaggagaattgtggaaatgaggttgcgaggagaagagagccatgttgccaggtgaaacttgccaaagatggaagagggcgacgatgtgggtgtatcagagcttaaaagattgaggatggtgatgcggaggttgcaagaaggagaagatgtcgaaaaggggagcaacgtggtttggtggggcatgcgagcaaggcaactgttggtatttcttaacgacattactagaaatacaattcccagcaatggcgcagaaatactcctggtatattatggttacagagttcatccgcaagcgcacggatataccattgtagcatttcacccgagagtattccaatggtatcgtatttatttaatctcgtggaaagattatagtagagagaacctgactaataatttatatgttacttgtaataatcatattctaagcaggggttaagataaatcaagggtagagtgacacacaagcaggaagcatactcattctcatattgaaatatctaagctaagtggaaagaaaagagaaagagaatatattcctatacttctagtatacatagtatacatatacatcctagttatctgacatactagccaataccctctatccaatgccctcctggtacttcgagaagccacccctaactgccgagttccttacgacagccagtcatgaccatacaaccgggactaaatacgtaggaataccctccctaggaaattaacttaggactatatacatgcgcggaggaatacccatattaatctatcaccatcagcggcccacctctcatccgcagcatataacccaaaataatgatattccgtaatctagacaccacacctaaactaccagatactactctaatatcatcgtcatgacatagagtatttgcataagcaaacattatacccgtaccaaagcatctcccaaataagctagcagtataatcagtataacatgaacataatgtaaagttggcattcatatactcggaaagtatttcaataccataaatgacatttataaagaagagtattctaataaaagtacaaagcttacaaaagagaagagaagagctactagagctatacccaaactcttccgaaggcttccggactccgatttctactctattcctattcaactagcttaagaacaccaaactaattaaacttgagagaatatgaaagaactttgcttgaggtgtgtgagtgaagtgagaagaggagctccttttatatgcaggtaatgacggttgtgatggttggaatggtcggtaataccctccaaccgtcattagggatcaatcccagccgtccatcaaaaccctgcatccatcggtgccacgggaggttcggccgaaccatgggctaggcccacctggtccaaactcggcaggtggcctcctctgttgctcctttatacagacttgtgaattttggtctaattcatcgtgtcaattctgagttcttggcccattcatgcataagtctgattctcgacatcgtccgattgatttatcgtctgatttgatgtcgattctcctccacttaatgatcattctctgcaaaagtttagtgaaccaaaaactagtggaatattattattctaacatggatatgcattgcaagcatagctagttcttctctattttggtaatattgacggtcgaaactaatcgctaacgaccatcaacagcaaggtagaaaacgtgggaagaatcgtgtgattggggaggagtgtaaacccaacttttggatcttagctttaacagagccaggttcaccagccaaagatggcgatgctggtggtttctcgtacatgaggaaaaattgttgtgattctgacttctaatcgatcccactgggcgtgccaaaagcgtgttgatgtgaaaacacgaggcctgggagatctgcttaactccagtgcaggtccaaaactcgcctcgggtatgctagcgtgccagttgatttgatcctgcaatcaacaagaaacaaagacaaagaaaccgtggttaaatccataaacgatagccgatcggctaggtgccgatgacgtatcatttgtctttgagccgatgtcatatatgcatcaatcgacagtcataaatagataagaaagaactaaatctactcgatcggctatagatattaacgatatataatctttatgtcgatatatacttaagtcaagtgattgggatagatcggtcgccatgccgagacaatataaatcacttagatcgaagtatatactaagaataaaattatatatattcatagcatagccgatcagatagatctagcatgtatcggctaatattccgataccactctatattaagatatcaaagcaaataggatataccaaacaaagagcctaatatacttagatacggcaagatcttaacataaaggacggatttaacatgtcaataaagcatataaaacaaatatagttaaatcaagtaagatcggctgaaatcccgatactaccctaatcggcaaccaagaagcaggctagagattgagattctaatcatgactcataagatcaaactcaagtgatgcagctataagtatgaaaagaaggacaatatctagacaatcaagccattggaagtctcatagagtggtggatatcatatataatctaagccaacgtcgatatttaacctaatcggctgccctctattgatagatgttagccgattgtaagttagatagcgatattgccagagattatataagatatatgataactcgatgaattacatagacaagattagagtatcataaagatggaagcactaatcccgagaacgcaagctgtcataacaagttttacctattgttgaatatcgaaaccgatgcagctcaacccgaaagtaagaactcgtcgaaataaaacgaaagcaaaaagggtggcgatgcgccgaaattgtattgaacgtgtgttaattcgattacatagggctcggggtctatttatacccaagaattacacaacatgtccatatcggacacgactcttatctctaacaaactctaagataccataagtctttgcggaaaacttttgctcaaacatatctctacaaaaactacataaaatatcataattaatagatacaattgctttctcaggactctattcatgcatagcaatcatcttgaagcatatcaactcaacgcgatgacgtacaccaagtcatattgtcggaatcggctgtatcgtctaacccagtctgactcagacttagccgatcccgatcgtagccgatttagactctagccgattcttactatgtttccgcaactatcttcgtcttggattccgcttcgatctaatcttcgtctccgatactgatattaccaaatttggtcgttaacaaaagtctattaaagaggaggaaatattaatttttgttaaggaggtaatattggcattggagtattgatctagtctagtctaggttacaaggacaaataagaaaatgtaagcaagattaataataaattaattaagagaagaaattagaatagtagagaggatacaggaagagagggaagagtgggtgattggtggagggaaggagacgggcggacgaacggagaccttatgctcgatctctgcctgcttctcccttctcgcgctctctctgcagcttgccgagagagagagagagagagagagagagagagaggtttgacccccaacaaccctcctcctccatatcatctcccgtcccgtcccgttggttgctactactacttactcacttcctcctccttctagtaaagggaggagcaggtacacgggggttgagatctgaggagggaggagaggaggttcgtgatgatggagagccaggcgctgcaggaccccgtcgccgagccccatggagctgagcctgccgccgccggagctcctcccgccgtggtcagcctcagccttgttgcttcaccgtttccatttcacctacctccacctgccttatctggatcttatcttgctcaaacttgctcctatacttacatagtagtagatccagatctcatctcatgcctcaattcaattctttgtttctgggatctcatctcaatgcttgcttgctgcgttgaccatcagatctcaatgtcatcttgctgctgcaggttcccggcaaggagttcacccgcacctgcaagggcctcgtcgtcgtcctcgtcggcggatatgtgctgctccagctcctcccctcctccctcgactacctcgccatcatccccgccaagtatctttctttctttctttctttctttctcctttcgcatgcatatgcaccacacccaccacatccatgctgcacgtgctcccttcccttctctctcgatgcatatcacaccgacacacctattctaccaactacgcgattgcaattacaagcaacactgacatcaatttttaatgatacatactgcactttcaacaaccacgcaacattgctgctgctcccaactcccaagcaccattttttattcactctgttatgctcgatttaattctctagttaaatgccccctttgctttcaccttgcaggactattccatttgtatggactgtcttcacagctggctacatcgaacaagttcttccaggggtcagctcattttctcctcactcacattctttttttttatatagtggatttcaattacacaccataccggctcagaggttacaaatactttctgaggtctcaatttgttatcctagttacaagctgaggttgaatctttcaaagtatttaaactgatgcaatgctttgtaaacaaatactttgatgaaaagtatttcacagagacatactttcaaaacaatgaaaagcgatgcaatgccataaattttgtacctttttgctgtttagtgtttactcttgattattattatttttccttaggctatcggcagttcccttggtcttctcttctgtgggaaggatatcgaaccagtgtggggccgcaaagaattcttgaagtttatcatcttggtcaactccatctgcggtgtccttgcattctgctttgctgttgcactctactatgtcactggaaaggagagcttcctgtaagtttctaaccatcaatcaattaacttttacatagctattatactactacagattatatttctactatgtcattgaaataatattcattcttgcttcctgcgtattaccttttcatatgaatattcagttagtttcttcaaaagcaatgaatatttagttcatgcaaacttctacacattagctcgctggataacaatatcataccattacttctatacgtgataataaatatttttatttcggcatattgtggttactgttggttatgtttgcataatgtaattcatgtcaacaccttacataatgctttcttggttagtaacattactgactgaaaattgtgcattgtactcactagctgatcttgattgttgtgcagtgttacaccactttctggtttccatggtgcccttgctggctttcttgttggcctgaaacaacttttaccaaaccttgagctccccatgtgctttttctggaaaataaaggctaaggtatgctgatgaactactataaaatacaatttctgagcatgtagtgtgctaataaatacttcttccacaacaagttacatagcttctctcctttttcccttgctattgcagtggatgccattcttcgtgctatgcttctcaactatcatggccttcattgtacctgattccattaacttccttccaactctgctatcggggatgtatgtcagctggatttacctgagatacttccagaggaacccactgacagggcttaagggtgattcaagtgatgacttctccttccccagcttgttcccggatgccatgcggtaatttttttaatcgcgatactgcattagtgcattggcaaagatcgtcacaattaatcccacatctgatatgccattcttgtgatccttgcaggccagtcacagaccctgttgctaacctctttgatcggatgctgtgtgcaaggtctagaccttctgaactggccctcccagtctcagatcctgcaaaggcatcgagaagaaggtaactctgtcgtgtcttggcatgcctgtaggcgtacctatcaactagtacactggtagttctgattagaatgtggcacataagtatgaaattaattgtttgaaaatctgcaaaccttggcttttgataaatcttttatcaatttaattagagctcagcgaatctatttttattgttccagggagcgtggcgaaagggttcttgaggaaaggttggctgcagaccatgcagcagacacggaagccccagctctgggccattccacagcagaagattaatatagctcgtccactgtcaacacaccatactgcgataggagccacggccacctgcctatgtgctttgtaacaccgaaaatttgtgttctggagaatgcaattcagtttacaatggaccaatgatatgatattttactctcttttcttattatttattggttaaattctgttgtagttgattacagtgaaaaaagaaagaaaaggatgacatccccatccagatgtaatgtagaaagaattgagactttgtgaggattgctgttgagaatattttccaagtgaactgtgactttgagtcaataatagggttcatatcagcaagggacgcccatatcggctatcaatttgtttgtagaagcagaattattgggttttgaactattggtgctaactaaaggatagatgcttgtactgcaggtgtcatctatgctccttcaaaagacttggcactgcaaatgggcaaaggtgtcatctatgctccttcaaaagacttggtagcggtgagaagtatatccataaaaccataggttagaaagcattcacgaatgtcaaacatagagataggagttccaagtatttcaacatatcagtgctctcttcgttctaaaataaactaacttctatatatgaatttgaacataaaatttctatctatgaatttgaacataggctctattcagattcatgtataaaagtttgattttttttaaacggaaggtgtacatgactaatgctctattatcaagaaaaatgtgggttaaaataggaagaaaccaaaatcttatccgtatcctatgcaacatacaatttgtgtgtatatgcttctctggtattcaaatagcttccagaaagacatgcgagtgagttggtttgtactcctttttttaacttatgtaatattatcacagagcatcaggtaaaattgtgtcatagcatgtaatcaagggtttgtgccaataagacttagggctcatttcgaacgcatgaatgcaaaaccacatgaataagaaaaacataagaaactaattaataggtaatgtaagtgtaaaataaaggatcgaaaaattgagaaaaaaaatgagatgtagtgcttggaacatgtgatagagtaaaacacatgatttttgctaactatgcataacgtatattttcttgttcgtaaatttgtgtttaaactatgtttatttggaggtgtatacattgatttgtgttggatatctcaaaagaaaaaaaaacaagtcctagtgaatgtcaaaattcctatggatttccaatgaaatcaatggtataggaagatttcctctaatatcatattcccgttccttcattacaagtgaggacttcaaatcctctaattttccctagaaccgttcaattcaaaggagtccttgaagatgcaaaatatgtcgatgtgcaaaataaaacttcgtagatgaaatctctgacaaaaggtaggtgctattgcctataggtaggggtgaaaacagtatggaaactttccggattccggacctattttcgaaaatgaaatttgtcggtcggaattttttggaaacgaaaatgaatttggaaatattttctcagaaacggaatcaaaaatgatatagtcagtttccgtcggaactcggaatcggtcggaaactttccgaaaaatttctcggaatttccggaaattttgtaactaaaataccctggattttttaagcactgaatagtgaataccatggtgtttagctgttattttttaaaaatatttgttatgcaaatctgaagttacataagaatatttgtttcctgcattgggatttatcaacaacattactctcttaaatatagataatttattccatagattgtgttttgtgatgtaccgttgagacttaacaattggacttatatatgttttatgatgaattgttgaccattgagaattgagaattggatttatccgtttgaggggtttttatattccaataaattttcgttaccgtattcgcgccggttcatcttcgctccgtttgcggtttcgataatattcgattctgtttttgtatgtggggtttccgatttcgaaaataatatgaaaacggaaatgataaagatgctttccgtaccagtttcaccctacctatgggtcaagtaacagagccataatataggtataataagcccgagccagcaggctataggttattccacgctagcaaaattctatgtgaataagggagaagagaagaaaaagaagaaagtgggtgctagatgtgtcgtgggatgatagtaaagaaacaaggttctatcgctcacttgcagctgttaggagtgatacataatgtatttggtaggcttctaacatttctccacggacaagtgtgcatatatgtttgtttttttcctatctaacacgctaaagcatcggcaacacaaatagctacggttagtttagatcatggtaatttggttattcatgcatgaattgagtgattgattatctccaactagtaatcgtgcacgtgcaatgcacgtttcccacaatatatacataagtgtactcaaagtttaatgcattgattttccaatgatatgtatatcacacagcgcatacaaagtacgaaaagcataaaaaattgtctcaaaatagtactctagtaaataacatttacatgttcaacagtaagtgtatatcttctatcgtgtgaccagtagaagtttatatgatatgcaaaccatagaggtttatatctcagttactttcaagacattaattgtctcgtaatagtactctagtaaattgttatcggaacagtactcggcgtagttgccttaagtgaaaagaaggagatgtcgagtgtgaacatgttggaaacaccttaaaaattgaaacgacaactatgtatttgtggtatggacttacagggtatcccgtgaacatgtccaaattatattagttgagcactggaagggatttcacactgcacatgtccatcatcctagcagttgcagcccctccaaacgaaagaaaataattcaataaggaaaataagaacttgatgtctcatggagctacagccatttatctcaccaataaagttcagatccatttttttcttaaaaatctttttacagaacaattaagctaatgaagcaacgaattcatggtttgaaactgatatagctgagtgcatacaacttacgactcacaacattaatgcatcaagaaaatagtcagtagggcgcacgtgaaatccatgtagccaataaaatgagtaaaaaagaaaatagtcaaatctcatgcactgtttcacatttgttttcagatttattattacttattcagaagggtttatacaaagcaaaattatgttgggcacaattcttttgcatccttagtctgcaaaaataatgaagaatctgagctcctcttattatcaattggtgtatctgagctcctcttatcatcaattggtgtgcccaatattttggaagccaatttgatgaactgaatagaagcttcttaaacatgcccccacacacttatcttgtcgatagaacagaagaccaaatttctggagcatcctaatcactaaagagaattttggatggtcaaaaactgataatgcatcatctatctcgatcaaaccgagtcaacatatgactaattacttgaagaagctcaatcaagcaagtaaactaaataatgaatcaagaaacattggaaaaacatatatatacaaatgtaccatgttattatcactggtcatccactcattgaacgtgagaaactaagttgcatgggaccggcggcgctggtctagcggtgcaagggcagccccgggtagggctccggcggaagggggaaccaccacggcgtctgtaggggcacgatgcggtggcgtgcggcgtggagtcgcgaggaggcacggcagcgagtgaggtggtccgacgatggatgcatgaccagggtttgatctatcggaaagagaaaaaatttcgggggtcagcggatttttttcggaaatttcgtacgaaattttcaagcaaaattggggaaaattgacctacacctcaatggaacacagggcttggactgccgttgtcgtcgatgcaatgcgccggcgagtgcatccgccgctgttcaagccaacgggcggtagagccgctgctgtctttgtgagaggaagagcgaggaggcgacggggattggtgtggcgttgtcatcgcgcgctcgggggcggattcatctctctctcttgatggctggatctgacacggacatatattaaacttgttgttgttgatgggacgagcaaggcccacataagggttaattgggccgaagaaaggcgtcgggtgttaagggcagccgagctgattcgtatcgggttttagggttttcttcctcttctcttgcatcctcccatctcctctccggcggcggcggcgtcttgtgcgcgtgagaaagagaggagaagaagatggcgacgatcgtgaacacgacggaggaggagccgatgctggccgtggtgcgcttcaccgccgagctggcctgggcggacgccggcgccgacgtcgccgagccggaggtcacccgtctctgcgtcgaggcgcagcagcacatcctcgccgcccgctggctcgacatggcctccctcatgctcgcctccgccgacctcctcctccaatccacgcgcctccccgacaaggacaaaggttcttcccttccctctctctctcccctattgaatttgagaggctcatgttgctgctgctcatcctttccaattctagatctcgagtgcatcctcgctatcatctgcaacctcgtcaccaaggcccgatcccaagacgaggccctgcagatcgccgaactcatctgcgccaagctcacccaccagccccaagacaaaccggccctgcgcctcaaagtgtaagcctcacactctctctttttttttaaaaaaataaataaataatatatatatacattattttctagtattggatttgtcacaatgctttgcttccattgtatgcgccccacacaaggcagtctcttcagcttgtacaatctgctcgggagcccctatgccaaggccttcgtctacaagaaggcactcgacctcgccgccgctgggaaggctgccgactgcattatccctacttttaagaacatcgacagcttcatcagcgattggggcattggcaaggtggagcagagggacctgttcctcgctgccgctaggatcctcaaggaccagaaagggtgcgccttgcattgctttcttccattactttcctgacattgcagcattttgtattgaggtgatctcatgccctttcttgattgacaacagcatgaacaaggagtacttcaactttctgaataagtaccttgccaccttcgatggatcggccgatgacgctgatgcaatcggtgatgcaaaggaagaagctgttgcagcaatcattgagtttgtcaagtcatctgatctctatcaggtaattctttacttgagagttcacatctctgttgccaagtctaggatttgtttaggcgtaacgacacaatttgctccctgttggatggacattattaaaatgaacaaaggattaagatgagccccactgtgtccatatcagaacttcaatgtattatggcgattctcacatcagatcaacagatgtcgaattgggtcatatagtgttgaattcggctgttaaactgccaatacgacttttttcattttgtgaacaaggacaagttattcgctaacatttgaaacctagtatgtacttgtgctctcatctcttagtatgtctactaccctgaaactgatttaggaagttatcatatattcatgtttataaacttgttctttacttgccattttaccaactattgccagtaatccagttgcaaccaacaatgggttattgggtatggacatgtctcttgtatgttacagtccctggtctttatcaatttcaatcttgacaagctatatgtatagtttaagggcacacttcaatgcagtggatcatgcaattatgtgtcattgcagtgtgatctactcaatatgccagcagttgcacagctggaaaaagacgaaaagtatcagctggtttatgagctcttgaagatattccttactcagaggcttgattcctatttagagtttcagtcagctaattctgccttgctgaaaggttatggtatgtacaactgctgaattgaaaacattaaatgtctttacttggagcaaatatggaaaatgtgatgcttcgtttacaggatttctaatgataaacaattggcaggactggttcatgaggattgcataacaaaaatgagactgatgtccctgcttgacctcagcagccgttgtgctggggagatcccttaccatgcaatcatagatgcacttaaggtgaattagctgttcaatcctgccattgtgttactgttcacctgtcgaagaatttatattgaccatgtaaaacatttattagatcaatgatgatgaagtggagtattggattgtgaaagctatttcatgcaagatattggattgcaaagttgaccagcttaaccaggttatcattgtcaggtattcgcatctgtaggaccttttgacttacctttattttggttttgctttaacatttgtggtccatattaaggtgctatatatgtatatattctttggttaatgagtgatctggtatgtaattttcagtcggcatactgagaggatatttgggatgccacagtggcagagtttacgttcaaagcttggagtttggagggtaagccacttgacgatatctcacctttaatttgtcattttgattagctcaactgcatagtttagttaaaaaaaatctcttcttttttggttctgtatgttggttgcatatcactgggctgaagtctttaagcatttagcatggatttgattcagttgtctatgaaaattctgctgcagggaaacattgctagtgctattaacacaatacaagcaaacaaggtgactgatgatggatcacaggggatccaaggcttgatgatccgttgatggagaggggttcctgaattgaaattatagtttcaactttgagtagatgagcaatccttttgtatgagattacttgtaatgtgaattactttgatcccatgaccttgtggctggatctggattgctatggcatgctaagcaatctcattgtttttgtagtcatagcggtgcttaaaagtcggttgttacacaagtaccaatcagtcgattactaaagagttccaacagaatggcagatctattgtggcaattttccttcataacggattgatgagttaatgtattattgtttagaacatctggtgcgatttttcataacaattatgacagtcatagaacgtcttgttcaagaatactgaatcaagttatcataaatgaaagcctgtcaacaatatatagaccttagagtagatatctaactgtttagaatgttggaatttccattttctttgatatcttttgcttatttgtacgctgtgatggttattttggtagccttcagatctcagtgccctctgttctgtatatcacgtagtataggaacccattttgtttgtatcatcctatctgaagaaaatctcagcccatgaagatgaaaggtgcatccatattgatgttatttttttaattataccattatttagtaaaattaacaaatacatgatggcatttactttgttatcagatattgatcatgtgtaaaaaatttggcaacatcacatttagtctaccgggcctcatcttttcacttatgcttatcagtcaaaatttaaattttcaacctgacttattccacgaataaacgagacaatgctgtcagcttgccaaaattttggtaatgccaaattttggaaaggtccatttaggcagtaatctgcacaggccagaagaaagaatgctattaaattaaatatcctgaaacatgtattgccgtttggcttttgaacccaaaaaaatgaatacaaattgctacaacatgaacatatacacggcaaagagaaggtttttggattggatttggatagaggccgtccaagcaattatgaatcctacaaaattatgaagcaacagctgaagaagtcttccctttccgagagatgctctccaaagtataaatgtctctgcacacttgccaaggcctaatttctacagtatatgcctgaaacaatataagtaacatatattattagccttcaaattggcagggcagacgtcgtaagttcattgctattgttatatgatgcaaacttgcaataggcagtagtgatgaatataaaacaaattcaccaatttatagaaatcagctgctcttcatttacaatcattcagcaagaattaaattcacaaccatgtttctaactattcaacatagaaaagccaacacaaattgtagaaaggttccaaaatggtagtaactcattcctgaattcctttacccttttccccaaaagaaaagaaaactgagtcaaatacacaaatgaaaagcatgtgcggtataaaaataaaggctcctgactatgaaaagaaaaggtatagcaaccgaacgctaactataccaaccatactccaatccaatcaaccaaggagtcactaaggatggatcaaaattcaaaacgagtcacaatcagaagcgcaatgattaatatggtgagccctatgatagcacaattaatctgatattttagcataaatgccacgggaacacaacagataagacagagggaaccaaataatggggcttttaaaaaaaaaaagggaaccaaataaccgttttgatgtatagcacttgcgtcaatttgaagaattcataaatgagaaaaaaaaactagaatagacaagatgtagagagcaaaatcagagtccacaaagaactcaaaaaaattaatagaagaacaaacctgtcaaaggagttagcactttggtgaacatagctggtgatactattttagagggataattacatccagatctgtagcaacccgccatcctttaggatagacaacactttcagatccgaatggcacatgccagttcattatttgagagcagtcagcaggtatgccttccatctggctttcatcctccactagctgctctacaaacgcgcttccctgcaaagtaacaaccatctcatctcagctgttacactacatgcagaaaggcatcgcaaacaaaatccaagaaggggggggggggggtacaagaaaaggtcacagtattgcatttggtgataaccatgtgtttgaaagctacagagaagtatttttcagcattattcgtacacttcttttgcccttctctgaatatctgtggttcgtgtagtagttggcaagagacaacatgatgatcaattaactagtaattagcatgttgatagcatcagcagcttcttcatcagataaacttggctctacacagcaatgagaacctgcaggcacctacctacctatcttggtggactgaaaaaaatggagaaacaacttacttggagactttctttcaccatttctggatgcctgatcgaattccatgccaaatgggacctgagcttgggatcccagagcatggtgctgttgaatgcgaaaccggacatggcaagatgaaatctgcgcagcttgttcccgtcgtgggttgtgtgccatcccacaacctggccctgtttacatacagggccttggagaaccacctcgtttgtgtgttgagagatttctggaacaggccatgtggcaaacctcctgatgatggtacacagaagcacaaattaagctagtagttagtactactaacttgattataattcggtatcgaattttgagcagtaacacatatttgaatgcatcccgacactagtaagtactagtccacacaggtggtgtccttgggggaaagagccttcttcagtcatactatgtactagtagcaatagataaaagtatggatgttgaacccgattcatggcgctgtgtagtgtatatgagcaaaacttgcaaattattaatacgaatgggcatgaaaatagaaattgggtatgaaatcagggacaatataagattgcagggggtacctgatttggcggaggtggtggaagaggtggagggagtagacgccctcctcgtcggcgaagtagaggacgccgtcgaggcggtggttgtcgacgatgtcgagggcggcgttgatctggtgggggcggaagtcaggggcggaggcattgatgttgtggcagcatccgacatagcggtgcaagacagcggtgcggcggagggcggcggcggcttccggggtggggttgccggcctggacgacgatccagaggaggggtgagtcgtggaggaggcggagggtgtgggccatcctggtgaggtagtaggcctgggaggggcgggcgcgcgtgggggtgacgacgatgagcagcttgtggttgctgtggggggtggatggcgggtgcgggtgttggaggatggggaatggatcgcggtggcggtggtgggaattaggattggggatggggcccaggggtcgggggagatgggagaggaagtggaggaggccgaggaaggagccgaggaggaagaaggcggcgaagcgagggagcgggcggcggaaggaggtgtgcccagcagcagcaagcagatggtggtggtgatgagccgctgatctgggagaagacgaagacgaggagtggcggagcggcgaggatggcggggaggaagaggcgaaggggccgaggtgtccgtggcggagaaggtgctgctgctttgccggtgagtgcggccgccggatcgacgccattagccttccttggcttattatatacgagtagtagtagtatgttgatcggagctccagtccagtccagatctatatatcctcgctcgatctccactccagtagaatcgatcgatgcgcgcgggcggtggcagcctcaatctcaatctctctcaagggaggggatggaagaaaaaaaaaaggaggatgagtttggctgtgtgtctgtgctgggaaattgccgaattggaatgagatcgaatacaagaggatcggaagaatccaatcacggcgcgaatggcggggagatgatgctgttgaagttagccagcccaggcccagctgatggatggatgaagcgaagaacagcgcaaggaaaggaaggctacctgcccctcctcgtgcctgctgtggacacccaaaataattaacgttaactactcctgctcctgctgccgttagtttaaaactcacttttaacgacgcttctcttcgactacgacgcgtactagacttgtactcctctcctactcctaattgggtcaaacgctgacccacggttttgggtgggtcaagcctttcagacccaattcagtactggagtagtactgtacgccaaaaccaacaactctgcttccctccctccctcctctaggggggatttataattatgacactgcaaatattaatctttactataatgatattgaacccacattttatagacacggatgggcccatttgtcatccacacggagtgtcaaaacagcgaagccaccatgtttgcagtcctaatattgcaattttctcctcctctcttccaccgccatcaccacgcggcggaacccaacccaacgcattattattattcccttcccatcccccacccacacacactaggggcccctttgaatcaaaggatttatgtagtattttcataggattcaaatcctataggaaattttcctatttgtccatttgattcaaaggattgaagctttccaaattccatgaaattcctatggaatagcacattgtatgtggattttggaggaaatatagcaagagctccaacctcttgaaaaatttcctttgagtctatctctctcatccgattcctgtgtttttcctgcgttccaatcaaacgaccattcctgtggtttttctgtgttttgcaatcctctgtattaaacttcaattcctatcaaaatcgtatgtttttgctattcctccatttttttaattccgtgatttaaaggggccctaatttcctcctgaatcaatgcttctaacatactcccct

SEQ ID NO: 59422 - DNA, 15809 bp, Oryza sativa
ctacttattgttgctgcagaaacctgattaatatactggcggaggtatcccagtctggaaaacaaaggcatcatattccttatcgagattcgaaattaacctttcttttgcaagaatcacttggtggtaatgctaagctcgcaatgatttgtgcggtttcaccatcacagaagtactgtttgagactgacatgctattttcttttgccattcttgcttcttcatgtgcttataatttgttttttcttctgcagctgtaagagtgaaacactaagcactctaagatttgctcaccgtgcaaaagatataaaaaacaatgctgttgtcaatgaacaaagagaggatgatgtcaatgttctccgtgagcaaatcaggcagctgaaggtattattttaatttctttttggtaatcatgattttcaattaattggctctatcgttattgcaggaggagcttcaacacgtgagatcaaatgggagcttgccaggaagcaatggcagcccttccactgggtggaattctcaaaatagctttcttttgaaaatgagcttgagtcgtccaactgcattccccaccatcaaagatgatagtgatgaggagatggagattgatgacaatgatgttgaaaagccttgtaatttagaaaacaagtcttcatttcctcacggggatgttgaaacaagtagatgcaagtcaaacttggcagcaagcattcagaagggccttcaagtcattgaaagccatcggaatagtgttacttggaggagatcatcattaggtcttaacactagacttatggacgctcatctttcagttccagtttgcaaagttgatgtggctattcaaaccgaccccgaagaatctgaaccaagacaaaacactatggctctaattcctagcaatcagcctgaagcaactacagatggaaacagagaaatctctgattgcataaatctacagttagtaacagttgatggatcaataccctctaatgatctaaagcaacaggaacaagtctttaaagtaggttactaacttactatgcagatgtgtgcaccatttatctgcaatatcagcatgacaacttatgcaagggtttgttttattcctataggctgtggagaaggtccttgctggagccatcagacgagagatgttacgtgatgaacagtgtgcaaagcaagctgctgaaattcaacagctaaaacgtttggttggtgccttgcccatgctatcagattttaggatcttttattcgtcgatctgaagtgttttccttttgcaggtgcaacaatataagcatgaacgtgaatgcaatgctgcaattgcacaaatacgagaagaaaaaattgcaaggcttgaaacacttgtggatgggattttaccaactgaagaacttatgcatgcagagaatctctctctccaagacgaaaacaaggtcttctgcttttccatttattttctatgttgccaaatatctacttggttcttttgaactgagcaaagctatattcttaaacatgtctctgtatcaacaaaaacagattctccatcagaagtatgagaaccatcctgaagttttgagtgctaaaatcgagcttgaaagaatccaagaagaattggagaggtacagaaacttcaaggatgagaaggaagttttactggaggaaatccaacacctgaaaaatcagttgcattacatgctgtcatcatcaatggcattgtgtaggcctccagttgaacttgtccaggcaattagtactgtctcagatcgtccaaccatttcggctttggaagaagctggtgatgacggccacagcattgtcgatgctgctgagagtagatggattactcttacagaagagcttagagttgagcttgagaagagtaaatctctatctgaacgtttgcagcttgaagtggaatcagaaaagcaatgctcagaggaattaaagggggcattggaaatggcaatgcaggggcatgctagaattttagaacagtattgtgaattacaggaaaaacatgcatccttgctctcaatgtgtcgcaccatcaatgatgggattgaagatgtgaaaaaggaagctgcaaaagctggtgtgcgaggggctgaatctaagttcattaatgctcttgctaggcaagtatcaattttaagagctgagcgagagaaggagcgtcggttttggatggatgaaaataaaggccttcagcaacagctaagtgatactgctgaagctgtgcaagctgctggtgagcttcttgtacggttaaatgatgctgaggaagctgcatcacttgcgcaggtaacattttctgctttgcatacatagatatgcttggaaccttggtacgtagttatcgcatactccctctgtattcgtaaaggaagtcgttttggacagcgacacggtctccaaaacacaactttaacttcttgtttctataaaaatatttattgaaaagtgatatatgtatacttttatgaaaatatttttcaagacaaatctattcatataatttttaaattttcaaactcaacaacttgagagttatttatgatttatattcccaagatttgacttaaacattgtcgtaaacgacttcctttacgagtacggagggagtactgtacattaagtttgattctataatttataaagctatttatcacatgctaaattcctcgagtaagtgatcctgagtgtaagcatcttttttatatgctctgctttagactccagtacaaagccaatctgatgatgtttgcatcgatactcccagttaaaaccgaacacctaattcttcccttgttctgtttttttatggttccatgccttcacttctgcgtccaaatgaaattctgttcaaatcaactcttgtgagccaattgcacccttgtctcaggctaatatccattgatgcatcttaatttcccattcggaaataatgtactaccaattattttgcctttcatgatttgcattgtttttttatctggttctcgttacttatcttaaacctgtgcagtatcaactaaaatttaagtaacctgaaaaattagaacaatgataattgagttgatgtcactatttcatcaaaactaagaacaatattttcctttgctgcagaagcgggctgagttagcagagcaggagatgaacaaggcctttgcagaaatcgacaacttgaaaagggatcatgaccaagaagttcttgtgctaaaccagcggctcgctgaatccaaactgcccagcaatgttgtacagtcacctgagcctagtgagaccggccccgctagatacgacacaggtgggagcttcggcgatgagcaatggcgagaggagttcaagcccttccagtcggtcgaggtctccaaaagcagtgatcccagctcatggttttatgggtacgacaaatgcaacatttgatgaggcattctggagccatttatattgatttatttttggattctttcacctagaaaggtataatatgttgtacaccttgccattgaggaaaagaattttcccaacgttggctttgccatggcccatataccaaaccgcagcatccctcgctgcctagtgcctgcctgcccctatcagcaggactttcacaggttgtatgttgtgtcgcaaactgaaaactgtaaggtgtatgtttagatggattgatgatgcatgtaaaaatggcggacttattttttgggcagttggagagttgatgagtcgaaacttacagttaaaatttatcagaattatcttttttttcttacagttaaaatataatgaatttgaagataaaatttacatacaagtgtaattagaaatttatgtataatttttttttctaaaattttcggttatatttgctaattgatatgcaaaacatatattaaaagcttatgtgaataggatatgtttatgttattacaagtttgtttagtatcatctaagtcggctctatctccatgcatcgatactgttttgccgttgtcgcctctgttgtgcactcaaaacttttttctcgtttgccagcttggcaagtttttgttgcagtaatgtaagagcgagtacaatagcgaattaataatctaatctaattattatatagtaggattttagcatattagcagagaaatactccctccgttccaaaaaagccaacctaggaagggatgcgaatataaacaaagggatgtccagattcattatactaggtaggttgactttttttttgacggagggagtaaactgtatagagaaaagcccgtgactaattagacgcgcttatgcaaatctgcacatacgtgggctctctacatgtcacggcgcacaatagaaaaatagaacatgcagcaatgcccaactccttggaacaagggactgttacgattaaaagtttaaaacattgaaaccttgaattggtgaaagcaagttaatagtctgttgttgtatgtatggtagtttagctatctcttagatgtcgttggttgcacgtttattgaaggaataagttcacctgtcattcctcaactttacaccgagtttgtttgacatcccttatccataatatcataaatcttcaccccataaattatacaaaactgtgcaatttaggtcccatagcagcatagatgcctggttttgccgacgtggcatcatagagaaaacaaaaggtatgtggggcccatgtgtaagtgagacaaaataatgtgggccccacatctcttctttcttttctttattctcttctctccttctcttcttgggggctcgacctctcatcctccttgccggcggcagatggggaagaggtgaccggcaagcctgggcgagctccgccatctcaagaggctttgtcgtcaccactgccgctaccgcacctaacgatgacgatgacgacgcacacgcgccagggcggcgcccatgttcgccgccgctgcacccgacgacgacgacatgtgcgtgtgctccaccgcctgaccaagcaccccgcctttctcaccgccagcgactggtatcatctcgccaccaacgatgttttgttgttgaccatcatccatgcgccactgttggagccagccccattgacgccgccggacgccatgcctcttcccgaagactgcactgccaaagttgccgccgattgccacagctggctttgcggcaacaacaacttcatcatcgctgccgcccgccagatctactctcctcctcttcctccacctcctcctccgccgccgttgactctcaccgaattgattagtcgctcgcgtgaatgggtggatatggatattgttagtgtttgatggggaggtgggggtggtaggtgggtgaggtgtggcaagatcactggcatgatgcctccctaggtgagcggtgggatccatacggcggcggcgaggacgaggagaggccgagaggggatccatctgcactggcacgacgccttcctaggccagtgacgggatccatgcggcggcggctgaggagtaggagcggccgataggggacccgcccgcgctggcacgacgccttccctaggccgcggcgggatccatgcggcggtgaggaggaggagaggtcgtcgtcgttgggggtggcggcggcggaacctctcgaggtggcggagctcgggcgggcttggcggccacctcccccccatctactgctagcgaggaggacgagaggccgagcgcccgagaagagaagtaaggagagaggagaataaagaaaagaaaaaagagatgtggggcccacattattctctcacttacacatgggccctacatactttttgtttcgctctatgctgccacgtttatgggactaaactgcacagttttatatagtttatgggtgaagatttttggtacagaggataagggatgtcaaagagggatggcaggtgaacttattcctttatttaacattctctaagtgcagttagcgggaaattccggccagatttattgggcttatatggcctagagggctagatgtctctagaatctagatcggcggccgggctcccaccactccacactccacaggaatgctaccaccactcgtgtctgcgctttcgccacggtctccgtcgcgtgggcgcgaggaggatgcaaacggaggaggcagccggcgaggtggtgggaggcgttgtctccggcggtggcgcttggcgagtgaggctggtgcgggcgctcggtgcctcggtgctgaccgcgaagagagggggcttgcgggcaaggcatgcagctcaggtgctcgacgaaatgccgcacgaggggaaggcgctgttccagctgcggccttcggggatgagcgcgcggcagggtcaaccgccgtgaacgtacagtgggatctgggccaggatgctcggtttgaccgggttgccgcgatggcgtggcggaggcagagcactgttgccatggacatgatggctcccaattgggcaccttctgctttcatgtgtcactggggcagatgtcttgacacgatgacaaccgggcagtggagattgaagagatctagatgtgtgatcgatgtcgcctatgcggggttgcgctcaggctcagctacacggctcatacttgctgacatacgaattgatcttgatcagagtggttgttctagtagcaatatctgatggcagcaagatcaatttcccagatagcaagaaccatcgatccattctatgcgtcttcctgtcaagacctcagatcagtgttcatcagttgatgatcaagtgacaccatgatgcagagttacatgtttcactcaaggcaaaccagaaatctcgtcagaagcttcacgtcctacatctgcacaggggcagcaaaaccagaaatctcctggtcatcaagtcctcaactcaaggcttataaatagaaaggccccaggcttctttgtatccaaacacctcttcacatttttccctccaagaaaccgacccgctccactccaccccgcaacgcaagaaaccaagaactcctcgaccgccggctcgaggccacggccacccacccaccgccgccgggaagcagcgattcttcctcgggaaggaggacaccgccggccatggatccggaggcggaggaagcgcagcttcgcctcgagatggagttggcaaagaaggccaaggcggacatgtctgggttgcaacgctccagcagcctcggcttggaccacgccggcttgtatccgctgccattgccgccagggtggcggtccgccccaacctcgcccctgaggacaccatcgagcccgcccccgctccagttcccgccggcgtgggcggctgatgttgccggcacgtcgggctcggcggcgcccgaggacgatggcccagcaagaaatgccggcgctgatgaagccacggctgggtctgcgcccaagaacgaggacccagcaagagctgcgggcgccgatgatggccccacgaggtctgactacgccgcgatgatgcggatggcattggccaagttccaagacgacgatgctgctgccgacgacgaggaggcggcgtccgcggtgatggagcaggcgatgaccggcctcatggacctcacctaccgcaaagcgaagcctccagagctgccttacgagttcgccacaagatggcctattcctattgctcatgtaagtgcctgctccttggtctcttgactctgaattcttggcatttcttgtcgaggcttccagctctgttcatgttcttgtcatctttgcctctttgcaaacccgcctccttgttctgtttcttgtttgtttttgctgctggtgggtagtaggaatttctttgttcctgtttgttttaggacgaggaatttcctaaggagatcaattgcatttctttctgcatctattttgtttgttgttgtgcaagaactgcctgctgtttgattctttccctgcatcgtgatcagtgatcaccaatgggaaacatcttgtgctatttatgatcaatgaagaattccctttcctttagttgggcattattaattagcatctggttgaatttccttacacgcgctcgaattcgatcatttgtgcaagtcccatggcatcttgcctgacagttgcattcagtcaaatcgattgacccatctctgcttcttcatacgtatgatagttgcatcgaatcaaaagtttgatccatttcttacccacctacactaatcctacaattatgtgtgttcacaggatggtacgcttcaagcggaagtaatgcgtgatcctgttatcttgccttctggatatgtaagtgacaagattgcccctttgctaggattttatccaattttgttttagataatggaggtttttatccagttggaattctgtataattatctgctgggtgttttcagttttgtttgttgtagctaatgttctgccaaaaagctaagattgtcagaaaccaggcaaattatctatcaccaattgacaaaacattgattcgttgtacttatacacttgttacactggatggtagtaattagtgtccttgtttaaatattgttatttacaatgcacttctagtttttaggcttcacttgccgaacactaaaatgcaaatcctcttggattagatttactcttgagtttgcatcatcttaaatcttagattcctattttttaatctttcaaatcaaatgctaaccttctcttggttctgttaaaattaacacccgcttcctgctttctgtagtagtttgaattgtcaaatgctgcttaggtttgatactttattcatgcacgttatgatggttcataagttcatcttatgatataatgactagaatgtatagtgatcctgaaggatagaacacgggacaaaataataattttaccctagtttctttcatttccattcatgcatagtcttttgcccctttttctataatatcctgtaccataacttatgaacattttggcgatttagcattctattgcttgatatattgattagtaaaactttttttttttgccacaataagttactgtgtgctgtttttctgaagttagctatggtggttatgttctgcaaatccaccatgatttggattatcccagtaaccatattttgcttgtttggttgcagtctgttgatcaaacataccaaaacaaccaaaaacggcagaatccatggacaaataccagcacatttactgatcactccttgccctactctctctctgttccaaaccaccttctccgtgacatgatttctgcatggtgcctcgatcactcggacctttccccatctaccacttctgatacaccttccactcccttggaaccttcagaggaggaacaaattcaacgcatcctaaaactattctcagggaattctgcatcgcaacgagaggctttgaaactgatccagctactcactaaaaccaccaaaggggtgcaaccttgccttgccaagtatgcggacattatcccagtgctgataaatcttaggaggaaatataaatcgagttggacacaagatcttgaggaagagaggctcacaataatcctcaatctgaccatgcacaggcaaaacagggagatcctagctggacagaatgaattagcaggtgctataaaaaaaattgttaagaaggctggcaatcgtggtaagcgaacatcatccttggcgaaggtagcttctatagttgctgtcctgtcagagtttgacatgttcaggaaaagaatgctggatgctggtggaatgaaaatgcttcgaggtatgctcaagataaaggatactgaagtgataacggaggctgccactgcgatccttgcactctacgcagatggtgaaggcgagcaaccagccagatttcatgaggtgcctcagatgctgctggaatgccacatgttcactgatgggatcctgcttcttcttgaccgtctgccaaaatccccacgtgttttcagaaaaatctgtgatcaggctttgcaattggtgaatatcgtcatggctgaagatgcaagtgggccggtgacacgtaagggcatcctctcagcaatttccttgatctacgagattgttgaaagggatgtgggtaagatgaatgcggtgaagaacatggaggatttcatcgagcggttgcgtcagctatcatcagatagattgccgatgcagaaaatgctccaggtggagagaataatcaggactctgtcagatgcgtttccagctcctacggtgcgagggcgatgccaagaacccagtggaagccgtcttctagcttgaatcttatactgttcttctgtacagatctcaaaaggctcgagattttacttctgctcgcttaactttctggagaagtttgaatttgttgactgtgcagcaatgtgatggatcacacgaacaattcaaagcatagacagaataactttgtttcacttcctggtgagagattgtaacaaatgattggtgttagtaactgaccgaattgaatattattgtgattctgtgtagtactcctgtatgaagagaaaaatcttgtatcaactggtgaccattcgtttcttttctcgagtgttacaattggtatataatcccttgttaataattttgtttggagcaatatttcttatatatagaacatcttctatgagcatcaaacttgggagtcaaatgcaacagcataggactcggacaagaaggtaaattatttattttttttaggggctgtctatatatcatgtgacagaaaatcccacctcctatcattcgaattttggaccattggatgtgctttaagattcgtgcagccccttaaccctaactcctcctcctccccccggtttctagatcatgccgccaccctcctcccgtcccacgcgcgatccgctgccgccaccaccgccaccgccccaccgcgccgccgcccgcctcgctggctggccggaaaaggtcaacggcgccggtgaggcccccccggcgagcccctccccctcccccttccccctccccttcccccctcactttctcctcatggcgcaacgacgaggtgcccccgccccgccgtcttccccgtctccggcagctccccgccgccggatccgccaccaccggccgccgcctcctaatcccacccttgatttgccctcgccgccgacgccggcccaccgccctcctccatccccacggcttcggcgccgccgccgcctcgctgcccgctggagtccaccgcccaccgcggtcctccgctgcccacggtcatccctctaagctccgaggaaacccccctcttccccctcccccaaccctcctcctaccctcaccccaacctcaaaccctaacccgccggagttggggtgtcgccggcgccggagaagaagaggagcccgccggagttggaggagagaagccgatgcacgaatcttggcatagatccaatggtctaaaatctgtaagatttcatccctaaatttcattcgaatgccatatagcaatcccggtaaactatttctagttccgtataaatgtttgtgtagaagaagatctaacgaaagtcaagccagggcagagcagaagaggatcggtcgtccgggcggaaccaaaacatcggacaaacttgcaagatgctgattccagaaatgcttataattagccgtctgatgaaagtttaaccacatcatcagcgttagttgtgcggcatgacgtcatggaccatgaccatacagtctgaagaagcagtcggccactcatttaaatcccaaaattcaaatgattttgtctattcaactattcatccgatctataatctaattacacggttggatttattacgattatatctttataataagatctcacttgataatattttgatgggtttttagtttgttgcagtcttaaatgttgcacgtagtgttaattagatgttgcaataaatatttcgtggtgttcactatgtaatttgtaaatgttgcacatgttggcgttttgaatgtttcagcaatattttttatttttcaacaactacaacttgatgattgatgcatgctataacatagaacttaatgtttcgtctaattgttatcatggttgcagacaatatcttttaaatgttgcattctataaaatatttattaaatgagttgaaacatttttttttgcatgcgatgaaacaattttatataaataatgaaacaattcttttaaatgttgcatctctataaaatatttattaagtgagttgaaacattttttttcatgcgatgaaacaattttatataaatagtgaaacaatggttgactatatatataatttcatcaatgtgatatattattctaacgatttaattaagacaaatataatattctaatttgatcgtgcatcatatatgtatttttaaaagaaaatattgtgtaaagatatgtaatgaataagtacgtatatataagaaaatggggagagaaaaaaaaatagcaatgatggtcaaacaacactgcatgtgagcaagaggcatgctagttgctatgtggcagtggctacttgccagctagcagcgcatgcaacacaacagcagggcgtttttttgacaaattggtccttgcagaaaacttatttcgaaactagtccctaccaaaaactatatccagaaataggccgtcggatcagcgccaaagcggttggtgctgaggttgttcttatctgcgccaacgggactggcgctgacatcgcgccagcgtggcgggcgaggcgcgatgtggcagggcctcagcgccaatgcacttggcgctgacaccttgcacaccctaaatagaccgatgtgcggcaatgaattaacggtgtcgctcgtggtgcaacggtaagtttctttcttgctatatctgaggactagggttcgaatcccaggtcagccatttttgtttttttttaaaatcatcaatctacgtgcgtatatattaatgatgatctccattttcgtttttgtcttcaaatcttcaatgtacttttttttgtttaaattaatttttattaaaaagaaatatcacatttagtacaaatttaaaaagtagaagaatggattaaaaaaagtttagagacaacttttaaaagaaatatcacttttttataaaaaagaaattagaagaatggatttaaaaaaacttgagtttttttttaaaaaataaacaacaagttgagaactaagggtaagttttattctaaaatgtcacgtgtttttttaaaattaaaacaacacttgagcttgtaaaagaaatatcacttttttaaaaaatatttaaaaggaataacacatttagtacatatttaaaaataaaagaatggacttaaaaatacctgagctttgaaaaagttaaaaccgcaagttgagaactaagtaaaaaaaaagtttagtaaaaacataaaggagagggttcgaaccctggtcactgtaacgccacctttcaaatacctaccactgagctaagccaaacctaattgttgcttttgcttttgcttttatttagccagtataaaggccagcgccgctgtagaacatatattctgatatatatatatatatatatatatatatatatatatatatatatatttaaaaaacagagagcatcattaatcatttatatgtactaatgtacgcacgtagattgaagatttgaagaaaaaaaaaagaacgaacaaggctgccgtgatagggagtcgaaccatggtgctagggtacacaagcaaatggtcataccattgcaccacaagtgcattgcttattaatggccgcgcatccttttaattagcctgtacaaggggtcagcgccaaatacattggcgctgaggccctgccacgtcgcgtctcgcccgccacgctggcgcgatgtcagcgccagtcccattggcgctgatatgaacaacctctagatatagtttttggtatggactagtttcgaaataagttttctataaggaccaatttgtcaaaaaaacggcaacagcaggggtagaggggcatgcggagcatcgtctgatatttcgcaaattttcggacgtccgacgtatatataagacatgttgatgccgaatcgctctgattagcccaattgcaccagtgtgggctgtgaactattattgtaacggtttaaacatcttatatgtttatatattgtaaactagcaaggtgtcccgcgtaaattgcgcggatagtatcattatattttctctcatataatagcatatacgttttgtcattatattattaaaatatattacaatgacaacataattttaaattttgcaataactttacgaaactactgatgtgtaatatttatattgtattttatatacgtgttagttattaattatttttaatatcaaattttagttatttgtaaatcatatatattcctttatggactttagacttgtcttttaatatttttttttaattttgaatttttattatttctaattgtatttctacgtggactctaaactcatctttcaatattctttaatttttaattttaatttcagttacttctaaattgtattcctatcttaactttaaactcttcttcccatgttttttttaatttcgaattttagttatttgtaaattatatttttatacggactctaaacactacttttcattttattatgtttattctgaattttagttagttttaaattcctatatggactctatactctacttctaatatttcttattttttaattccgaatttctattttttttcttaattgtatttctatatggactctatactctacttctaatattccttatttttaatatcgaatttccattatttcctaattgtatttctatatgaactctatattctacttctaatattccttatttttaattccgaatttcagttatttcctaattgtatttctatatggactctagtctgctcttctaatattctttattttttaattccgaatttcagctatttataaatctttttcttttctccaattaatgtgagaattttaggtcatgagagcgaacgtggaggctcctttttattccgaattttagttagttttaaattcttatatggaccctatactctacttctaatattccttattttttaattctgaatttcagctatttctaaattgtatttctgtatggactctgctttttttctttttctccgattaatgtgagaatttctcggtcataagagcgaacgtggaggctctttttattccgaactttagttagttttaaattcctatatggactctatactctacttctaatattccttattttttaattccgaatttctattttttttcttaattgtatttctgcatgaactctatgctctacttctaatattccttatttttaattctgaatttctattatttcctaattgtatttctatatggactctatactctacttttaatattccttatttttaattccgaatttcagttatttcctaattgtatttttatatagactctagtctcctcttctaatattctttattttttaattccgaatttcaactatttctaaattgtatttctatatggactctagtctcctcttctaatattttttattttttaattccgaatttcagctatttctaaattgtatttttatatggactctactttttttatttttctccgattaatgtgagaatttctaggctataagagcgaacgtggaggctcctttttctattcctttaatctatatctatctatatctatataactaattaaaaaataagtaaggcttccggttaatcttttcgtccgtcattaag

SEQ ID NO: 59423 - DNA, 12265 bp, Oryza sativa
attcctgcagcccggaaaatgtgtcacgatatgattcaagataaatggagggggcataagaaattcacttgaaaaaaaaatcaagttgaaatatgatattgactaagcagcattttgatgaacatctctgggagcatcactgatttcagttcttcctccttttataatgttgcaaatccaacaactattttccaacgcaattacaactttttaatgaaaaattagaaaaaaatagatggcatagggatttctcaaatctttacaagcattacctcacaaagcaaagttatctactccagccaaatgacatgtttgaaactgatttattttaatggtctgataacagtgcctatcatcagggcttttgaaactttttacaagagcttagggcacaacacaacattgcaactccataccatccctatacaagtgcagaaacatccaataaacagatcaagaatgttttgaagaaaaccgtccatgagattgggaaagcttggaagcataagctacctgatgctctttgggcatataggatcgtatataagacgcccattggcatgtcatcataccatgtcatctatgggaagacttgccactagcccgttgagctggagcatagggtgcattgggcgatttggacttgtaacatggatttaggacaagctggatgccaccggcagatttagctatcggaaccagaggaatggagagataaagcttatcacaatgccaagatgtacaaggaacaaaccaaaagatggcatgataggagaatgaaatcaaggagtttgaaccaggaaacaaggtcttgatgttcaactcaagggtaaagctcttcgatcgtggaaaactttggagcaaatgactaggaccatataccgtcgtcgacacttcgccacacggagcggtcatgctgcgcgatgatgaaaacaacgttttttaggtaaatggtcactgtttaaaagttttcttagaacccgtagaggggttggggcaggatttagactgttgaattggtagattttaatgcttattttagagaccaacccaaaatagtttcgagtaagatgcgaaggaattttaataagaggtgattaatgagatgagtagaactctaaagtggtcacttatttttggcacaaatcgaaagtggtactaattttgggccggagggagtaattttgattaattaagttgtattgttttgagttattgtgattattgccaaacccatgatttgctatatcatgttccttcgtaacctaggcatagatttaattgtaaaacattgccatagaagtagatagtaccacaaaaccttatatcaacacacttgttttgtctgtcgtcactttggctttatcatgcaagtaatatgtttatcaatatgtatacgatcaaagtcttgaacgattgcgtgtgctttcgggataccatactaatcaaaccctgtatccccaaacatggctcaactagccaagctacgcccgcttggccactaataggtggagttgggcccacttgtcatccccaacgtcatgcaggccatctcagtctttggccaaaaccctagcacagctggccgcccgattcgcctaacaattaacatttttccataaattaattaaggggaatcgatccattgctcttgctcttcaattccaccacttttctcagcacatcaattgcacactatattgaagtgaagaagaggcgtggcatggatgcgccacaacttcttgtctgaaaagggggctatgttagctagatgagaaggcaagatgacaagcctatttggcatatgccactaatcaactgctaatttcccactctttaatgcaataagtaaagtacagaccgacatgtatttttggctggagcaataggatgatagaaaaccaaacatgtctgagatgggctgtccaattggcaggacaaacatacaagtacaatgagcttgttactttataggatgtaatttgattgagcacctgttaacgaccaaatttggtaagatgtgaaccaggttcaacattaggatcgaggcagattcgatgaagagatcgattcgaagaacagagtatgcatcggctgcgaatgtatcggctggagtgtacatcgactgggatggatcggatagaggatagccgatacagccgatggaggtaatgcagccgattacaatgaagacggtttcaaggctgtttctagaattgttcaaagtgcttcatagggattgccacgatggagaaaaagctctcggtttaggcaattgtatttattaattaggatatcttatataatttccttagagatatgtttgggcaaaagtctgccgcaaagacttatggtatcttagagtttgatagagataagtgtagtgtctggcaaggacatattttgtatctcgggtataaatggagcctgaacccatgtaatcaaacaacacacgttcaatacaatctcggcgcatcgccactcttttactttcgtttactttcgacgagttcttgctttcgggttgagctgcatcagttttgatcttcaactagaggtaaagcttgttatgatactctaatcttgtttatgtaattcgtcgagttatcatatatcctatataatctatgacaatattgttatttaaccttcaatcggccaacatctatcattggaaagcaaccgattaggttaaataccaatgttgccttatattatccaccaccctatgaaacattcaacggcttgattgtctagatattttccttcttttcatacttatagctgcatcagttgagtttgatcttataagtcgtgattagaatctcaatctctaacctgcttttggttaccaattagggtagtatcggagtttcagccgatcttacctgatttaactcttttatatctcatatgcttgattgatatgttaaatccgcccttatgttaagatcttgctgcatttaggtatattaagcttcccgtttgatatattttgcttgctttaatatcttaatatagagtgatatcggagtactagccgatacatgctagatctatctgatcggctatgctatgaatgcttataatctccttgttaatatatatttcgatgtaagtgatttatattgtctcggcatggcgaccgatctatcccaatcacttgatttaaatagatatcaacgaaagcattatatactattgatatctacagccgattgaatagatttagtcctttcttgcctatttatgactgacgatcgattcaaatatgacatcggctcaaagataaatgatacatcaccggcgagtggccgatcagctattatttatggatttaaccgctattttgctgtctttatttcttgttgattgctggatcaaatcaactggcacgctcacgaacctaaaggcaagatttttggacctgcactggagttaagcagatctcctaggcctcatgtttttcgcatcaacaacacctaatacatatattattaagcatgagtacataaataagctctctatatgtttccgcttaggcacataagtttttttgtggaatcacgtaaacctaatatctgatagcacatttgttatgttctttttgaagaggcattatttgttacattggcatttatgagcagcttggagcaatgtgagtaactggacatacattcaggctagtgtgtttagcggcaataagtccaggtgcctcccgcatatcaagatccttgtgcaacattccattgggtagcttccagtcaaaatggtagagcaggttagccaatgcaaactccatgttggccagcccaagattaatgccaggacatattctgtgaccagagccaaatggtagaaactcaaagttactccctttgtattctatattgttgttttcgaacctctctggcttaaactcttctgcatcctcccaatacttactatccctgcatattgcccatgcattcacaaatacagatgtacccttgggtacatcataacccatgatcgtgcatgtctcacggcatttgcgaggagccaagagtggtgctggacaatgtagtctcaaggactcctttattaccatcttgagatagctaagttgggcaaggtcatcttcagtgatggtgttctttccttcaaaggcttgacgcacctcggcttgtgccttggccattactctaggggaacgaatgagttctgccatggtccaggtcagtgttgttgacgatgtatcggtgccccccgcaaaaatatcctgcaataatatttttttaaataactatataacatgattatttttcttaattcatttttacataaacttacacaatatggatctacagtacacatagcttaaagataattctatagcccctacccataatcccattttttaagcagacaataataaattggttaagttaattactatcttacagtactgttgtgtatgctttgctcatttgatctcaatagctcatttttttgtactcgtaaacttgtctcatagtcccactgcatgcatgcatacatgttatgcaggacttctttctcttctcttcatgatggttgctctcccgatatgatatccatttaaaaccaattactttgaaagtttcaaatcatttttttctaaattatttatccaattaataatccgatcacaccattttattacttataatttaacatttacaataatatcttacatgattatatttttgacgtaaataattttgtcgacaaaacgggtgttattttaccacatacaaaaaaattgtttcattacttgaagtcaaatatttcaactcacttcataaaatgtttcaaactaatgtaaaatttaaggagtactaactacaacactggcaacaactacttgaacggtgggtcctaactagtgaaacatcaaaggaaataatatatttgcaaggaccacctttgctttgttttgttgaaatatcattatctatactccttataaatgggagtagtagtgatggtgattctaccaccaccccacactaattcccatattttttttaagaaaaaaaaggacatgtgaggttagcaagtgcaacattatgtggtaacaattgaaactactcccatcaactctacttttgtgtggagttaacaaggttcataaacgcaacattatgtggtaactattgaatcatcacatattacttggtgaaacattcatggattaccacgtgcaatatttgcaaatgaactaataaaatataagtaaatactaattgaaacatctaaataagtcagtgtaaaacattaaaaaatatatatgaactattaaagaaaactaaaaaatcacaagaatatatcatctaaaatcttatagtaattaatctacgtgctacaattaattataggatatatagagatgtgtgatgttggcttaccatcaaaagcacaactataacatcatttgtaattggcatcggtgcgccgccttccttctggagcctgagcaggacgtcgagagagcatgacttgctccccgccgccgccgtcacctgatcgccgctcgccatgtccgcttcaatttggtccctccgttcttgaatgatttgctgtatgacgcgctccatcttgttgcgggtctccagcgccctccgtggcgccgtcgcgaccatggacgcgagcttggacgacgggaagaggtcggcgacgctgagcgagaacgtctggcctaccatgtcgtttagcgcagccagatactcatcgctgtacttggaccggctcccgacggagcaccggagcacgatgtcgttgatcagccttgtgatcatctcggtgaggttcacggccgtgccgggcgctgcagcggcggcggccgacacgtcgcgcacgagccgcgccacctcctcctcgcggatgcgctggaacgagcgcacccgcgccgcggtgagcagctcctgcgtgagcagccggcggaggtggcgccaccgctcgccgtacggcgccagcgcgacgtccctgccgccgaagctgaacgcgtcggtgccgctggtcaggtggcggtcggcgaacgccaggtccttgctcctgaggatctcctgcgcggcctccggcgacgaggcgaccacggtgggcacctcgccgaaccagagctgcatgacggggccgtgctcccgggccagcctccgcatgacactgtgcacgctctcgctcgacgacacgaagtggtggatgctgccgatcagcggcagcgtgcttggccccggcggcagcttaagcctcgacggctttgtgtttgtggcacatgaaatcaccggcagcctgtgcctgtggcagactaccccttggcgcgtggcgagaagcaccatgtcgcccatgtctctagctactgtactacgtacgtgctagatagactactgtggtatgtgcagctttactctacagcattggatcgtgctataaatagccgtgtcattgcgttcttaatatctgccactaatgctggccttattctaaatttacggtcaattaatggaggtgtatactaaagggcagcgtggaaatatatactccctcttccatcccataaaaaacaaatatgatataatttaacttttttatttatagtatttgttttataactgagcaattttctattctaatcatccaattagaacacgctctttctccaaattttagcatgtattaatttagttaaatctgtaatttttgagtgaattaaatcaaacaaggattccgtgcacggtatacagatctcggatactcattaccgtgaaatatccagtgaataaatcaaataagtgaaaacccattaaaaacatatttaatgttctccaaattcatgaaagaaattacttgagaatggcataaagcatgaaatatattcattccaaatctcaagtcgaaactaaatttggttataaaatgacaaattttagatgaatagtgttggttaattaccactacaacagaaacacaaaaatacggcactttaggtgccgaaaattatagattagacacctatagtgcacttttcacccaagagcatgccaccgggatgcctttgggggagaatcagcacaaatgtggtgatgtaggtgccggtttttaaaggagctgccacctatgagtcctagctaggagatataggtgttgatttctaataagaactagcacctattaaattgtcattgttggtggattttaattaaaccgacacttatgtggaagaacaaaatcaccgtcccaccggtccgccaattagtcaatctccttcctcccctcatccttatcctctccgcccttcctattctctcccaccccctcatctttatccacactcccctctttgccagcccctttccatgccaaggcaacccttcctcctgactccaacgccctcccccccttcgtttctcaagcggatccatcaactacaacaaccgcagctcctgcgggcagatctagcggcttccgtgggtggatctagtggaggcaacatctcttgcaggtagatccggtggcggctatggctctctcgcatggaggtggcagtggcggcgatatcctcgacatcccaatgaacaacattggtaggcagaattctcttttgtaattagttctcctctacagtgagtgacaacacaacatctccttggagttggtttctgatgaatatttgatgaaactgttaaccgatatttggttgatatttatatgaattgtgctttcggagatgttattggattaatcgatggtggtatagaggtgatggggagcgactcgattcgagccaatgcatcgaggaagttcccaaatcatgccgcttcgtggtgctggttgaggaatccagtacctatatgggagttccagctagcaccaaagtatgtttacatagtgcactattcgcaagaaaattttgtttttattactcacaaataaagttgtgtatgaagttaaaattcggcgtgaatgtatcctgtgcctagtagagttcaccgtatatatcacgaataatttttttatgaatgtacaaaatgttttaggtctgtttttcgatttcatgatttttaccgtttatgtccctagataaatagcatcgtaaataaacaaattatgtactggtatataccacttaattagatagatagaaataagaaaaactagagttcacctggacaaaagcgatgacacttcttgctagacacatcgctttcttggacgtactctgctctttccagtaatggaaaaggcagcgcagggccgcatggcactgatggcagtagtgaccaaggaaccttcattatctcattttcatttctccttaccgagattgactaaaaatttaaactaacgatgagttttttttcttaatctctgtcctgaaaaatactccctccttccactaatataagggattttgatattttgcttgcactgtttgaccactcgtcttattcagaaaaatttgtacaaatataaaaaatgaaaagttatgcttaaagtactatggataataaagtaattcacaaataaaataaataataattttaatatttttttaataatgcgaatggtcaaacaatgcaattaaaatgtcaaaaccccttatattagtggacggagggagtacatatattaaatatataaattacgatttccattgtaaagtgaaatatctatcactaaaaactgttacgaaaacaagcatagaaaagtcgtttatattattcaacgtttcaatagttccgtttggaaaaaatgtaagaggtatagacgtgcagagaaccgctttctttttccaccgcttggagtaataattccaagtcaatcggcgcgtattcggaaaatatattgatggtctagcacgtacgagaaaattgaacgaagttcgagctgtcattttttttccaaacacgggttaaactgcgcggtgaaatatacacgtgtttaagtcatagatttgtcacatgttgtcgtatttacaactaatttatgatctgacatgcgtgctttgtgcaaatggtcatggagaaacaagagagaaccttttcttcttctctccttttagtcagagattatgttggcggcatctgggaatcctgtgagattctaatctcaatttcttccgaatagtggtgctggaagtcttcttcaatgttgcctagcatatttgcctagcaacgttcctttgaagcatggagaagtttgttcatgagagaagtgtgtagaatgaatgatgccctaggcaagttgttttttattggttacaaactttgtaattttttcaggtgctttccttgtaacctttttcttgtaaatatttttctttttaatgaaaatcacactctgagacaaagccctggcagtaattaaataaaaaaactgatcgaaattaaagctaatcgatcctctaatatacgaaaaggttgcatattaaacaaccctataatagtaatactatcttttctttgaaaacatataaaaattcacccccaacacctcccaccaaaatagtgataagtgggataatattcctaaggtggccagattatttatagtgtgcaatagaatatcggtaatgtaacaccctgaaaatttgaccaataaaagcaaaactctaaaaatacggaccttcgaaaacttttaacttaattgcatcatgccgatcttattcgcctattttatttggatttgtttttgaagttcattaatcgtgagtaaagaatagttaattaggaataaaccctaaaagtaaattggtaaaataaatataatctaaaataaagattaggtgtggatagaaataaataaaatattatcacgatcatattcgtatcaattaaatttaaatgcgatggaataagaattaaccctaattaaaaattcaaataaattatataaataaaatatgagtaatattaatttagggtgaattcattagttgagataacacaaatattgagtaaacttcatttatgcaagatttagaaattataaaatcaaatttatatgggaaataaactaaaatcgggataaataggaaaatacactgttcattatagcgtaggtgttcgatgcggtccctagccttccccctcctctcccacctctgcccctagccgccctgagcccgcgccgacgcgccatcgccgcttgccgccgcatgccgtcgccaagcgtcgcgcgccactgccgtcgccgcgttgagccctgcgcgccatcgtcgtcaccgtcgcgtcgtcgcctcgtgccccacgcccctgcctcgccgcacgcccgtcccatctcccatgccgcgcgccgtcggtgagccgctgcccccccgtttgtcgccatgccgccgggtagagagagagccgagagagagaagaagggagaagccgagggagagaaagaagaaagaaggaaggagagaaaccgggagggagagaaagagaaggaaaaagaaaagaaaagagagaaagagaaggaaaaagaaaagaaaagagagaaaagaggagagaaaaagaaaagaaaaaaataaatagaaattagtgggagattagggaagtttagaaaatttaaaataattagaatttaattatagattaattatagtcgtagaattgcaaaatttaatataaattatggattattcttggtaatttctataagaaatcaattcgcggtagtaatttagatgtaattaataactaaacaaatagatgaattcttatagattattatagattatttttgggtaatgtctataagtaatcgattcacggtaaatattcggatttaattactaggaattttagccgtgtattatatttaatcgtttagtcatagactaaattaaatcgtacaatattataagataattttaggattttgtccgatatttagctcgcgatagaaatttctaacctattatatggatataatgctcgggtagattaaattaaaaacttatggtaacaaaatatttgtatccgcaaaaatagtttaggatgtataaatcgaaattgggtttgccctagttcgcgaatagtaaagttaataaaaaaagaatcgactttcgcattcgacttccatttggatttatttggatttttatttgaattctaaccgaattcaaatcaattttcgcacgtaactatagagcccgagggagttgcggatccaagtgatggccaggacccgcaagactttgagcaaggcaagtcatcactattccttgaacatgttcatcctatttgcaaaattattttgtttacaaataaaattacacgcagtgataaacatcctacttgtgattatgccatgccttgattattgtttacccttaaatccttgtaaccatgatttacgtataagtccctaatcaactatgacaaatgcttagaaatgctactctagatttatgcatactcatatttatcaaaagctatatgcttgggcaattacctttgggaaggtaattgagatgcggcatgtggagacatgagcggcacattgccatgatgttgatgacatgatttgtgaaaggagaaataaaattaaacaactgttttcgactggagcggacggaggatttgggtggtatccggaaaaggctagtaccatccccggtcaattaaggaccgagacatgaagttaagcatgaaacgacccccgtacaaccgcacttctcgtatgggtatagacctagcggaatagatagctgagcggaggcagtatccatgcatagtggtttcttgatgtgtgaggcaggggctctacggtggggcagccattggtagaaccttgaggcgggtgtctacagtggtgtcgccatcggtaggactgccatgagagaatttaaacataattataacttaatgcatgtgtgagtcttcccttcccgggtgcgccagaactcctctcactgcaagaaaccgtttacgcctagagtgcatgaggatgtaaagttcatggagcgggtactgccaatgtgaggttatcgaaaagctttgccgtgacgcgtctcatgtgttgggacgaggctcatgtgttgggcagtcgcggagtgctggtaaagtgtacatccactgcagtgtgaataaaccaaatctagtcgaatagccgtgctagcggttattgagcaccgggacgtgtattacacttggctagactctaaattcttaacttgtgtgggatgggatattgcatgatgatttctatattgatggagccacttcttgagaggcgggaatgtggacgtcctcagaaa

SEQ ID NO: 59424 - DNA, 1068 bp, Oryza sativa
attgcattgaaaaaggagctcattcagcttaaatctaaagtgcaaatactggctggcacatgtaccatcatatgttctttatatgactgtcaacacaggaagcaacctgaaagtttcacatgtttgatgtagttggatggatgcttgtgtttcatgaatctaaaggttttgcaccttaaggctaacggtttgcttcattgtgaaagggggttttatacctccaaatgataaaaatcagtttatacagaattaacataaagaagcctaccaagtgatgaaattgccgatatcgcctgttcttctcacatcaaccctcctctaccccctccatcatggagggttagtagtgaggcatgttcccctgtctcagaacaatgatggtgaggtaagacaggacaattttaacattctgttgattccccacagaaacctaaccgcttggtctgtagctacacattggaagctgagatgtaggactgatcaaatttttcgctgggcaggcacaccaaagactctccgttaaaacacaatgacctcaaaggatgtgcaaaaggcaaggacacaatattattattgtactgttctttctagttatgtggacatggtgcaaattcagactaatgggcgatagacatgacatgaatttgtggctatatactgtttatcttggaattatttggtggcatactataaattagacaatcttttagcgagacaaccctctgccggatatgcttcagagcacttaacaagcaaaaaataatggccaccgaacatctcacacaatgactataggcgcactaaaaggcacaatccaaaagtaaagatatccataaatgagacagcaacgaaagccaacagaaaaaacattttataagagctgaacagtaaaataagaaaatggtggcattggaagataaagaaacttagataactagatccaccagcgaatattctcatataataatctgcaccctacatgcattacaatactatatgaatcatgcatgcatagaatgtccgcatggcactaaacttaacatgacatgcacttttgctgatctaatt

SEQ ID NO: 59425 - DNA, 2293 bp, Oryza sativa
gagtgagaacatatgcataaatcattcatatagcatccaacacgtactgatgcatcatctctctcattacgcgacatacagtacagtatacaatataaatgttgttttgtaagcattctaatgaagaaaaaaatctcggtacgcatcgccaataagaatttcagcaaaagaaaaacgatatatttagtaaagactactgtcaatttcatccaactttttgtagaagattgtagcgaggtttccccatggaggacggcaatcacatgaggcggataagatcggaggagttcctttcatctccttttaggaaatttaacttccaggggcgctaggctgtccctgtacaagccgtcctctgcttgctcagccagcaacttggcattcttcgtacagtaccatggtgcacgcatgggttatgaaaatgaaacgaaagtttttttaaaaaaaaacaaatattttgaagccaatattatagttataagaagtatttgttgccaagattgaagctatgtaaaactgtgatgatcaataggacaataggtgtgagtgcacctgtgatattggtataggcccatttgtcaatgtgtgttacaagattattcgacagtaatagttttcatgtatgggttgtcagttccatttccatgtccatgtcgaaatgaaatatctggtaattgaaacatcattatcaaatgtttatttttagagatcaaattgcagtaatttgccggaacggagctgatgatatatgatcacaggttttttttctttttggcatttcatctctcttctcatccacatgaacccagtgagtaactgttgctccacaatcagtgagcagtgaatgtcaatgccaagaacagtagtatatcaagattcagtgaacaacatcccgagagtacttacattttggatgtcgtttggtgccaattggcagcattcagaataatgtgcagagaatctcatgcccatcatcttacgtttcagaacagtagatgaaaattcgcaagccacagaatgatgacatggaaggccagtaggagcacagtaaattaaaatcagcacaatccattgctccccttctctgagcttggttaaaggattggagatcagtggtgctgatctatcggtcgaaatcagtgtagctgttactggaagcccttcaccctctgaaacacgctgtgagctttgtgaccaggtaggttcagccgttcaggggatccaaattccaatggcatcaatcaacatcgcgctctacgtcaatttcgagccggtgcttgccctttgcaggcagaaatatacagttgaacaaatactgtactacccctagcatgttcctttgcaaaccaccactttctgaagtcatacttgtatcatattcatatgcctaaccttggcgtatccctcttatgctgttatgcaaataggatggcataagcttcatggagatgtaaccaggcatgcaaattctaactcgaccaagatgacaggaggcggctgcagtatttgggcaataaaaatggcagtttcaagtttcaaccatgttctgcagctgagggctttggtggtgttttcttttcctttaagtatctttaaaagggatacaagtagtaaccaccagttaatgaaatcccagcaattatgtcaaaaaaaattgaaatcccagcaaaactaggctcttttggctctagttcctaccgggcatgctcccgtagaaaacaacattacgtcaaacttgggggcaaagcactcattcattttcaatatcgatcgtttaaattaattgttcgtcacacatacaccatcttgttcagtaatgatggctcacattgtccgtaatccctgcttaactacatattgactccctcattttatactcaacaatacacaccagactcccacactccattttcacagtgactttatttagcgcaccgcaagctgcaccagcacactcctcatgccaaggagaagcaaataagataattgctccaatgctgccttcctcgagcaatcaggggaatggcttagtgcgctcgccgggtgccaagtgccaaatggccttagaagactataatttttgtgcagctcctggtctgttcacagccgggagatgagcagtgggactgagacagtggcggtctgctcccccattgcagggtggcacatctccagcatgtccagctccctgaaccgctcaagaaccctcattcggcactcctcagctgccatcagaccagtggagaaggcgccatgcacgtgccagtgtactggacactggtggcttctccag

SEQ ID NO: 59426 - DNA, 16698 bp, Oryza sativa
ataaaggagagaagaaaaataaaaagagaaaaccttgtttgtggagcagtccatccaaagcagcccggattggattagtgacgaggcagcccatccaaagcagctgcagaccggcccagatagcagccgcagcccaccagcgagcccacagagcggaggagaagcagcccaccagcccagcacagtactgcgcaacactgtagcaaccgaacacgaataaagtaaagaagagatcttattacttaaaacatgtagtcaccaataaaatgaattatttaccgacaaaataaattcttttttaaaaataaaaataatcacatgtgtctttcttttttttaaaaaaaaagtaatcaccaacaaattgaatcgtgtttacatttggattttttttccctcatcaattgctcattcgccacaggacacctaatcacatcactttttttcattcatcgtataatttcttctattatttagagtgaaagttattctgcgatataccacatttttttctttccttctgattatttaagtgagtggttatgcaattggagtgcagtgaggttaatctgatagctagcaaaaaatatatcttatattatggttactctttacaatatgaaaaaaagtgcttatcaatatcgagtaaaaaaaataacaaagtactgcaattgactcataataatacatgacaaaaaagtaaatatttttttgtggtttcaaagtttagtatccatgtcagtggatttagagcaacaaataattatatcatgttagcgtcttatttgcactagaaagattcgattcgactataaagacctcaatgaacctggtgtttatgctcccacacactaattactatttttttcttcccccagtacaacgcatgggcattttgctagtaatataatagatagattgcatctatatcgtaagtttatgcacggcaagcaccagtgtggaaattctcggatttgtaatgccgttttttttccggctgaaaccaaatagtgtcgacatccaacaacacacacatccagatgaaacaaagattaatgttctagcttggaatatatatatatatatatatatatatatatatatatatatatatatatatatatatatatatatattactttggtgtgggtccttccaaaaagactaaaaaaacctatattctaaataagcataaaacagatataagttaactcgggaagtagaaacaaagcaaactactccctccgttccacaatataagaagttttagagttgaacacggttattaagaaaataagtagaagtgaatagtggagtccgttccataatataagaagttttaaagttgaacacggttattaagaaaataagtagaagtgaatagtggagtccgttccataatataagaagttttagagttgaacacggttattaagaaagtaggtagaagtgaatagtggagaattgtgattggttgggaagagaatattggtgaagaagttgttatattttgggataaatcctaagggctaaaagttgttatattttgggacggagggagtattatattattatgaaatttacattaccacacaaccatcaatcccgaccaccacagcattcctagttatttaaaaccatcactaaaaataatattggtatcacttttggtttttaaagtgaactggtactgaaagtctgaaactggtcgagcatgttggagtttaattcaatttaatcactgaagaagggaaaatatataagaaaagggagagaatctaataggtgtggctcattgatttttttaataaaaaaataatgaccagattgtgacgcgaatgccacgtagaaccaaaaccacttcagattaagtggggggatcgttatttgtcaagtttgaatagttaaatctgaaaatttggagacaaacatttagaataataaaacctttttcaaattgcatcacgctggtatttattggattttccctttctgtgccagtgcaaaaaaataaaataaataaatccagaggataattaaaaaacatatttaaattctaaattaaaatatgaaattcatacaacatttattaaaaacatgattacgaattaatttaaatcaataaattatattaaaaaaaggaaataaatattatttattttctaaaaccttaacatgaactaaaatatttaagaaactaattttcaaacttagaattaaaagtctattagcctaacccaactcacctaatccaaaccctaaaattcataagggctattttgaatagcaggattgaaaaaaaaaaaggaataggaaaaatgcagaattttgataggaatgcaagttcaaaatagaggattgcaaaacacacaaaaaaaacacagaaataatcttttgattagaccgcaggaaaaacaaaagaattatatgagagagatagactcaaagaaaaatttccaagaggttagagcacttgttaaatttcctttaaaatctcgataggattgtccatttaatagaaatttcaaagaatagcatatgattcaatcttttgtttcaaacactttcataggaaaattttcctgtagaattgaaatccttcgagacctatttaaagtctaatttggcttcttattcttctcaattcctttcattttctctcccaccaggccaaccaaaccaggctggcctgaccttcctacctccagttggcaagcccaagaagacagaccgcccctaaagcccatgccatgccctttctccctttccaccttgggcctttaacgatggggagttggggacctaagctagcaggacaacttcgaccttgagttctaacacatttcctcgggacgcttcagcgtctatggccgagggaggcgacagtggcctactagacggtttcgaggaagatggatggtggcggtgcaaggtatagtgaaaaccctaaccgatcctaacatctttatcctgcttccatggtagacaaatctcatggaaaaaatttgaaatacagacaaggaagaggaatggagccctcaccacggtgaagaaccaacaaggatcgagcgggaggtggattgatggccgctactataaagaaattatagatatttgcacatttatatagccaccttttctcttcttgccatatatatctcctctatttgggcatatgttataactggtgtatattggctatatatatatcagttccccctctctcacattgagtacgtgacatctcgtaattctctatctagatttaaatccagaagtggttttcttttaacggagggagcacatgatatcggagtctgcatttctcatgtctttccatgccctagcagcgccatactggtcatgcaccctctctttcaggcttggctagtttgcgcgcatatcctagctacgcaagttgcacagccacgcgcgccttacgccgatgagcatattaacactaatgacaatagttagtattattatttttaaaaaacaatacataaataatttagttaaaagtttttaaggaatagtttgaagttttaaatttgtggtagaaagattttaaaaatctagtcgaaagtttttgaaattggggtttaaagttttgaacattgagtttaaagttttgaaatttgatatgaaagttttaaaatttgatttgaaagttttaaattttgagttaaaatttatttttttttaaaaaattcagtagaatatttaaaatttaagttaatagtttcaaaatctagatgaaggttttaaattttgggcagaaagtttaaagttcaggttaaaagttttaaatctctatcaaaagtttacacaattttgacatactttgaaaataaattaaaaaataattcaaaagcataaaatcactaaacacttactatatatggttgatccaagccatcatgggtttcatccctgtgccatcatgatcatcggcttcatcctatgccatcttgggctttatgcgatggctcggtagaaaaccgtgtcgtgtgaggtagcctacccacgcatgtctgcaccaaatagagttttcactctcttccttgtcatgcaaactccatcgtgccacgcccatcctatccgtgacgtcctatttcgaggaccgctgccctaacgccgcacctccgccacgctcatcctccagcgccgcattctcgccgtgccgtagcatcacgccatgttgatcgagtccaccccagtccttcgcgattgcatcgtccatgtcggctaagatggccaactgatccctccttccaccaccggcagatccatcagagctgtcttcgtcaacccctatgctaccgtcgttgtcaagtcacacgtccttttttttttggaacgactcgtacgagaagtgcgaagttctattgatagagcagaaaaaaattataagattacaaccctgaagggtcgtaattatcgtaattaaccaggaaaaagaaaagtcacatgtcctaatcacaccataaagcttaagcacccaaacttcaacaaatggaaggcttttatctcaattaatgtgcggcaagtttggcctctcctcaactacggccctgtttggagaactagccaagagttattttgagagctattttttagcacaagaaaataactctccaataaaatagctctaagttgtttggatcgaagggctattttgagagctatctggcttttaatgtaccttctcatggagagagatagagagaaaagccactttttcagtgggccccacctaaaatagccccaattagcaccccttgggtgggatagttttttgggtgggctatttccaaatagctcacccttttagatctttttgagttatttaggctatttgagggagggctaaaaaatatcccttagatccaaacagggcctacattgccatcaccgcccccgcacgccaagacgactcagcctaggaacaagccagctgcctactgcaagaaatcggtgagacggaggtgcgagaaaatagacaatatcaaaggttaccgaatatggaggggcagcaagaaagtgataacgaacgagtcagtaaattgaggcccactggaatgaacagtgcatattattcagcactgaaaaagattgtgcgacttgtgctccggaccaaccagttattgttcgaggcacacatgacttgtcccttaaagatgtggactgtactgaaaaagagacgtattacctactgctgagcaagtttaatagtatagcctactaccggctttaatttatttatagccaatttaatagccgcttactatactattaatatatggtcccacctatcatacacattgcgtcttatagttcgtgttgaagctggctacagatctgtagcccgctgtttttctcttatcgtttatctcattaaaatatgtttatagctggctaatagtatgctattgtacctgctctaatgagtgtgtgttagcggccagctcagccctcgacctgcctgcacgttcgcggttaggtgggcttttctgtcatgttagcagcgacttgtttggttgggttgggtgcaaagatgaaagatgaaagagctggaagatggaaccagacctcgatcaagctacagcggcggttatacagtaacagccacatgactaaatatttaatatttttagaaacacagtataaatataaatgtacacaacacgcacacaattatctctataaacgtaaatacacacacatatctctatgagtatctttgaaagagtagaattaggatgtgtcatattttaagattggcaaatattgatgaagtatccatgcacatctcgatatcgatatcgataggtacgttgcctagcaccaacaaaataattagccgtaaaaatgagcacgtgtcaattttgggacttaaacttaggggagtaagttctgtcacttttaaaatagtatagagacatttgaataatatagacataactcgtaccataagtttttttttcacttagtggatttatataattaactattgttaaattgcagtttggatcactttattaccaagtttaactttagcccaccctttgttccatccttttttactttggactagttaattttatcattatatagtaatttggaccatcccaaaccatttcttaaccacatgaacgaccttgagtacattatctccaacacaccatgacccctctcttgtgcgcaagccatatcttttgttggagggatgtggttaaatatggcaatagaagagaattatggtggttaaagtaaaaaaatgtaaatttaactggtctcgagtgaaaatattagttaattaaggtgatctaaaataaaacttttgaaacaaaaggtggcttaaatttcaattgagaatccatagtggtatatatttgctaattaacattaacaaacggcatcatccttctccactattttcctcctcctgatgtccttgtcatttaattaatttcaacatggcagatctccgtcgtgatggtaacatcagcatattttatatcatccatgctctaatatatttgaaaggtacatatattctcattaatatataggcatatatctagtagggaaaaaagaaacatgcacctagtcacctagactcctagagtatccgaataaatcctacctacaatactcacaagcttcacgccctagtatgttataacctgccactaaaagagaaggaaactatgcagatagtacaggtacgtactacctcattcgttccaaaaatatcaggattttatctatataattatatgaataaaatcccttatattttaacatgtaaatactagaaaacttattgaaacagtactgtcagtaaaaatgagggggatcaagtgaccagtcgaggaagcaaagctgagttttccacaacgcaattaatagcaaagagaccgacgatctgaagatatgatagcagagaatgactttaatttcctggaccatttgtccaccaaccgctgccaacggttttgtcgacaaataaccgagcagtcattaataaaaccagtgaaattcatataaaatttaccaaaaatttgaattcagttcatcttgtgcttaccaaaattttgaaactcagctagtttatctgcagccccatcgtttcacttatacttatcgttcgacttataaacaaccaaaatgagataatctatccaatgtcatctcattttaacaatttgacattaatattgtctcttaatataatataccagcgagtttatcgattgttctaactttttctttcaaaattacccaaaatatctcaaagacatataaggttaacaatctatttattacaataaaaatttcaaaaaaaaatatgatttttatatagcctccttatacaacatggaaagtagtttgtatataactttcaagataatttttggtattttatttttttaagaaagttattttttgtttggtatataatagaaaaaatgtgttgtctaggtttttaaagatttgcattgaaaacaacaacacatacagcatatagcagataaattgtattatgaaaaaaatagaaaagcaaaaatactgaaacttatatattgtgtaaagaggctaaaaatttcatatttttctgaaagtttttgatagaataaatcaattgttaacttgtatgtttataagggtgttctaggtatttttaaaaaagaaacaagcatagtggcatattatagaataattagtaaactcgctggtttattatagaagggacaattaatgtcaatagtaaattattgaactaggacaaatttagtggtacatagtaaattttctccaaaataatttttgggtaaaacttccatatacgtgtccttagagattcaaaagcaaatggtgtgaaataaactatgataagaaaaaccataaaatcaaatctaaattaagtgttgaaatttaaattttggcttataaatatacgcataagcgaaacaatggagtggctagtgttttctaaatgcagatcgagtaataaccggggtaatgcattttgaagccttgtaaaaatgttctgtagcaacattaatatcctgtttgattttagactattcagcggattattgcattggacaatctaggtgatcacatgcataaattaaatattttcagaaataaacttaacgaatatgttaaaacaatgatctaagtaatgcaatagaagaatttgttttagaaaagtatattttttgaagtgtggagcaaataatttgtttcagcaatctactagctagtacataagttggacaaaaaagggtctaaaccctccacaacttggtttaagtatcacataaaaattaaagaggaaaaaaaaatccaaataccccctacaagtcactagttttttcaatgtcctccctacaaattaattccatgcacaccatgctagagatccacagtatgcgaggaatcgctaagcgcgatgagaaatcaataaaagatagatataggtgagaagttggaagagaaaatggacttgtgagcaatgttttgcatgaaactaacttgcaggtgggagattagaaagatcactaatttgtaggggttattcatattttctcaaaaaaataattatttatttcatgcaaactgagcatacctcaattgatttagtttcttgtggtagatcctacctgcttggattccggtcctactcttggtattggtgttcgtatttaacgctaattatttttttagtggtatgtggcgtaccaactagggacttgtggactttggtgactatgttaatctaaagatagtagatgatgcaccgcgcttcgcggtggaatacaagagtgaatataagttaaatgttgtagaaataattgaccaatttgggctgaaatattgtaaaaaaaatgatgtaaggaatatattacaacacatgcttatatgtttagctttagaatataataaattgtatatgtaatggctatgcttacatattgagttttatagatacttggtgggttgatatgtcatgcttgaatgttatgctttaggatgtactatcgataactatgtttgcatgcatgttgagttttaaatgcttaatatgctttgtaactatatagaaagagtagatattgatccaatatatcaggaggggcgagtttatatgggtgtgtacttacatgagtgtctacgttatgaatacgtactttgtgataaaactattattgctattttgcttttgtaatacactacaactttggtactgctattaattgtctgtgttaattagtatctacattaaatagagataatttagaaaacaatatgacatgtatacatatgaaagataattatatgatatccaatatcatctatctctcctttttctcgtaactaagttatcccaagctgtctaaagaaacgataactcatttttctctctcgctctccactctcatcgacgtcaaaaaaaagtattaacttacttatagtgtcccactaattgctgttgtatatatcctaatccaccaaactgtaggagttgaatcatttttttaatgtgagttaggttggttatgcacaaatatgactagatgtgtgtattgtaacaaccaaatcttcatgggctgtactctaactcgccacaggtacaatttatcattatattttaaaaagcagatatcaatcatacccgttaattaaagattacacttatatttaaaaaagaaaagtcaattttactccctttaactctttcatccactacactggataatgtcacctgtgacgggcccaaaccctcacctttgacgggtttgggcttggtcagtgatcagtggtcactggcaagtccaatcacctttgatgggtgaccggcccgtcagaggcacactcacctctgacgggtccgtattttccggcctgtcaaaggtgaggatctccacaagccaatgtgtagttgcaacccatcaaaggtagacacctgagactcacctccaacgagttcaagatatgaacctgtcggtgaaatgggcctgggggtacgcacagtagagggaagtgtccttcccgtctagtcgcgcggccacgcggcctcgcgtcctcctgccccttggatagcgctaaggtggccatgggggcctcggggtgccacgtcatacccctcgggctttcggggcgtgctaccccgaggccctcgcacggccaccacgtggcgaggagagcgggcggtgcgaaggacgcctcttaggatctttaatgcgtggcgccccaaccgtccctcaccgcattttaacgcggtgtgggtggatgtacggcgccgcccgattgacccatgtcaatcgggagtgactggtctgtgaccggtcacaggtgattgggcgggcggcagcgcccccacgtcccgccctgtgtcaggcggaatgggggcaggtacgccccgtcccgtcagtatgctgccaggggtgccctccggacgtggtgagccaccaaagtctccatgcatttaaagggggaatgacagggatgtcccccgtgtcaggcgggggacggcgctgggccccacccaaggacgcacagccaccttgcttccggttgaaggcacgaatggcggtctaatcgaggcagggtgggttcctctcccctggaggagtaggtatggacggtgcatgtggtatccccttgaactataaaaggaggacctcgcccaccgaaaaaagtgacgactctcagatagttttgagttcgagaggaagaacggctagggtcccctccagagctcaagacatcctgtaaaagttgatcataatcccatgcacaggagtagggtattacgctcgatagcggcccgaacctgtataatcctttgtcttccacacagccccgagagcgatttagtagttaaacgccaagccgaagtaggcccttgatcatcgcgctgtatcccccggtcgaactcacaaaggggggggggggtctcacgaccacccgctagagagggttgctcctcgacagaacccatcactggaatggaaagtcatcttaaaaaaatggtgcccagttgcaaccatagaaaattggtaatagaagccgaagaactaataattaaccccaaacatttcaaactaattcctttcaaaagatggcaagaagccggagaacttacaagttttacaataggaaccgaaaaacaaactacaaaactaaaaactactgggaaactgcatttcagggaaattgttaagattctaattttctagctacatcacaacgaaaaaatctctagtatcttcaagaaaaacaagacaaaagttcacaggtcttcttctaacatcaattaatctccagcggcaacacatcatggggcttcaacaagaccacacccgaatcaaaaacttggaatcgatgacttgcaagatctgaaaccaaatcgtaagcacataaacacattaatcagtacttgggaatggtggaggaagctatggcggtggccgcgcgaggatgcaggaggaggtgactagctctcggaggagggcgcttggggacggaagaggagaaggctgtccagtgccggatctggcgtcccccgacctctaggaggctggatccagcgtcccccgacctcagtggtggcggtggcggtcggtgcttgaaacggtgaggacgacggccggtgctcgcgcgtggagttggaggccgccgccggatccggtcaaccccgacctctaggaggcgaccgcatctgcacgccgtcaagccctcctcaccgccgccatgcaccgcgcactgagccacgcaccagatcgagaaaataagagaagggggaggagggaagaaagaagggggaggaggatggggtaccgccgaaccaccactgccgcctctcccgagggccgtcgggtcctccgccgccgcctctcccgagggccgcccggtccccttttgtttctgtgagtgtggataagggagagagagaggtccccttttgtttcttggataagggagagatactatatataaaaaatttgaatttaaattcaaatttgaatcgggtatgtaaacttttgacttataaactttgggtctatagtttttaggtgtataaactttagatgtatagaagtactatatatagaaaatatttgaattcaaattcaaatttgaatcgggtacgtaaacttttgtcttataaactttggatctataaactttaggtgtataaactttaggtgtataaactttagatgtatagaaatactatatatagaaaatatttgaattcaaattcaaatttgattcagatataattcaaattcaaatttgaaacgggtatataaactttaggtctataaactttaggtgtataaactttagatgtatagaaatactatatataaaaaattatttgaattcaaattcaaatttgaatcggatatataaacttttgacttataaacttttggtctctaaactttagatgtgtaaacttgaggtgtataaactttaggtttataaatttactaaaataggaaagtaatgcggtgccaaaaaaggaaaccgggtggaggggtggagggagggaggggggaggggatcgatcgctgccccatccccagggcgatcgatcgccgaacaacatttccgcccgtccatcactctctcccctctcagtctccctccgtcgctctccctgtctcctctccctctctcctcgatggtgccaatgctcctccccaccgcttcacaatcacctggagattaggggttgcagtggtagcccctctctagtgggcaggccactggatctggtcgtctggaggttagggtcaccggatcacatcccctcgttatttgcatgtcatctaaatagttatgaaaaaaaattgagaagattattaatatgtgatatatcattcccacaaccatacaagttgaaattcaacttctataagtgttggtatttcttaacgacattactagaaatataattcacagcaatggcgcagaaatactcatggtatattatggctacagagttcatccgcgagcgcacggatataccattttagcatttcacccgagagtattccaagggtatcgtatttatttaatcccgtgggaagatcatagtagagagaacctgactagtaatttagatgttacttgtaataatcatagtttaagcaggagttaacataattcaagggtagaatgacacacaagcatggaactactcattctcatactaaattacctaagctaagttgaaagaaaatagaaagataatctattcctatacttctagtatatatagtatacatacattctagttatctgacatactagctaataccctctatccgatgctctcctggtacttcaagaagccatccctgactgccgagttccttacgacagcccgtcatgaccatacaaccggggctaaatacggaggagtagcctccctaggaaattaacttagaactatatacactcacggaggaatacccgtactgagctgtcaccatcagcggccgacctctcatccgcagcatataaccccaaataatgatacaccgtaatctagacactacgcctaaactaccagatactactctaatatcattgtcatgacatagagtaattgcataagcaaacactatacccgtaccaatgcatctcccagataagctagcagtataatcagtataacacgaacataatgtaaagttggcatttatatatttagaaagtatttcaataccataaatgtataaagaagagtattctaataaaagtacaaagcttacgaaagagaagagaagagctactagagccatacccgaactcttccgaaggcttccggactccgatttctactctattcctactccactagcttaagactactaaactaacttgagagaatatgagagagctcttgcttgaggtgtgtgagtgaagtgaggatgagagctccttttatatgcaggtaatgacggttatgatggttggaaatgtcagtaatatcctccaatcgtcattggggatcaatcccagccgtccatcaagaccctgcatccattggcgccacgggaggttcggccaaaccaggggccggcccaacctggcctaaacttggcatgtggcctcctcctttgctcttatacgtagacttatgaattttggcccagttcatcatgtcaattatgagttcttggcccattcatgtataattttgattctcgacatcgtccgattgatctatcgtctgatttgatgtcgatgctcctccactttatgattattctctgcaaaaagttagtgaaccaaatactagtgaaatattattattctaacatggatatgcattgcaagcataattagttctctattttggtaatattgacggtcgaaactgatcgctaacgaccgtcaagaataagttaaaaaaaaataaaactaaactatagctagtcgacgtatatttacaattaaatttgtttttttcgttgtaacattttagaagttaaatttgaccatacgtattggtggaatgacctatcacatagtaatttgatttttttttcataatcatttaaatacatgtaaataaagagaagatgtcctctccataatagttcccatcatattcggcagccacgtgcattaaagtgactgtacaattgcagcatgcaaccactgtacgtacactcttaaattttaacctgtacacttgtaattttcaacggagaatgctagttgtcaggcctccgatgagaggggagaaaaatcagacgctgcatggtctgccatttgtatgcaaagaatctttccctacatgcttccatctctcatttcttcaaaagattttttctcataaactatttatctaatgtacgatctgattgcatcactaaattgttacaattaaatctttacaacaagaccacacatgattatattttaataaaaaaatattttaattttttattgatttttttaaatgttgcatatggtctcttttgatgtttcaaccagtagttttacaatgtttcagctagtgtactcataatgtttcactatgtacggatcaaatgttgcagtgaattttgatattatagaacacgctgttacaaaaaaaacccacgtattttggaaacccctattaagggaatttgttttatttttttgttccaccaaaaagtttcacctaatgtactcacaatgtttcactatttatatatctaatgttgcagtgatttgagatactctattgcaacaaaaaacccacatattttggaaaccctcagaattagttttattttttgttccatcgaaaaatgtttcgtttagtatacccgcaatgtttcactatgtatggatcaaatgttgcagtgaactgaaacattctttcgctatttgcccgtaatctagacactacgcctaaactactagatactactctaatatcattgtcatgacatagagtaattgcataagcaaacactatatccgtaccaatgcatctcccaaataagctagcagtataatcagtataacacgaacataatgtaaagttggcatttatatacttagaaagtatttcaataccataaatgtataaagaagagtattctaataaaagtacaaagcttacgaaagagaagagaagagctactagagccatacccacacgtctctgctgatcgtcaatctccaacagggcctcctcgtagaagtcgtccacagcctcagcccatcgtgacagtcgggtcattatcgggctgtagcagcaaggtgtgtcctgaactgtgcagacggagttgccctcctctcgaaacgggtggtgagcaaactcagtactcgccaactcagctcggtggatagagctaagtcggaggaaggcctcccgggcagcatcctgcatcgcgatctccggcaagtcgcgacggtggcgtgtcgggaagctgtagtctaactctgaaggaactctggtgtggacctcgacccgagcctcccaaacagatccacactgtctcactcggtagatcggaaatctggggtatcgcagacgccttatcagccggtgtagctcaatgacgtatccctctgagcggggtacgcccatctcccaggtggcgggtgaatccggatctgccatctaattttaagaaaaacccaaagtcagttgagagtaaaacttgttttgtaaagaaaatagttaagagtaagatgaaaatcgtaccgagttttgtaaacatagcatttttatttttgaaagtattactaaatgggaatttctcccttggccaacttagaaaaggggtggggtgccttttggtcttttcctacagtcgtatggctctgataccagctctgtagacccccgtttttataacaggaatcaatcgtgtaaaccgtaccatttccctggatcaagtagtctggtatacacgaactcatagctgaaatatcaagtgcacatacacgagagtctagtacgaattattacatcataagcccacaggcacagtcttaaatcatcggaccgagcggtccggaatacattccaaaaacagaagtaggtaaggcagcggagttaaggcagcggcacgccattgccacaggcaacgaccgtaactaagacctactgagcgccatcgtcctcatcaccctcctggtaataggcatagggatcctccg

SEQ ID NO: 59427 - DNA, 10863 bp, Oryza sativa
actattaagaattaatgtgtcgcacaagtcctcaatagctcctcctatccctaataatcctctctccccttcctaaaaaaatccctaatagtctctcctccctacaaatatttttttgcttccatccaaacagctcctcaggatctcactctcggcccgagctccatctgaaggacggcaacccaagctctactcctatgaacttgggcactgtaagatggtcgctagccgctcctcaagggggtcgagcaccacaaaacgctaccacatctcattatcgagctctaccccaaggtcctccaccaccacctctccttgttgagctcgccagtgtgagtaagccgagggcgtgggaagaaagggagggatgaagtacgttgaatccaccttttatcagggaattgcaaacaactccaataatactaaaagtggtattgggtagctccaaaccactttggtggtgggatattgggggactatatattggagatgctcggaaaatattattcattctcgtattttctatacttgttactttaccctaaaataaattttaatcagttgcattgaaattacattatcttttccataaatgcgttaccaaatagagaatgtgttttaatcgatctagaaatttgcaagttcaaatataactgtgaattcatgttaactaattttagtttaattttttattatacaatttgtaccagttgaatttaatcttgcatgtttgtgaagtgatatgtcttacattaatctatcttgttattttttttaatatttttataactatttaggtgacatataggaaacgagggaatgtctcctcaaggacgaaaatccatctcctaccaaattagctgggatccctagctagggatgaaaatggagcagatagtatccgtccacttcgaaaaaaaaacggatacgaataccgttcagagcgaacaattctcggatagtccggataaagatacaaatatggatatttgatgaaaggtactattaggatatccgctgaagccatgacacgtacctcatttctatataactctagatcttcaagctaactctttaaatattaatagtagcccatctcacaacaccagtctatactagtaatattatttaaacatttaattttttaattatattatattttgtattataatattagttagacgtgtatttatatgaacactcttgtacatgttaaacttgattagaagcttatgaccaaatttattatataaaaagggctaattatatacctccaccattttctaatatatgataccacgtcttattcaaaaaaaattatacaaatataaaaaaattaaatcattcttgaaaaacatttgacgataaatcaagtcacaataaaataaaaataattacatattttttaataagataaatggttaaactaacatatcttaaaaggtaacggcgtcatcctatcttactataaagttatccactaacttcagaagctcaacatgcaagtgtgccatatcgtcacccactagcaattattatctagagtattttaaatatcatacaaacataacatatcatttgtaattttattgtatttgtagaactcaatatgcaagcaaagttaaatcattattttcatattatttaaacatatacatctgccatttctataatatataacatgtattcatccacatatatatcctacaataaagtgggaggtatcaactaatatattaaaaaaatgatggagtgtgttggtatttgtttatattaaaagttggggtggttttcgtgttccagaaaatatttatgtccgtatttgtgtccagtataattcgtatttgttttcatatccaaatcattcgtatatgttttcatacccaaagaaaaagagaatgtgggacgaccattatccgtatgtatccattccattttcatccctatcttttgcagtttctagatttactgcaactttggtaacagtcactaaagtgaccgttggacaaaaaaggaagacgtagatcctccaaacttactgttcatcagatgctgtagcggtcctagaactggacagagccgctgtagtctctaccgttgattcattgaattgatcctgtggtgacttgcagtctatacagtgatcgcacgcaattctttggttagtccgagtatgcgtcgtggacaggacaattctttggttctcccagcctggccatgccatgacatcacggcaactcgccatggcataattaaacagcacggcaactcgccaagcaaccaaattacagtatagttgcatcccggccgcgtacgtgtatacctttcctctcccctgcccctgctgcttgctgcactctagtactcttagtactaaactaatttcattttccaaatttagaaaaatatataggagactgacgaaaagagaaaataaatggtcttcggattataagtaggcctcgttttcaattcttaatttcttgtcgagttttttttctaaaaaaaatagtaacatagaagaacgatcagtacacaattacacatgcatatagtacaaagttacaagtagtaattgagattttcaatacaggaggcgatgcaagttgcaactccactctctgttgtgtttgaattgactactggtagtggtactcttatacggaagcaaaacctgaaccgaactgcagtggcatcgcatcgcgcaacgcacagcacagcacagcacatgaataaagattaccagtgatgttctccagtactcgatccgttctataaaagattacaagtgatgtgacacatcctagtgttataaatttgaacggatataaatttgttgtactaaaatatgtcacatacagttttagattttttttcagagagaatacacaatatattattcagtactactagtactacctccttgcaaacttgttggttagttcaatattgagctaaccaatattgagttaacaaatgtcaaaaaaaatataaagggagtatatgcctagctagctagtagcagtataagttactcccctcatttctataaggcataactattttttttcatgttacataatataaggcatgcatgcatgcatataattaattagaacctcttctctattaaattattacttttttaaatcctcaactctcaagatctctaattctattggatacatgcattatatttattagggtgattcaaactagaagatgataataattatttcttggtatttaggttaagggtggttgtgtattatattttggaacgaagggagtactatcctcccaagccattaattgttagaggtccttaatttggaacaaagggttataaaagaattcaatcctataagaatttttcatatggtccgttggagcttggatcaaattaaggaatagctatagaaaaatcatacgaaattcctttggattggtccaaagggattttagagtaattttaacgtaaggtcaaaccaattgggaaatatcctttatatcttccttttgtattcatatatttttcttgcgctcgatttgaatagtcatttttacgttttttatgtgtgctttaaatccataggatttgagataagtggacacttaagatctacatatttcatgattccgaattataaaaatcctacgttccaaatgagcctttatatttcttttgcaaggataatccaattgatatacaataatccagctgaaatgcgtcacttgtgcaagaacaggatgaatgagaaagaaaacattgatgtataaaacatataagcacattgaaaattaaagttgcgcgtagtatagtacgtaaatttaaaatcggttgtggctcataataatatagcccgtcaaacaagcaggtcggccctttggaatttcgtacttcatgcgtttggccgtgttcggttgttttggcgaaaaaaaaatgacacatacggagacacatttaaatattaaacgtagactaataacaaaacaaattacagatttcacctgtaaactgcgagacaaatctattaagcctaattaatccgccgttaacaaatgtttactgtagtaccacattgtcaaatcataacgtaattaggctcaaaagattcgtctcgcaatttacatgcaaactgtgcaattggttttttcggttcatatttagtgcttcatatatgtgtccaaatatttaatgtgataaaaaaagtcagaagtttgaaacatttaatgtgataaaaaaagtcagaagtttgaagaaaaataaaggcaaccaaattgtccttaattaatgcaaggatgatcaacgacgacgttacgtcgtagcttttcatgaatttgtttgcttggactgcaaacgaaaaaatgttcaacactttttcggtttgagttgacagcagttgacaaggatgtataatttggtgcatagcttcctggtcctattacaaccgaattttgccaactttttcatcatctctttttttctttcacattaattcatacaaaaagtcagtgaaaatttggtaccacatgtataatgcttattatattatatgcggcgctgtcacacaacgtacaacgtacgcagacaggctacgacgggtactacgtaaaaaagacaagaacacgcgatcgatgacacacactggttcctgcatactatgcacacagtacagtatggtggaaggctatgagcccacttgctaattggctgaatagaatggcttaccaaagcccaacccggcccacacgttccaactagtcggattgctacttttttggactttttgagcttttcttttttcctttttttttgtttgggcaaagcttcaatggacgccatgaaagctcgagactcaagggatgtaacgcaggggcgcagatctgtactccctccgttcaaaaaaaatcctaatacaaaatgtgatttaaaatgtgttatatcttgtactaggttatatttttatgaaatggacaaagtgaatccattgtaattgcatcaaaagtactgcaaacagttcccactggtagtgtagagaggtactgaattcattcttatatcgataattgatgataaaagagtattataacttaggtgtaaccattctcacctttcgtactagccttaactcccaagaactacacaggtcagggtgttaatataatcctaagatataaacaaaatatataatttttctgatagggggccactagtactttttatcttgggcttcttctggaaatctctgctaatattactactcaaggctcaaagttgagtagagcggtgggaccaacgatctgttcaagggcaacatcataatgctaattgcggaaaattacagatctagattacagcccagcccagtcgcatgcaaccaagaggtggcgaagcctgaaaacactagtgatgccacgttactcaaagctacaggaatgaagcaacgtgttgcatacgggctagtagatccataactttgccaccaaatgagaacgacggtggctctaacgtgatatggcttgggccacctggttcaagatcgagcatgtggcgagaaaagcaaagacccagctatcccgagcccctttgaccagggtgcttggggcatagtgtcagggttatggataccacatacctaatagtagttgactaaatctcggcagggctcaccacgtaccatgtcctatacggaaacaatctgcggatataggaggagtaccggataaggaaagacagccagagttctacatagaaacgataaggactactcggattgtatccatataggtttccctagttctacttggacaagaggacacttataggtataaatacaagaccccctagaagaagaggggacacgaccacctcaatcaacacctaacacaatcgacatagaagccacaacacagaagcctacatacgccaagacacgccgccggatatcgacttcagggataagcacggctagtaccctacggtgtctccggattctgtcaggagagacgaaagcgctatctctgatctcgccgagcagggattcgaggaggaaggctatcctgttgtcgactacgagtcagatcgtcagaccgccatgtcgacaatagttagataggctaccccaaatattgtactggtgtgattatcatgaataagagcaataccggcttcggccaacaggatgtagggttattacctgacaattcaggggcccgaacctgtataaaaatccctgtctccatctcttttacctcagtctcgcgtatatcctaataccaacgatccccataccatgcaaataccagaattgcgacatcaaacgtcgacagtggcgcgccaggtagggggattttggtgcttcaggatttagacgagatgggtttaagagatggattctccaacaacaagctactcgacgacttcggctgtggggagatccaacaggctgtggggagatccaacatgtccaagtacatctttcgactagatcggaaccatcatcgtcatcgacaacttggtctatcgagatcaaccaagcctcaagcctcgtggcgtaccaaaagatgttagaccgtatgatgttgaacaagtacgcaacaaggtaattagtagattggttttttaaattgatctactaatttcgtagatacatccgacatgtatctaccaaggtacgcaatattttatctgcaatttatcgtacctatttagatcatacagcattgtcagatccatgatttattatgtttacctagagcatgttctttatacaatatttattgcgcgagtgtccccgatgttaaatcgactacggtctaacgctgggggctcgctctattttcttctgtataaatcatgcttgtttacggtttacataatgcctgatatttacatctgctcgttatatcctgataatgctagaagatccatgcagttttttaagtacatactcgatattatctgctatatgtcttgccttctagaaactatttttcaggaacaattgagcactcgagtaggttgtggtcaagtacaccgcattgtcgagaacgatctcgacaaatgcagagtcgtcgcgcccaacctaccaacgaagaccgatgacctatctcatagccccggccatggctggactactcaagaaaaggttgttaacggataattcctcgcgaacatcatcggcttgatcacccgacatgattgcgaacggacatccggatatgctacaagttgggtgtgtgagtcatgctggccacatgagacgcacatgtaataaaccaactctagcacctctattggtgtttgagagataattctacacgttcactggttctcgaaccagtgcgtagcaatctcttgcaccgccaccaccattggtgtccgagagataattctacacgttcgctggtcctggaaccagtatgtagtaatctctcgcaccgcaacctccattggtgtttgagagataattctactcgttcgctagtcctcgaaccagtatgtactaatctcccgcaccgccacctccattggtgtttgagagataattctacacgttcattggttctcgaaccagtacgtagcaatctctcgcaccgcagcttccattggtgttcgagagatgattctactcgctcgctggtcctcgaaccagtacgtagcaatctcttgcaccgcagcctctattggtgttcgagagatgattctactcgttcgctggtcctcgaaccagtacgtagtaatctctcgcaccgcaacctctattggtattcgagagataattctactcgttcgctggttctcgaaccagtatgtagcaatctctcacaccgcaacttccattggtattcgaagagataattctactcgctcgctggttcttgaaccagtacgtagcaatctctcacaccaacaaacctccattggtgtttgactactacctggtcctcgaccagaggtgtagcgattctcccattacctctacttcaacaaagttgatatcaggtgcacaataatgccaagtgttttacccagagatcccttacccagatgacacatagcgttgaaacctatcctaatgttcctttacgctgtcttgacaaggcctccgaggaacctaagggaacttcggctggggacgcccagagccgataaggccttgtcggatccttcagagacgaaagaccatgtaagatctggtcgtgtaagagttcttgccgtgcgtattaaccaagccatgtaatcggaaatggattttccaacttcacggctgggggctaggatcagtgcttgttcaaccgaggcaggtcaaaggtccaagagccttatcttccgaaaacgattctctgatgacaaggctgggggctagggagagtgtataactcaacaaactgactgatcgaagtcggtaaaagagtagatgctcatatacaaaacattggtctgcaagtttaattcatttttggttttccatacatattataacatgttaccctttgagcgttcgctcgggggctatttctatctaatattcttttctgagtattgatttcaggaaaattctattcgacattatcgaacactccatgtctctatggttctacaccaagatcgactaaggcgagtacgacaaatattgacaaggctccttcgcagactctacgcctactcgattactcgagaacggttggtggatctcgacaaggaatacggaatgaagagatggtgtacccaccgagataaaatttcttgacttcaatctaaattctcgattacagcaagacgggagacttagtcgtatgctctgttctttcttggttgacatcggagatcagacaaaccctataggtgcccgcacgaggctgataagggaagtctaaacgttatctctgaactcaccgagaacggtcacatgagctcgataatagttactccaaggtctgcgcgtggttgagaatatgaattcgttcatttgcattgaagtcgggggctactgtcagggttatggataccacatacctaatagtagttgactactctcacactctctaatgtttgtgttcatccatttagtgtgattgagggttgattagctaggagtcacgtgcattgcttcattgtagagctagtgtggcacttgatcatctccgagccaggtcatcacttgttactcttggaggttgctgtctcctagacaatttgtggaggtgttgccggtgacctctccaaggagattatggagaaggcccggcgccggttgtgagtggtttagagttcaccacctttggagtgaaggaagaactacccctagtgatcaaggcttgggtagtccacttcgtggccggctcccacctttcccaccccttgatgaagggggcttgcggtggcttcgtggttttgagagttgaactagggcttgccttaacggggattaggaaaccggcgagtttccgaacctcgggtgaaaaattccttgtcttgtctcatttacttattgcattttcatttgtgcaatttactttcatatagacatatttgagcccatatcaccttaggattgcaaaacatcacttagttgcaatttactttcatagagacatatttgagtccatagcaccctaggattgcaaaacataacttattagttgcttaattaagtttatccctcaccaagcctagcaacttaggtaagttttgattaggtgtgttttaattttaatcgcctattcagcccccccccccaagtcgacttctcgatcttacataatgctagcacacaggagtagggtattatgcttccgagcggcctgaacctgtatatttgcttgttttctttgtttgagtgctcacacaatctgaaattgatccctactcacccctggccgaatctcgaaagggggtcttctcttccctgttgtaggagtaccgatctccgacagtgttaactcaaagaaaaaaaaaccatttacgcccttgctcatttgatcatacttctcaatggtttttgtttcaatataatcaatatcgacaagtgtttgatagtgataatctcataactattacatgagtaaaaagttctaattccaacaaaaattttcaccttcatcactcgtcgcacgcacgcctgctggtggatcccgctaccttcaaccgttctgccgcccgtcgcccgtagttctctcgtttggatcgaagaagagaagcaccagccgtcctcctcgttcggagcgagaaggagcggcatcatcgccaatcgtcctccttgttcaaattgaggagaagcaatgtcattgccatcgtcgtctccttgcccttactgtatgccggataatgccgtcgctgccgatgcatatagcttgtggatgggaggttgtgccgctgcagccaacatcctcgccgacccgccgctactagttccagagcttgcacgcctcgactctatcgaatccaccgcccgggcctcctcatcaccggatccgccctgccactcctccttctcatcgcctgcgcaacaagcctccatttgatccacctcaccactgctgctccttgtcactgagccaccaccattgctccttctccttgtcgcacgcaccaagccttcatctgatctgcctcgctgctgctccttctttcctcgagccgccgccacctcttctcttagtcgttgagccgtcaccagatccactgtcacgcccagaaattcacgaaccagaatttctaaactgaatgtgcattaaatccctatccaggaccagccagggtacacaaacgacaattgttgacatacagatccacgtcttacaaaaatagaaaagattacaaatgcagcggaaaaagataaaacgagctaaacttgg

SEQ ID NO: 59428 - DNA, 8619 bp, Oryza sativa
gtgtttattttagcccgttagagatgacgaggttgtgacggttcgtaagccccaagcacaggaaaggccattacagataagaaattctgtagtagtgccatatacactggtggagaaaccgtcgtagtcccggttggtatccccctttagtcccggttgtccaaccgggactacgaatcccagtttgtgttaccactggtgggactaaagatcaatctttagtcccggttcgtgttaccaaccgggactaaagatcggtcagccacgtggccggccaaaccatctttagtcccggtttgtgttaccaaccgggacaaaatatcggtacaccatttttttttatttgcatggccctgtttgctgcatggttgattatatatatacatatatacacatacatatgttacaatacatatatatgcataatatataagcatatatatatatatatatatgtgtgtgtgtgtataaatcatatattacacacatatgtataatttaaagcacttaacgttttatgtgcatatatgttaccaaaatatatattaacactaaagtaatgtgtacatatataaatatatatatacatgcatatatagtacaattcatttgctcggtagctatagctacgacatcgacgtcgacattatgtcagaagaggaaggatcgacgttatgaattgtcgatccgtcgtagtagaattcaccatcgggaataaagacttcttcgttgatgaatcccatcagttgttcttgaacagccgtgataaaatccttgtgtaggagattatccctcatgtgaatacactatcattcgaaaaataatgacgtatcaatatatgaaattaataaacaacttaacaaatcgatacgcaatgaaattttgaatagtttatgtatacatacattgagctctcgtgttgtgcatatttggtttgataggtagtgggcatactcgcatacgtagtagccgcataagttagttccctggtcctgctttgcatactacatgagaaacgatgagagatttaatatactctttatattaactgtaattagagattcaattcaatataattttggatcatgcatgtactcactagaaaatgaaacctccgtccaagtttttctatccaagtcccgcggaccaattgacggaaccgatcccaagccctacatatacagttacatgctatgattaattaattattacctgagatcaacataatagcaatagattccccgcgactttggaatagatggcattatattacctgtctatcagtttgaagaccttgtcaaaaatcttctcctctttattcattgagtcgtacacagtgactctgcatgcgtccaagtcaaagaataacaagacccagtggaatctagaatatgcgtgagatgagatatatatatgaaaatgtacatgctatatgtgtgggaatgaaatttgtttgaatgacaataaaaactcactctgtgttgtacggcagtagtatgtacgtcttgaaatgctgctgcgttaggagatggacgagattgtcctctatgtctttctcgtacttgtcgatcatttcggtgttgattttccgagggtcgatgaacccagtatcgtagaccctccaccgtcggccctttgaatctccattctacaacgatgaaaggaaattgttattgcttacatatatgccaggagctaattattgaacgaaacaaatcgaactcaaagatactcacaaaatccaagcgctcagaagagagacgtcgagggcgtccagctagtatagatcgaagagatccttgaaatggatccagagaacatattctccttgcaagaagtcggggtttctgatcctcgctccgaacatctctctacccttggcgctcatttccatgtaccgttcatggaatttgtacatctgtgtcggtagggactgcagctgttcaggtttgacaagcggtttaccgagttcaaacttgtatgccacatccgccttcgggattggtgcgcctcgaatcagctgatccacagttagaccggtgtctaaaatgaattccgttatgccaaaatcttcgccggtcaccaacggctcgacctcttggtttggttgttctccaagctaagggactggtttggacttcttgtgataggctctctgaagtgttcggtcatagtccaatatctgtaacgcctcgttgtttgttgcggacattcccttgaagaagttcttcacgctcgggtcaaaaggtatcttcttttcaggacactgtcacgcccggaatttctatccaaaattccaaacgcttacatgtgtgttaaaccctcgtccaggaatcaaccgaggcacacaataacaaattgataatagagtacaaattaataactacttaatattcgcaaataataaattattacagaggtagatagttcctctcaaagaataacattctatgcagcggaaaaaaaataaaactataacaaactacggaacagctatggcgactccactccacaggcatcttaaccagaacaagcctaatcctccagatcatcaccttcactgagatactcctcttctaatgaatgaatattgcaagaatgagcatatgacatactcaacaagccacacagcaaatatgcaagtgcacaggataacaaaggatggcataatatagctcatttgcagaaacagcatttaacaaatatttaagagaatatttaaacagttgtataattaatcaatattaaataaacaccatacaacacacccatgttgcataggcccaaccacatttgaacaaccaaccccagttgaacaaattaaacctccaaaccaggaattatccattccaaaccaggagtcaaattaattatcacattattaccattaatgagtagtgtgagactaatcacgaaaaacattgctcaactcacccataaccgcgggtacggctattcgaatagtttaaactctgatcagaggtgtaccactgtacccacaagacacaatcccacaacatgttaccatgcgccttagtaccaccacgatacctcggaaaggaactgtgacaataccccttgcacaacacaactcaccacagtgcaccatacctggatcataatcaccccctctacaaccagaggcatggactccccagcgacccccacggacttctcgccgcttctcagtctggcactccataatgaatcatgctatacaaaaggtaaagccgttgcccacgttggcttgtggttggcacgataaatgtttcacaacagtagctcgcgaaccggtcctttattgtcatgagcacaaccatcaaaaccatatgctcacaacccaccttatccaggttttaattatcaattaattaacatcacacgataaatcatcgtgagctaccacttaacgtaaccataattaataataataattatattatataatttatatttaaaccctttagttagctaatgtttctaagcatggctaagcaaacttacatatagcatttagctgaaccaatccaatatataaggttcatgctaattaaattataacccataggaaaataagatcatcttcggccattaattaactggggaaggttcaccacccgatgacattcgaaaacgatgcataattgaaataaaataatagctttaaacgggttcaacatgctcaaagggttgtttgggatctgtgtgacttgccttgggcttccgcaaacgcttcggaaccttcctcaacggaaacgctctcctccggaacgtcggaaactaaagcaattaaacaaaaattaacaaaacagtacaaaaaaagcataaacagtacatgtggatatttttaacatgtagatcttgattttagaaaaatttagcaacttgaaccacctgaaacggatctacggttatttagttatgattttccgaagatttaatctattagaaaaaaaaactggaaaaagaagaagatgatgatgccatgatgacgtcatcaatggccggcccgggttggcgacctcgccggagattggatggtcggctgcgactttggaggacatgtacacgtagaggacgacgagacgaacccgacagtactcaccctcgagccaaacgacgaacgacgacggccggcgacgaagaggacggcggcggcggcttggtcgacggcgacggcggagctccggcggttggctgcgaagggggacgggtggccgagcttccccacggcttggcgcacctaaaggcgatggcggcgagcggcagcgacggcgcaagcggcggcgcggcgcggctgagcggcggccggcgacgacggaggactaggcggcggtggcgcggcggctacggagcacgggaaaggacgggagatggagcaaacgaaagaggaggactagggggtcctatttatagccttggattgaagagatcggactcctcccgcaagaaatcgactcgggaaatcaaaaactcggttttagagataaactcgaaaacgagttcgattcggataaaatacccaacgatttgctccgattcttgagggtaaagatagaggaggatgtggggataaaaacccctcaaaaatccggactaaaagtggagagattggggcggattcggaggcggaaggcggctcggtcggccggctcgggctcggcttgcagccggccggaggttgaaggaggccccgacatgtgggccccacatgtcggcggctcgaggaggagggggcgggcgacgtcggctgggccggcttgggccggttcgcccgcgcgcggagagagaaagatgttgggccaaaaacggcccaacggctttagggaggagttttggaactttttaattaaaataatttgtgaaatgatgtttcatttattaaaaatacttcccttgctcaaacaattcctagaaaaatctagaaaatagaggagcaagtgtagtatttaataaaactttatctagctcatttttttgttgaaaattttcctaaataattagggtttagcttgtaggcttttaaaaaaataatttctaaaaaatgatttaaacaatgcatttttaatttaggcgatttttagggcgtgacagacaccgaggcttgagttacctcttcacttctcctgccacataagcatcaagctcctcttgactgcaatcgtacggtggccccttgtttttggtggcgtcaactctcaccttcttcgttgcccttgtgcgggcaggcggtggagcttggcgagaccttgtcttgggaggtgcaggcggacacggtggaggtggaggagccggaggagatggtgcaggaggacgtggcggaggaaccggaggagatggtgcaggaagagatggcggagccggaggagatggtgcacgagacgccgcttgtcgcctagggaggatgatgtaccgcttgcgccatagtataatggtgtggcttgtgtctcgtagatgcgtctcaccgtctcctcctgggtagtccaactcgaggtcctcgtacgcagcttccactagctcaacttcgaccctcgagtatcctgctggaatcggcctgcagtggtaagtcctggaagggtccgttgggatggccattcccgacgccaccttcacgtgatgagaggttatctattagtaatcaacctaagcagcaacttgcagaatgtacaagtcaaaaatcatcaaactacgagcataccttgattgataagttcttgaagggaatatgcagctcacatggtgtccactgcgtgatctcatcaacggggcaggtggtttcgtcctgggtttgcatggcgtccatgctctgtgatcctacctgccccgttgaggtgcagctgctatgattgcctgatgggctgaccattgcaggaggaatgtacggctggggatcctaggaccaatgtgcggccatacgttcatccaccttccttgccacctcctcttgcatgctgagctcgtagctcaataccctgtactcaagatctgcaatcttcgcctcggtatctctcttgctcctcatccgactcctgtatatgtggatgtcctccttaaatccaatcttccaggggatcacgcctttccctcgtgttcgtcctggatgctcgggagtctgtagggcgagtgacagctcatccttctctctatcgggtcggaatgtgccctgagaagaggctaccactgcgtccgttagttgactggcagcctcgcgtatctgatcgctgaagacaagggagccatcaactaggttaagcgttccaccatgagcatagtaccagaactttgatcgatccgatccggccatttagcggtggccggttcgatacccctctcaatcaaacttgcctccatctcctcccacttcggcattgcgacgctatatcagcctgaccccaagtggtgatggtacttcttggcggcattttctttgtttctagccatcatcgcttgcccttgttgccctgtcttgtaagcaacgaacttgtcccaatgatctcttagctttggaaatacgtcgaagttcggtgttagttccttcaggatgtatttcttgtagagatctcccttgaagctctggaactgttctgccattttcttcagagtccaccgtttcactatgttctccgtacccgcgggtagcgtgaacgtctcgagcattgtggtccacaacatctctttctctgagtccgggacaaagctgtcattatccctgcatgcccatgttctgcgccagtacaccgtgctgacaggcacgttgtccctcacaacccaaccgctgtggcatacaaaattcttggttgcttctgccggggcactaggtcggccgtctttgtccatctcagttatgatgtgccgaccctctatcttcttcgtggcacctcattgtcagtgtgccctcttctgtccggcgaagggatgacttccactagcctcctcctaatagttcccctcctcgttcccctccgcatccctctccacgttcccctcctcgttcaagtactggtttggatcctcattcccctcttcttcgttccagtactggctacttccctctgcgattgtatcgtatagtatatgttcctcatcgcgatcagccatctgtgcatacaaaaaatatttgttaggtctagaggatgtatttgctaaccgtaatattaaaactctactaatcttatattaaatctctaataatcttatattaaaattgtaataatcatatatatatatatatatatatatatatatatatatatatatatatatatatatatatatatatatatatatatatatatgcgctaggtctaacaatcttatattaaatctctaacaatcttatattaaatctctaataatcttatattaaaattgtaataatcatatatgctaagtctaacaatcttatattaaattgctactaatctaatcttaaaattgtaataatcatatatatatgctaagtataacaatcttatattaaatcgctactaatcttatattaaaattgtaataatcatatatatatatatgctaagtctaacaaacttatattaaatcgctataaatcttatattaaaattgtaataatcatatatgctaagtctaacaatcttatattaaatctctaacaatcacttcattacatcacttgcctgcgcgaattccttcgatggctagttaccacttcggcttgagggacgacgacgacatcttctctgcaacattaccaggaaaatgtattagtctaaacgggccaagttacatatataatcatatatgtattaccaggaaaatgtattagtttaaacgtgttcgttctcacacttttagtacaagtgcattcacgttcgtaagcatttcgttcatgttcgtaagcgtttcattcacgttcgtaagcatttcgttcacgctcgttcgcgttcgttaacgtttcgttcacgtccactcgtgtttcgttcacgttcgttaacatctcattcacattcgttcacgttcgttaagcgttcgttcaaggtcgtccacgtatcgttcacattcgttcgggttcgttcgcgttcggtcacgtttcaatcacgttcgttcacgttcggcaatgttgggcgcgcgcggcagtggcgtggtggcgcggcggcggcgtcggggcgccgtgggctggtccagcggcgggcgggcgcggcggcggcgtggcgtcgtggcggcgtggcgagctcgaggcgggggcggcggcgtggtagtggcgacggcaacggcggcggtggcggtcgcgtagaagtcggtcgtcggcggtggcggttgaccgcggtgtggcagtggcgtcggcaacgagctaggcagcggcgatttggagagagagagagatcgagattgagagagagagagagagagagaggtagtggcggctctcacccaagagaggcggcagcggcgtctgcggcggtggcggagagcaccgccaagggacggcgagagaagacgatggcgtcagcgcagggttgccctaggcacggtggcggcgaaggagaagccgagatcgatctcgatggaaaaacatctaagtattggtggagaagacgagggtgtaccgggaatatatataccccagatctttagtcccagttg

SEQ ID NO: 59429 - DNA, 745 bp, Oryza sativa
cagtagttcatcacatgtatcggctaatactccgatactacgctatatcaggacattaaaacagatatagaatatgaagcaaaagcctaacacattcaaatacaccaatatcttggcataaagggcagtgaagcaaatagagataattatagttaaatcagatacgaccggctgaaactccgatgctattctaatcggcgtatatatatatatatatatatatatatatatatatatatacacacacgcacacataatagaaggattttgcaggtgagaagacaatgatcgacaagcgtcacgtgcacatgtcggacgagttcctgaggagcaacccttccgtggcggcgtacaactccccctctatcaacgtccgccagaatctcaccgatgtcactgtgccccagctgggcgctgccgccgcccggctcgccatcgccgactggggccggccggcgtgcgagatcacccacctggtgatgtgcaccaccgtcagcggatgcatgcccggcgccgacttcgaggtggtgaagctgctcggtctcccgctcaccaccaagcgctgcatgatgtaccacatcggctgccatggcggcggcaccgcgctgcgcctcgccaaggacctcgccgagaacaatccaggcggccgtgtgctggtggtctgctccgagggcgtctccatggtgttccgcgggccttgtgaatcgcacatgggcaacctggtagggcaggcgctgttcgggga

SEQ ID NO: 59430 - DNA, 886 bp, Oryza sativa
cgtctccttcctcccgcccggtttctctctctcccgtgcgaaccctagctcgctccctcctccaaatccgcttgattcaattggccaattccaaaattgattagggggttttaatccccattgattcctcttcaattccccccaatttcccccttgaatggcgcccccaattgtcaggaacggccgcgcttttcccggccaccaaccatggccgccggccgtgcttctcgtcgccgttccgccctctcccatgcccggctccctcccccatcctataaaatagaaccccctctttgcgttctaccgttttagtctcctcccgagctctcccgtggtccctagccacctccccgccgtcgtcccctctctcccgtgccgccggccgtcttcagccgcccctgccgccgcgttagcacgccggccggccgtgccgtcgcctcctccagcatcgcagccgcctcctcttcgccggcttgccctccgtttcccgcggagacccccggagctacgttcccgccgtcgcccttctctttccttcgcgccggctgcctccagccgcttctccctcctcgccggagcgtcatccggtcgcgccgtcgccgccagcagcgtcgcagctgcttcccctccaccggcgtcgcctccgtttcacgcggagaccaccggagacgcgtccccgccggcaaccagtggcattggtgccactgtactccctccagccggctgctgtccctcgtcggagcgtcggccgacgtcgccgtctccttcgtcgacgccgtggcatcgtctccttccccggccacaactcggtttcgccggaacaccgccgtgtcgccaccaacccctcgatccgcctcaccggagttgttcggccgcccgtccctcc

SEQ ID NO: 59431 - DNA, 8527 bp, Oryza sativa
cacaactctcggagtgaagagtacttagtgacaaaggtcaaaagatgactgataggtgatatcgaaaaagatgtttattaccaggcaaagaagtaggtcgaaaggtgattgataagagaaatctaaaaagaatacgtcagggctgaatgtgtaaaggaatactttgaatgctaaatgatgacaaacatggtatcctagtaatgacaagctagtgttgacgcatgacatgaagtggtaacttgtatgaggttgactccaaagatacgagttataagaagttctggaactgaagccccatcttccaatgccgcatcccagtcgaagtcagctagaggtacaaccagggaaaagtcaggtgaagagaagattccatctgcaacaggagatcgagccaagcagtccagagtggagaagttttgttaggcaagtttgttatagaagacggagcggaagaagttagacaagaagagaagaccgcccaacctatcttcttgctagcctcctcgaatctcggggacgagattcttgtaaggggggtggatttgtcacgtcctgataaattcatcccgaaattaaaaatcattctttaaaaggaataatagaattaattaaaattcgaaaagaaattggcaaacactaaaatacgtgcaagaaaaattcaaatgtggcccggagaatttttgttaaattctccttggtctaaaaggagccctcaaattttacttgaattttcagagcaccggaaatatttataaaacaacaacaacatttatcaaagttcaataaaaagaaaacctaaaaatccctcctcttcctcctttgggccaagcccagtccgaagtcctcctctcctccctcttttctctccctcctcctcttgggcccccttcccctcgggccacctccctcttccctctccctcccgggctgcctctctcttcccctcccctcccggcctgcccggcccaggccgcctctcactcctctcttcctgggccggccgccggcccaagccgccccagcccccgagccgctcccctcccgcacgtgccgcgcgcgtgcgcgcgctgacgccgccggccgaccgcgtggggcccccgcgccaggcgcgtcttcttcctcccgcccggctcctctcactcccgtggaaccctagctcgtttcctcctccaaatccgccccgaatccaaccgttccttccaaattaattagggggaattaatcccctttccctcctctctctttcccccttaatttcccctttgatggtgcccccaatcgccgggaacggccgcgccattcccggccgccttccattgccgccggccggcttttccgccgccgttccgacctcccccgtggccggctccctcttctctcatataaaatgggatccccgcactccgttctaccgtttaaccccatcccgagcctccccgtggtctctagccccatccccggccgcgccctccctctcccacgccgccggcgacctccagccgcctgtgccgcctcgcccgtgcgccggccggccgcgccgtcgccttctctagcatcgcagccgcctcctcttcgccggcctaccctccgtttcgcgcggtgaccgccggaggcgcactcccgccgtcggccttctcattcctccttgccggccacctccagccgcctctccctcctcaccggagcatcgtccggccgtgccgtcgcctccctcggctctgcaacaccgtccccttcaccggcctcaccgtctcctcgccggaaactcgccggaacggtgcccccgccggcaaccagtgacattggtgccactgtactccctccagccggctgctgttcatcgccggtgcgccgatcgacgccgccatctcctccttcgacaccgcggcatcgccttcttccccggcatcacctcctcctcgcccgaatttcaccggaacgccgtcgtctccgcgccggcctctccttcctcctcgtcggctcgtcaccccgctgcaccaccaccttcaccaacatcgcagcggcgtgttccacgcgtcccctcctccgctcagccgctgctgcctgccatcatcatttcatcgtcgtctccattcatcctcgccgatcgacgtcccatcggttgcccggctcgtcgtctcgcggcgccgcctccgtcatcgtcatcgtagcggcgtgttccacgtcgtcctcgtccccgtgcagctgctgctggctgcccctcgtcgccccctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtctccgtcctcggccccgcgtcgtcaagcctcgtgccggccgcgtctcgcctttgtccaaggatcgccgccgaagtcgttccctcgccgttcgcctccgtcgtccccgagctgtcctcgccggtcccgttcgtcgttgtcgttcccacgcctcgtcgcgtggtggtaaggatccgtcctctcgcttccccgccctcgtccttccggtgtcgccccgtacccgttgtgcggtcgtcgaccccggtacccgtgtaccggtgtcggtagtcgttcacgtgtgcgggtggtgaccgggtagtgtccgtgttagtgtgcccgctcggtagccgcgtggtttccacgggtgcaggccgtgtggtgtctagtggagtccgtttgtcggccactcgcctcggttgacacacgggttccgcttccgtcgacccgtggaccgtctctgtgtactcggtctaccgtggtcctttaggttgacatgtggggtccgcatgtcaacggcgcagccctcctgtcttttccaggctagcgcttacacctgttttatagttgcaaagcttaattataataattcgcaaatctccatataacagcattaaacttcggatgatcatatcctggtcatacgagctccgaatcgacccgttcaagtctcttaatgtttgttataacctaaagaaccctgtgctttgtttttatgtattgttattgcttctttataggcttgtagctttgcttgtgtgcttcgcgtagcttctgtcgttccggaggttcccgaagcgtggttcgcggtcgtcgccgaaggatcggaagtccgttctctctgagcaaggcaagtcacatcatccttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcgtggtatccctagtttaaatttaggtagatgcttcgctgattaattaggcaacattaggtggttttataactttagactttggggattctcatatcatttggacactatggaattgttggtttatggtggaattggacatacacctctcttcctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggttggtactcttgtctaaggctaggatgggttggaaactatgtcacgtcttccgtccgtataccgtggtggtatgtggcgcgtggttacacgtgaggaagatgtgtcttgtgggtaaagatgtacacctctgatcagagtaaatctattcgaatagccgagccctcggatatgggcaagccgagcaatgtacccaagtcagtgttctaattcttaaaatttgctcaaacaactaaaatgtggaatggttggcctgggttggcttgggacgagctggaacccaggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgctgtttactgcaaaactgaacccctatattattatccccttgtacccccttgcattaattatgcatctccggtgtgacttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacagtccaggtgatcgacgacggccgacatttattagtaagaatttatctccagagtttagaaccatgttgatagagctattcaaagaattcagagattgcttcacttgggagtattatgagatgcctggactcagccgattgattgttgaatatcggctacttatcaaaccaggggttagaccacatcaacaacctccgagaagatgcaaagctgatatgcttgatcccgtaaaggctgaaatttaacgattatatgatgcttgttttattcgtccttgccgatatgctgagtgggtttctagtatagttcatgttatcaagaaaaacggcaagatcagggtatgtattgatttccgaaacctgaataaggctaccccgacagacgaatatccaatgccagtagcctatgagctagttgatgctgcctcgggacacaaaattttgagttttatggatggtaatgcgggatacaatcagacctttatggctgaagaagatatccataagacaacttttaggcgtcctggtgcaatcggctcgtttgagtgggttgtgatgactttcggcttgaagagtgcttgggctacatatcaaagagccatgaattatatatatcacgatctgatcggctggttagttcaggtctacattgatgatgtggttgtaaagtctaaagaggtagaagaccacatagccgatttaaggaaggtttttgagagaaccaggaaatatggcctaaagatgaacccgacaaagtgtgctttcggcatatcggctggccagtttttgggatttcttgttcacgataggggaatcgaggtaactcaaaggagtgttaatgcaatcaagaagattcagcctccgaagaacaagatagaactacaggagatgatcggcaagataaattttgttagaaggtttatttctaatttgtctggaagattagagccttttacaccattgttgagattgaatgccgatcaacagtttacttggggggtagagcaacaaaaagcgttggacgatattaaggaatatcttagctctcctccagttttgattcctccccagaagggggtaccttttcggttatatctgtcggccggtgagaagtcaatcggctcggtttgattcaggagcttgaagggaaagagagagttgtgttttatctaagtcgtcggctcttggatgcagaaactaggtattcccctgtggagaagttatgcttgtgcttatatttttcatgtacaaggttaaggcattatctatagtctaatgaatgcactgtcatatgcaaggccgatgttgtcaaatacatgctatcggccccgattttgaaaagaagggttggaaagtggatattttctttaactgagtttgatcttcggtatgagtcgggcgataaaggacaagctatagccgattttattgtagagcatcgtgatgattcaatcggctcggttgagatcgtaccgtggactttattctttgatgggtaagtgtgcactcatggttgtggcatcggcttggttattatttcccctgcgaattttgagtttgcttatactatcaaaccgtatgcaaccaataatcaagctgagtatgaagcagtgctcaaagggttacagttactcaaggaggttgaagccgatgctattgaaatcatgggggattctttgctagcaataagtcaattggcaggagaatatgagtgcaagaatgatacattaatggtttataatgagaagtgccaagaattgatgaaggaatttcggttggttatctttgaagcatgtatctcgagaacaaaatattgaagctaatgatttggcctagggggcatcggggtataagccgatgatcaaagatgttaaggtcgaggtcgcagcaataacagccgataattggaggtctgatgtgcatcaatatttacagaatccatctcaatcggcttctcggaaattaagatataaggcgttgaagtatactttattggatgatgagctctattatcggacgattgatggggtgttgcttaagtgtttgagtgccgatcaggctaaggttgcaatcggcgaagttcatgaagggatttatggtactcatcaatcgcctcataagatgaagtggttactttggcgttcagggtatttttggccgacaatgctggaagattatttcagatattacaaagggtgtcaagactgctagaaatttggagcaattcagcaagcaccggcgtcggctatgaatcctatcattaaaccatggggtattgatatgatcggaatgattaatcctccatcgagtaaaggagataagtttatattggtggcgaccgattatttcaccaaatgggtagaggcgattcccttgaagaaggttgattctggggatgcgatacattttattcaagaacatataatctatcgatttggtatccctcaaaccattacaaccgatcagggttcaatttttgtatccgatgagtttgttcagtttgccgacagcatgggtgtcaaattgttgaattcttcgccatattatgcacaagctaatgggcaagctgaggcatctaacaagagtttgaacaaactgattaaaagaaagatttctgattatcctcggcaacggcatactcggttggctgaagcgttgtggtcttatcggatggcttgtcatggatcgatccaagtccctccttataagcttgtttatggacatgaagctgttttgccatgcgaggttagaatcggctcaagcagaactgagctgcaagataatttaacagctgatgagtattgtaaccttatggccgatgaaagggaggacttggtttagtctagattaagagccctcgcaaaggttaccaaggataaagaacgggttgctcggcattacaacaagaaggtagtacctaaagatttttccgaaggtgaacttgtatggaagttgattttgccgattgggactcgggatagcaaattcggcatgtggtcgccgaattgggaaggaccattccaaattcataaagtggtgtctaaaggagcttacatgttgcaaggactcgatggagaggtttatggacgagcgctaaatggcaagtatttgaagaaatattacccaagtgtttgggttaatgcatgatcggctgatgttgttgatatatgatagccgatgtgtttacatcgccttgagatggctgatatggttatattgcccttagctgtttttcgtattgtaatcggctgtggtttgccgatgtacaatggccgatatggttatatcgcccttagatgtttttcatattgtaatcggttgtggtttgccgatgaataatggccgatgtgtttacatcgcccttagttgtttttgtaattttctcaatgcttttgacattataaaatcagggggcacatatatacaaaacaaatgaaaatttttgagcaaatttagaagttatattaattggcacagatgattgtcaagacagtaaagtactggagtatcttagccaattacaaaaatttctaagacctattatacaaagagtcactgagacaaatagtgctggatagccgatattgccctttgcctaatctgttctacttcttcaatggcttgggcgtcttgagcatcggttccagggatgattttcaaagacttggtcagctcagcaacattcttgatagccgattttaatcgtgacttctgttcttcaacggattttgggagatcggccagctttttatgttctatatccagctcggcattgcgttcttcaagct

SEQ ID NO: 59432 - DNA, 7068 bp, Oryza sativa
tctcaccaaccgggactaaagatcttttcccgctatttccaaattctttttaaacccggttagggttaagaactaggactaaagataatagcagttgtgtcttgaatttcattgcatatgtgtttctaaaatagtaaataatgcattacaattatttaaagtcgaacaattaatgacaaaacctttgaaaattatttgttgtatgtagtagaataagtggataatatataataagcacatgaatgatttaaaattgttaaaaattctaataatcatatataattagcatatgcatgatattaaattgttaaaaattctaattaacatatgtaaatagcacatgcatgattaaaattaatacaaattctaataatcatatataattagcatatcatgatattaaattgttgaaaattctaattaacatatgtaaataccacatgcatgattttaataaaaaaaaatctaataatcatatataattagcagatcatgacattaaattgttgaaaattctataacatatgtaaataccacatgcatgatttaaaattaataaaaaatctaataatcatatataattagcatatcatgataataaattgttgaaaattctaattaacatatgtaaataccacttgcatgatttaaaacttttaaaaattctaataatcatatataactagcatatggatgatttcaatttgacaaaaatttctaataatcatacataatttataaaaaatctaataatcatatataattagcatatcatgataataaattgttgaaaagtctaattaacatatgtaaatacaacgtgcatgatttaaaacttttaaaaattctaataatcatatataactagcctatggatgatttcaatttaactaaaattctaataatcatatataattaataaaaaatctaataattatatataagtagcatatggatgagttcaatttgataaaaattctaataatcatacataattaacatatgccatacaacaactgatttgtatggatattcagtacattcaacatagtttacatcgtgtacacaacaattacgacaatacatcggcggtgacggttgactgcatgtactttctcctcactattgttccttccttgtgattgctacgtgagtaaggagtgtcttcatttgataggaggattctagggtcaatcgtcaccgtgaaagggggttgcgcatcaaactgatcgtaatcctcgtcagtcttttcctctactccgacgatttttctttttcctaggagaaccacgtggcgcttcggctcgttaggccctttgcccttttttcctttgctagacatgtccttgacgtaaaaaacttgcgttacatcattggcaaggacaaaaggttcgtccgagtatccaaccttgttaaggtcaaccgttgtcatcccactgtcatcaatagttacgcctccaccagtcaacctaacccattggcaccgaaacagagggaccttgagatgtccatagtcaagttcccatatgtcctcaatggcaccgtaatatgtgccagttgtaccatcgtgtcccatggcatcgatacgaacaacactattctggtttgtgctcttcatgtcttgggccctcgtgtagaatgcgtacccattgatttcatatctctggaatgtcgcgatcgagccagatggtcccctcgccaggaaggctagttgttggttaatcgtctcgttacccatgagatgttgacgcagccacgtggagaaagtatcaatgtgatgccgtgtaatccatgcatcggacttaccgatgtttctggtgcgaactagagccaagtgctcctcgatgtagggagccaccaatgaagattgttgcagaaccgtgaaatgggctttacgaaataaattgttgtctaccgtcattattgctttccttccgagagtcccctttccccgtagtctcccttcatggcgtgattcaggtaccccgattgggcgaaggtcttcgataaattctatgcagaattcaatgacctcctctgttccataccccttagcgatgcttgcctctggacgagcacggttatgaacatacttcttcagaacgcccatgtacctctcgaaaggaaacatgttgtgtaggtacacaggaccgagaataccgatctctttgacaaggtgacaaagtagatgcgtcattatattgaaaaatgaaggtggaaatatcaactcaaagctgacaagacattgcaccacatcattctacatggcttgtaatctatacggatcgatgaccttctgcgaaattgcgttcatgaaagcacatagctttgttattgttgcccggacattgtctgggaggataccccttattacaactagtaacaggtgtgtcatcaacacgtgatagtcatgagactttagatttgtgaacttcttctccttcgtgcttgttattcgctttatattcgtggagtatccagacggtaccttgatgctctccaaacattcaaacatactttccttctttgccttgctaagagtgtagctggctggactcaagtaatggcttcctttctcctttggttccgggtgaaggtcaccgcgttgttccatatgcttcagatcattaagtgcttccagtgtatctttcgactttccatatacacctaggaagccaagaaggtttacacaaaggttcttagtgaggtgcatcacgtcgattgcgtggcggacgtccaagaattcccaatagggtatgtaacaccctaaaaattcgacgacaaaatctaaactctaaaaatacggaccttcaaaaactttttaaataaagttgcatcatgccgattttgttcgattattttaatgaattttgatttcggagtttataaatcgcgaataatggataattagttaggagtaaaccctaaaaagtaaattgaccaagtaaataattaaagtgcaatttaaaataatatttagtgaggatagaaatgagtaaaatattattacgactatatttgtatcaattaaattgaaaagtgtcggaataagaattaactctaattaaattcaagaaaattatataaaaataaaatatgggttaaattaatcaaggatggacccattggttggaataacacaaatattgagtgaacttcatttgtacaaaattaaggtttatagaatcaattttaaataaataaataggcttaaatcgggtaaatagaaaacggcactattcatcggccgccaggtgttcgacgaggtcccctagcctaaccctgcgccgctgccgcaccgacgccgcgcccgcgccccacgcctcgcgccgcgcaccgccgctaccgccgtcgccttcggccgtcgccgtcgccgctcgcccgtcatgtcgccttgcgccccgtgccgccgctgccgcgctgtcgccgtcgccgtcgcgacccgcctcgcgccgcgcgccaccgctgccgccctgtcaccacccgtcccgtcgcgcgcgcatcccatcacccgccgctgcgccgtgcactgtcgccgtcgccgtcgccgtcgccacgtgccgttgccgtcgccgcctcgagccctacaccgccgtcgccatcgccgtcgcgccgcgccgcgccgtcccatcgccgcgcgtgtcccgtcgccgcacgcgtcgcatcgccgcctcgcgccccgcgctgccgcgccgccgtcgcatcacccccccttcaccgccccctctctctcctctctctcacaccctataaaacccccagccctttttttttcccccacacccatttccccccatctcctccctttttaccacgccaccgccgtagtgccgccgcaccaccgccttcgtgctgccgggccgctgttcccgtgccgccgcgccgccgttcccgtaccccgcaccgccgttccagcgccgccatgccgccactccagcgccgccgtgcgccaccgtcgctgccgccgtcgtcgccgctgccgccgtcggtgagccgccctccgttcccctcgcgtccaccgccgccaccgctcgggtgggagagagagccgagagagagagagagagagggagaggaaaagagagagccgagagagagagggagaggaaaacagaggccggcagagagagagagagagacaaagagaggaaaagaaaaagagaaaaaaaaagaaagaaaaagaaagggagaaaaagaaaaaggaaataaataggaaattagagggagattagggaagtttagaaaatttaaaataattggaattttataggttaattatagtcatagaattgcaaaatttaatatgaattatggattattcttggcaatttctataagaaatcaattcgcggtaataatttagatgtagttaataactaaacaaatagatgaattcttatggattattatagattatttttgggtaatccctataagtaatcaattcacggtagaaatttggatttaattcctagggattttagccgtgtattatatttaatcatctagtcatagactaaattaaatcatataatatttctaggatttcgtccgatattgagctcgcgatagaaatctctaacctattatatggatataatgctcgggtagattaaattaaaaatttatgacagcaaaacatttatacccgcaaaatagtttgaatcgaaattgggtttgccttagttcgcgaataataaagttaaaataaaggaatcgactttcgcattcgactttcatttggatttatttggattttgtttgaattctaatcgaattcaaattgttctttcacacataattatagagaccgagggagccgtggatccaggtgaaggccaagacccgcaagaccttgagcaaggcaagtcatcactattctttgaacatgttgatcctaattgcgaaattgttttgtttacaaataaaattgcatgcaatgataaacatcctacttgtgattatgccatgccttgattattgtttaccccttattccttcgtaaccatatttacgtatgagtccctagtcaactatgataattgcttagaaatgctattctagaatcatgcatactcatatttatcaaaatgctttatgcttgggcaattacctttgggaaggtaattgagatgcggcatgtggagacatgagcgccacattgccatgatattgatgacatgatttgtgaaaggagaaataaaactaaacaactattttttgactggggcggacggaggatttgggtggtatccggaaaaggctagtgccgtccctggtcaattaaggaccgagccatgaagctaagcatgaaacgacccccgtacgaccgcacttctcgtatgggtatagacctagcggagtacatagctgagtggaggcagtatccatgcatagtggtttcttttaggtgtgtgaatcgacaagcagtctactggcggatgccctgtcaggagggccagaggctgacttgcagtctactggcggatgccctgataggagggcctgagattgacttgtagtttgctggcggatgcccgttacggatggccagagactgacttgataagactacgagaaggaacccaaaagaggacagctgaaatggattgggttcaactaccggatgcaatgttaggaatgcatgtgtgagttttccctcccaggagcgccagaactcctctcactgctagaaatcgtatgacgcctagagtgcatgaggatgtaaagttcatggagcgggtactgccaatgcgaggttatcgaaaagctttgccgtgacgcatctcatgtgttgggacaaggctcatgtgttgggcagtcgcggagtgcgggtaaagtgtacatccactgcagtgtgagtaaaccaaatttattcgaatagccgtgctcgcggttaatgagcatcgggacatgtattacacttggctagactctaaattctttaacttgagtgggatggaatattgcatgataatttttgtgctgatggagccacttcctgagaggcgggaatgtggacgtcctcagaaaatcataacgactcaatggcgggaagctatccttgggatcacaacggatggtggacagaaccgtcattgtttaatatgaacaatggtattaaaacttgattagtctttgctaggtcttagacttgtgaaaagaattacaaaacttgctttgcgcaaatgaaccatagccatcctttgaaatcctctgtcatgtgcatcattgctgtggtggcttgctgagtacggttggtactcacccttgtaaatataaaattaatcagaagcgggagatgaagcttcggaggatccctatgcctactaccaggagggagatgaagacgaaggcgcccagaaggtcttagtacggtcgttgcctgtggcaatggcgagccgctgcctaaattctgctgccttacctatttctgcttttggatgtattccggatcgctcggtctgatgatttaagactatgcctacaggcttatgatgtaataattcgtactagacattcgtgtatgtgtatttggtatttcagctatgaattcgtgtgtaccagactacttgatccagggaaatggtactgtttacacgattgattcctgttataaaaacgggggtccacagggtaactcccaaaatatagagttctttttccacatcgccgcgtgaccatcttcactctctataggctggttgccaggcccctttccaaacactactttaagatctttaactatagcaaacattgttttcccattgcgatgtttaggcttcgtacggtggtccgccttatgttaaaagtgattgcctttcttccgtaccaggtggtttgctgcaaggaatcgacgatgacccatgtacacaaccttcctacagtgcttatgatatgtactttatgtttcatccatacagtgagtgtaagccttgaaccccttgttggactgtccggataggttgctaagtgcatgccaactgttgatggttacgaacagcagcgctcgtaggttaaactcctcctgtttgtcctcgtcccacacgggacactttccttcgtcca

SEQ ID NO: 59433 - DNA, 609 bp, Oryza sativa
gaatgggattagtggaagcgtgggcgcgagaaaggagggggcgaaatagtgggcgcgagaagcgaggagccgggcacagcgctggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgccatggcacggggctccgctctgctcgatggtagcgtgctgccgccttcccgcattgtgagcgagaggcaggctgggctggcgcgccgtttcatgccgggatctgccaccggccgggagatagtcacgctgggcgagggacgcccggcgccagactacccggggcggtccgtcttctttctcccctttgcaatggcagggctggttccgccattttcttctttcttcatggatgttctggagttctacgatctccagatggcgcacctcacccccaatgcggtgatgactttggccatcttcgcgcatctgtgcgagatgttcattggggtgcgcccatctcttcggctgttccggtggttcttcaccgtacagtcg

SEQ ID NO: 59434 - DNA, 12263 bp, Oryza sativa
atttgagggaggtaaggagctagggttcacgggagagagaggaagtaggccgggcgggaggaggatgatgacccggcgcatgggacccacgcagggagtgcggtcagcgcgcgtgcggcgcgcgtgaggggtgtgcggctcgggagtctggggcggcttgggccggtaggcggcccaggcgggaggggaggaaaagggagtgggccgggaggggaaggggaggcccaagagaaggagggagagaaagagagggaggaagagaggacttgggccgcgggccgagggagagagaaagggaggactttgggccagacttggcccaaaggtggaagcaggattatttttaggttttctttttattgaactttgataaatgttgttgttgctttataaatattttcggtgctctgaaaattcaagtaaaatttgagggctccttttagaccaaggagaatttaacaaaaattctccgggccacatttgaatttttcttgcacgtattttagtgtttgccaatttcttttcgaattttaattaattctattattccttttagcgaatgatttttaatttcgggatgaatttatcaggacgtgacaacctatgtcaatttcttccaaatcatcagccgacacaaaaccctgtccttgcttgtcatcgagatcatctaatgtgtccttagtgtagacattcgaaccctccacgacgccctcaaaataatagcttgggttctccatcttcaattggctgtatctcagaatcggacacttttagaaaatctccatcccaaacttttccagataaacaatctagaccatccatctcccaaagagctaaatcggcactggcaacattgactgacctgtcggctggcacaatttcaatcttgtcgtcttgccactgaatcaagcattgatgcatagttgaaggaatacaataattggcatgaatccaatcccttccgagcaacaagctgtaagaacccttcccatcgatgacaaagaacgttgtagggatggttttgttgctgactgtcagctccacattcaaaacccctttggtttctgatggattgccgccaaagtccatgagcaccatgtttgtcttgatgagatctttggcatttctgcccagtttcctgaacgtggtgtaaggcatcaagtttactgcagccccaccatcgaccatcatcttggacatcggcttcccattaacgtaaccatctatatacaatggcttaagatgccgatgctctgtaccctctggcttctcgaaaactgcctgctccggtgataaaatcaacttagccgattcgtcttcaattttatcgacatcggcttgtttgatcccaatttcaacaggcaatgtgaaaaccatgttaaccgaagcagttacaacactttttcacttagccaaccttcttgcttcatcatccgtggcttcatcagctacaggaacttgattcttaacacgccactcctgcctcggctttgttttctttagccgatgattgatttcctgctgacttcctgaaagcgctccctgttcctcaatatttgaacccttctcttctgattctttgtaaagataccagaaggacaccattgagttttcctgttttcattgtcctcctggccacgaccttggtttactggacccaatctttgatgaacaggaaccattgtctgccttagccgattgcccctgctatacaatcggcttgagctctccgcaatatcactgcacccaggacagtcctcaatagatggcagccttataccttcattccaataaaatctaaagaactcgcaaccccaatgaggatcaaagccatcaccaccttcctcataatgcttctcctgctgtttgtcatacttcctctgatatttgttgataatcttagccgaatttacctgaaaccctcttgcacgacctccatcggctgtccagccagctgtatgtaccatattgacaggaaaaggattgccatcaaccttcatcggcctcttagaatcatcaaacttgattttgcctccttcaatagccgcttggactgctgcctgaagaccttgcaatcattagtagtatgagacccagaattatgccacttgcaataccttttcttgcccaattctttagccgatggaattgtgtgaccagcgggaagttgaatctgcttttctcggagtagcaagtcaaaaatcttgtcagccttggtgatatcaaagtcatacctctcctcttttctagaattcttcacccattggtatggtataacctttttgctccttacccattcgagtgcagctatcttagaatcatcatccccatcatccgatccatatatatatacatatatatatataaggacaaacatgattaacctttctagaattcttcctagcctctgcaaacctctgttcatgcaaggttaccttctgtgtaagatgtgacaagctttcgaagtcttcagatgagaatttctccctgattggagcaatcataccctgaaaagccaaatcgactaactgggcatcagtcaaacttaagctgtagcacttattcctcatttctctgaacctctgaatatactcatgcacaggctcatcatgtctctgcttgattgctgtcaaatcagacagtttcatctcatgtaccccactgtagaaatagctgtgaaaatgcttctccaaatcggcccaactgttaatcgacccatatggcaaagaagaaaaccaagtgaaagccgatccagacaaagacaaccagaacaacataaccctcaaggcatccatagccgatgcttcaccacactgagataaaaatcggctaacatgttcataagttgatgtgctatcttgccctgagaattttgaaaaatctggaactttgaaccgattaggtagaggaactctctcaaaccattcagggtaaggttgtcagtacaaatttctagcaactttcggcctaagcccaaactgctccttcatgacatccgcaattgtcacgtcccaaaacgaccctaaaatatatcctttaaattatgcccagaataaataaaatccttgtgaaagcctccaaaaattaaaatatgcaaagttaaaagtcaaataaggcttggagaatttttgtatatttcctaaaagcctaaaatgtgtaaataaattttagtggaattttcagagcacaaataataattattaagaaataaacaaagttaaaaaggttttataaaaagaaaaaccctaaaaacccctctcccctctaatgggccggctgagcccatctccctcccctctctctcctctcccccgcggctcattcggcctctccccgcgcgcgcaccgctgacgggcgggcccgcccgccaccctcgctgacgggtggggcccacccgtcatccccgacctcccgccgctcccgccgccccgcccgtgccaagcgccaccgccgccgccgaatctgccgcatcccgccgtccccgcgcgcaattaagtggggggaattattccccgtgatcccctccctctttcctccctatttttccctctctctctctcgcattcaaatggccggatttgctcccgcaaatctcgccggcgccattgatggcggccgcacctcccacgccggtttccttccccgccggccgccctctctcccttccaaccctatttaaaccctccccgcaactctctcgcccgtttccgccacttgccgcaccttctccccgccggaaacgagctcgcgccgtcgccctctctctcctccgtcgccgacgacctccggccggccctctccgctcaccgggaccatctcccgcctcggcatcgccttctccggcttcgccgcaccgccgccgaccccgtccaccacctcgccgagctcgccgaccgccggaacgccgtcgtccccatccacccgagccgcgccgccgccttcctccgctccggccgcctcctttgtcatcgccgtcgacccggggtgagccgtggaccaccgcctcttttcccccttcccttcccctctctcggccgccgctctgccgtgcctatggccgccgccggcgaccataggggcgcgggcgccgcctccgggcgcgccgtgtggccgccgagtggggcccgaccgtcagccgcccgcgccctcgggtgcggctgacgcgcggggcccacggcgccggccggtgtgagcccgggtacgcccggtccaccgtggaccgtgatgctgccgcgtgggccccactcccgtggacccggtccgcgcgccctcacacctcggctgacgcaataaaccctttttaaattaaaatttaaatgcagaaattcgtaaatattcatttaagagcagataaacttcaattggccataacttggccatttgaactcggaattggaccgttcaagtctctaatttttccttaagaagtcaagaacctatttgtgtgctttgttcttgcttgttatatggagtttattagagtaaaagccttttttcctttccgttggtcgtgtagacgctgcagcttcagaagatccgctccacgtggaggttgaagccgatgtttgggaaagcgagcaaggcaagtcacatcatctttgaacatattggatcccagtttgtgaaattattttgatttaaattaatgcattaccgctttatttaaattcccgcgttatcactattttatttagccatgcctatttgcctttgttatgaccttattattattgttattgtgattattaccttgttcaccctagaataaacaaaaccccaactagtgggtactctattcatggtaccactagtatgaatttaggtagatgcttcgctgtttaattaggcaacattaggtggttttataactctagactttgggaatattcatatcacttggacattatggaatggttggattattgtggaattggatgcacaccttcccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggacgaagtcgggggtcgatggacatctctaggacaaatgaaggctacacgggctgcggcccggtagtcgagatgtcatggcacagggatggtgtcctgctgctaggggctcagtcctgcctacctgtcctagaggtttcggccgtaggtggggttgggtcggtactcttgtctatggctaggatgggttggaaactatgtcacgtcttccgtccatatgccgtggtggtatgtggcacgtggttgcacgtgaggaagacgtgtcttgtgggtaaagatgtacacctctgatcagagtacaatcaattcgaatagccgagccctcggttatgggcaaggctagcaatttacccaagttagtgttttaaattcttaaaaacctgcttaataactaaaatgtggaacggttggcctgggttggcttgggacgagctgggacccagggtcgggttgcaagttcggtctgaatcatcgtaggccttgggttaaggcaggttcgtgtgggttcacggccttgtttaataatattgaattgttctaggatcgtgttttaaaagtagctttaagcaactaagtgtcttttaaatgctgtttagtgcaaaccctaaccccctatattataactcctttgtactcctttgcatttattctgcacttgtgggtgtgtcttgttgagtatggtggttgtacttagtcttgctcaatttttcccaaactcagatgaggagctcctagatgatgaaggctttggtgtctagctcgtgcctgctgtcaagcgcctgtggtcgtcgccctagtcatccgttgtttttcgttgtcttcttgtgtgctggtccttcgttgcccatgtaataattaactatttacgcttccgcttgttaaactctaaattgtatcaacttttggtgttccttgcctcctgggacaaggaataatacacgcacgcaaggaacgcctgttgggttatttccagtcgtgacagcaatcaactcggcccatggttgttgctaaggtgctccttgaggttgctgtggcatgggctcaaattgattgtattgaggaacaaactggggttgagccgatcctgcctgctggtattgaacttgcggtgatggcggctgttactgataattcaaattgcccccctggtaattttgaagatcctgctgaatattgcgcaccaaatgcttgggaataacttgaggtatcaccgtgccatctagttgtacatgatgaaccaaatgctccgggacaacttgatttgcagcatgctgcacaggctgaccaccaggtgtcgcaaacctagccgatgcattcattaagccttgttgctggatccgctggacaacctgctgccttagtggcgtctattgaattggctgcaaaacctgccgtctgtgtggcatatgctgagctggttgcacaacctgttggattgggggtgtttgttgaatcggttgcacaacctgctgccttggcgttgtttgctgaatcggctgctgctgggttggatcaacggtatgttgaggaggtaagaacatagatgcaacctagtcttgtgttagccgattcacgttctgtccgctgtgttgtggttattctctcaccagcaaacggggattaaccaattggcctggtgccgacggagctgcaggaggtgcgggagccgatactggtgccgtcagctgagccgatggtgcattgtgagggattgactggacaactggttgattatcggtgattaatggccgataattcgggaaccctcctcctggtagataaaccggtcctgtagcttgatgctcagccattgaaccatcaaccattgattttaccatgcttgccaaagtattggttaatatgccagattgattgatcaaagcatggtgtacaacatagtcaacctgatcttagaagttgttgaactacaactgtgctgtattgctatcttgattaacacctccaccttgaactccctgagcaccatcaccttgaactccctgtactccttgagagttgtcaccttgatttccttgagaaccatatgtagcacctttatcactcggttgagccgagccatctggagcttgtttcacctctccatccttagaagaaccagtcctaggaacatcagcaactacctttaccttatacttctgcaccaccgttctcttgcgcgtttgcataaatgaacttaagaactggttacgtgcttactgcatcattgcttcaaatccttcttttgatcaggtgtcagcttgtctggagtgatggtcacgatgttgctctcattaacctcggacaggcctaactgctggatcttctctttaacagaaccggggctagccgaggacggtgatgctggtggcttctcctccatggagaaaaactgttgtcgcggttctgacttcttatcaggtccaactaggcgtgccaaaagcgtgttgatgaaaaacacgaggcttgggagatccgctttgttccagtgcaggtccaaaactcgcctccgggtatgctaacgtgccagttgatttgatcctgcaattaacaagaaataaagacaaagaaaccgcggttaaacttataaacgatagacgatcggcaaaaggccgatgatatatcatttatctttgagccgatgtcatatatgtatcgatcggcagtcatgaataaataagaaagaactaaaactactcgatcggctgcagatattaacgatatatactccttatatcgatatatacttaaatcaagtgattgggatagatcggtcgccatgccgagacagtataaatcacttagatcgaaatatatattaataatgggactatatatgttcatagcatagccgatcagatagatctagcatgtatcggctagtactccgatacgactctatactaagatattaaagcaagtagaatataccaaacaaaagcctaatatacttaaatgcaacaagatctcaacataaagggcagatttaacatgttaataaagcacataaaacaaatatagttaaatcaggtaagatcagctgaaactccgatactaccccaatcggcaaccaagaagtaggctagagattgagattctaatcacgactcataagatcaaacaactgatgcagctataagtatgaagggaagaacaatatctagacaatcaagccgctggaagtttcatagagtggtggatatcttatataatctgaatcaacatcgatatttaacctaatcggctgccctctatcgacagatgttagccgattgtaagttaaatagagatattgctagagattatgtaagatatatgataactcgacgaattatataaacaagattagagtatcattgagatggaagcactaatcccgagaacgcaagttgtcataacaagttttacctcttgttgaagatcgaaaccgatgcagctcaaaccaaaagtaagaactcgtcgaaataaaactaaagcaaaaagggtggcgatgcgctgagattgtattgaacgtgtatgttcaatgattacatggggttcagggtctatttatacccgagaatcacaaactatgtccataccggacacgactcttatctctaacatactctaagataccataagtctttgcggcagacttttgcccaaacatatctctaaggaaattacataaaatatcctaattaatagatacaattgccttctcaggactctatccatgcatggcaatcgtcttgaagcatatcaactcaacccgatgtcgcacaccaaatcgtatcgtcggaatcggctgtatcggcttacccagtctgatcggactcagccgattctgatcgtaaccgatttggactccaaccgattcttactgtgtttccgcaatgatcttcactttcgattccgcttcgattcaatcttcttctccgatactaatattaccaaactttaaaaagtagggtcaaattggtagctagatttaaagcggggtcaaataagcaattgccccaaaaataaaaaatgggtgcacccctataagatttaaaatcggcaccaatgggtttctctgcagtagtgagtataaactatgtttagtaatttatatcttaacgatccatcttatcaatttagtatttcatatttttttaagtacaagtttaacgtacacacaacacaatcgtgcaatcgctcacatatctaccaggactcgttttgtgaagattttaaaaaaaatttatagctatttagattgcatgtatgcaattagggccatgtttagatttcaacttttttcaacaaatttctaacttttccgtcacatcgaatttttctacacacaaacttccaactttttcgtcacatcatttcaatttctttaaaattttaattttgacgtggaaatcacaacctaggtgtgtatatgtactttggtgaaatactttctgcaagcacgaaatcctatagacacagctagcatacgaatcataagattgaacagagctgatcgacaaaagaaataaagaacggggaactacgttctgccgcaaaggatgccgtggcagcatcagctttcaacggcaagtttttcccatcccgcggcagacagtcaaaacaacggcgggtcgacaagtcaatgtttttgacacgacgaacaccataaaactttaaaacgtgtttgagagttgacgaaagaaaaaaaaaacatacccagaaaataacacaactattagctatgattaattaaatattacaacaattcttttaaatttaaaatttaaaaatacaactttttaaaatttcttttgtaaaagaaaatatcgtttagtattttggtaagcgtgaggttgaaaaaagtaatttttttctctgtgttgttgctgaacgcaacctaagatagcattaaagaagtactcatgggacaaaactttaacgaagtaaaactgaataaaaggatgcaaagtgcaaaaactaaaaagagtatcagtgactaggatctaatttttcaagctgttttcttgaatttagatatatatataaaaaataacttatctttaattaagaactcaccaggccatgtactagttggttgtcctcatgcttaattaatttggttaatctcatctttaatttggccaaaaacttgcttgctactccatatcgttatcaaccataacgaatgagattaagcaaagcacgagggtcgttgttgaagctgagtacatatttgaccaaattttttaatgtttagtggcacgtacatatatacctacagatacatctctttggcatgcgcacagtgttgtttatagagagagagatgcgttctagcgggatcagcgtaattgttgtcgttcgccacctggcgtggctggtgctaattttgtgctcatggccgcgggttgcagctgctcaggctcaacaagcaccaaaaactgatccagtcgaaggtttgtattgagttgttttgtttttccccatataaatcgcaggagtatagtacacttcggttgatatatggtgtcctctcttgccgcattgacacgagaagagttggaggaaatttgattcattaatcgcctagttttttcatctacatgattagtacttcatgacgagttaaccacacagcggccgccctgaacacgatcctagggagatggggcaagaaggcatcgtgggagtggaacattagcggcgagctctgcagcggtttcgcctctactgaaatcgactgggattactaccccaccatcaacccgttcatcaaatgcgattgcagtttcagcaacaacaccctctgccatattaccaaactgtacgtttgttttcatcagttgtgcaacatgtatctcgatgcggtgcctgaaaaatataagcaaaggaacatgtcagattatcgatacgtctgttttcaccagttgtgcaacatgtatctcgatgcatgcagtgcctgaaaatataagcaaaggaacatgtcagattattgattactagtatttccaattcatagagccatcacatcggtttatcctaaattgggtcctccggctccagtgacctttctttaatttgcatcttatttaggcaaaaccaaatatatcccaattagcacaattctcatatataggtattgcatgtctattatgcaggagggtatataaattgggagtagttggtcaaatacctgcagagctacagaatctcacccacctagagtatttgtatggtatctaagtcttttctccttaatcttgataactaattgttacactacagattaaggttttgccgtaaatataaattatattccatgttctttttgtgaaaacagacagcttatgctttttttctgctaattgacctagtgtttctttatgttgtcttcaggaactttaattataattacttgactggtgccattccatcattcattggaaaattcagttcaatgaaatatttgtaggagttacacatcacattctagatttatgtactatatccctttcatattataagtcgttttcagttttccaaatcaaatttctttagctttaatcaagtttgtaaaaaaatgtagcaatatttttctacataaaacaaagaaactattaaaatgttttcaatgttagatttaataaaactaatttggtgctagaaatattgctatattgttttataaacttgatcaaactttaaagaaatttgattttaaaaaagtcaaaacgacttttaatacgaaatggagagagtaccattcaatggttaatgttttttcttaattctgtttcatcatttgaagggcattagcttcaaattcactgtccggacaacttccaaaggaacttgggaacctcaccaatcttctctcgttgtaagataatctttcccatggcaaataaatcatcaactatttacttggactgcctcacccaatataatacaacaaatattaatcgcataacttctcaacaataataaattaagtaataaaaaaccataattgcaaaaatatcataaactactaaacaacatgtaacagacaagtcagtgcaattccttttccatgtgttgcatcgtttgatcaggaaaacacgatgccccctttcttctattatatagttgaactaaaaaaa

SEQ ID NO: 59435 - DNA, 12582 bp, Oryza sativa
aataccacatcaccttagcaggaattctcttcttcgttagctgcccgtcaacttctcctggatcatctcgtctaatcttgtatcgtagtgctttgcaaacagggcatgcttctaggttctcgtactccttaccacgatataggatacaatcattcggacatgcgtgaatcttctgaacttccagtccaagagggcagactatcttcttagcctcgtacgttgtctcgggcaatttgtttccctccggaagaatgttcttgacgagttttaataaatcgccaaatgccttgtcactaacaccattttttgccttccattgcaagaactccagagtggtatccaactttttgtgcccctgctcgcaaccttggtacaacgacgttctgtggtcctctaacatcttgtccaatttatgagcccccttttcactttcgcaatcctacttggcgtcctgcaacatctgaccaagatcatccgcaacgtcgttaccaacagcatccctttcctccccgcccgtttgatttccttcaaatccagcgtagtgagcaaagtctgaaatattgtcgtcttccacttcatcttcttccatttcaacaataatagcttggcatgaaccccgcatcaaacaagtggaaatgaatagtcctggatacagaatactccttctgattcttacacttattgcatggacaacaaataaaacccatttgcctgttagcttcggccactctcaaaaaataatgcacgtcgtcaataagctctttggaccgctagtcagcgtacatccattgccgatccatctacatgacatgaaaaaaaatcgtacacaaataattattcgtacaataatgatagtcatacaataattataaaataattacaaactctttcaacagtcacacaataatgacatatcattattcatacaaaaattatgaaatattacaacaaataattcttatttactatttataaagttttaaactaatattaatgtgttgtacttattttaatttttcattttagtttgttttctattattcaagataaactttcactatattttccttctcaactattttataaaaccttctttagcaaataaactaaatttctatatattcttccttccccacacaaattttctctctcatcaacttacaacaaaattttggagacaaaaaagtgtgtaaaacatagctccaaatgtaatatgacaaaaaaaacattggaggatgaagttgctaaccttttaggcacctccgatttgtatataatcaccaaaataaattcactagaaattttggcattacctcccctcttttttgaagaaattttgaagcttacttaggctggaggagaaagaagacatatatataggggtgggactttagtcccggttggtgttatgaaccggggctaaagatcgccggggtaacaccaaccggaactaaagttacgatctttagtcccggttggtgttaccaaccgggactaaagatcccggggggcctgacaaaccctgacagcatttgaaccgggacaaaagatgatctttagtccatctgcccgttaccctttttaaccgagactaaagatcatctttagtcccggtttttgttgcaaccgggactattgtggaattaggccgaccgacgaaagatggtttctccaccagtgatacgggataatattgctcatgtgtagaacttgcaaagctgcattattataccgactgaaatgaaacatagagaaatgaccgctagtagctactagctagtatcttagagcagttaatacatagaaaatcagctagcaaatacaagtgaataccatattgctataaggctgtgtttgcaggaggcagttaccaacccaaacactgggcacggaaaatagactgatccattaggacgtgattaattaactatttgttaaatttattttcaaaaatagattaatttaatttttttaagcaactttcgtatataaactttttgcaaaaaaacaccgtttaatagtttgaaaagcgtgtgcacggaaaacgaaggagaggggttgggaaaggaggcatccgaacacaccctaagtatgcaaatctaaatatatgttaacagttcttaccatcaaaactgagtctgcttattatttcaaaagataactactccctccgtctcagaatataagcttttcttagagttgtgcacggttattaagaaagtagttagaattactgaaaactgatctttgcccggatggcaaagatcacattagtcccggttcaaaatcccaatggcacattatgatctttcgttccggttggtaaacaccaaccgggactaaagatgatttttaatctcggatctaaatgttgtcaggcccccactatctttagcccgcacgcctcccctcgcccttatctccttggcacaccacacgcactgcacttctccctcccctcctctcctttccctctctgtcggctgaggtgatggcggggtgtccgcggcagcgggtaggaggcgcccgagatgaggcggcgaggggcgggtggtggcagcaccctcccctcagcaggatcctgcaggaggggcggaggcagttggcgcgcggcacatgaggggagagttagcgggcggtggcggcgccctccccttcgctggatccgacgggagggaggaggcaggcagcgagcaacggcagttggtgaatttttgtgaatttatttagatgtttttctgaatttgtgatgtcaatttgatccgtgatgttcattcgatctgttaatctttgatgtcaatttgatctgtgatgttcgttcgatctgtgaatttattatgtcaatttgagtatgttaattcaatctgtgaatttgtgatgttggagagttcatctcaaaagcaatatgcaaataggaaagaaaacaatgaaaaaaaggaaaaaacaccaaccaggactaaagatagatgttttgccctgattatttcaaccggggctaaagatgcccatctttagccctggattaggcgtcccggttgtatatgcggaactaaaggaggctgtgaaccggagctatatattattggccagaggaagtaatttattgcatgatgatcattgtcgaaacaatattttagcaataacaaaagggggtagcgcaggagacctaaaagtggggagataaggatttagacaggttcatgtcctctcgatgagaggtaataccctactcctgtttggggatttgaatttgccaggtgtgtattgatctgacgatctaaggtgctcatatgcccctagaggcctcctgcccaccttatataggatgggggcaggattacaagatagaaacattaaccaatacggcattggtttcctaaatctattatcaaaccaggactttaggccgttccgtaatatacgatgaaacgtaaaacccaagtcatgatccgttacatatttcatagatataagctatcccttatgactagtgctttaatcatcttcgccatggtctcccgagtacgtacttttatcaaatctgaagactgtggagggctgaaaaataattcaatgtaaacttaggtgcatcgactagatgcacctaataggtgtagccccccgactatgtggttagttgaacaaaccaagcatatagtcaaggagtaaataatccaaccaactgaatggtttttgatagttatagtcaaccaagtgacttgatattaatatatagcatatgcggtgtgaatccatgaataatatgatctgagtgatatatcgactgctttgtaaaatatgatgcgtacaacctaaagttgactacatcattgaaaattcacatagcaaaacagctataaagaatcttgtatgttatgaataaagtaatttccaaaacattgtgcacacaccatgcgcacactgctttaacagatgtacttaagtccctgaaagacacatggtttcaccatacctggaaatatagggcatacgtggttcaaaatccgagtaaactaactcataaaggatttaccaaccacctggaaaatgactgaaatatataatcagcctaagccataatattggtcaataaaaatgcacacttacatggcaaaaaacaacgacatttgtcacaccctaaaaatttaaaatatataaattgttgtttaaatggaattgttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaaatcggcccaaaaccgctctctctctcctcggcccagtccggcccagtccgcagccgcgcgcgcgcgttcggtcgctgacaggtgggtcccgcttgtcggatccatcgtcttcgtcgcgccgccgccgcccgaaaccctagccgagcgccgccgccgtctccttccaaaattcggtcgatcctttccttctctggccgaattgatagaggggaaacaatctccgggatctcctctaccttttcccctttggaaacatcggctaaatcggcttggaaagtgtttgcttcgaggtcaaatcggatcggcttttctctctccgagcccgatctttccttctcgtcgccagtcgccgtgggccttcgccgccgcctcctagcccctttaaaagcttccccggtgtctcctctacccgccgccaccctcgccttcgcctcttgtcgtcggaaacgccctagcgccgtgtgccctagcgccgccgtcgccgccgtcgctccagccgtgcaccgccgtcgttcccgtcatcgccgtcgctcgggaagaccgccgtcgtggtcgccaagtcaccgccgtcctcgtccgccccttcgccgccgccgaagaccgccggagcaccgtcgccgccgtcgacccgatcttttccggcgcttcctcctcgtcgccgtcgccatccgttggtcttccgccgctcctttggtcaccggtgagttcgccgcgtcgcgctctacccgttggtgccctccgttcgtgccgaagcgccgccgttcgccggcgagtgtgcgccgtccgagccgccgagccgccgccgccggtggtgacgtcatcgccgacgtcatcgtggccgtctgccgtgagccgccgtggatccgatcgatctcggccgtccgttttggatcaagtcgatctcggccgtccgttcgcgtgaaccgccgccgtgcgcccggtccaccgcaaaccctagcccgctgacgcaataatcctcctttttcttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgtttttgctcttttctgtttagattccgtcgttttctcccggagaagaatttgaagagttccaaggccagcaaggcaagtcacacagatcccaaacaaccctttgagcatgttgatcctatttaaagctattgtttctattcaactattgcatttattttcgaatgtcattgggtggaattaacctattgtttgttatagcccttttgttcttgattactttattccttgataccttgggttattataacttgactagttgagctttatattggttcaactagatattagatataattgcttagccctgcttagaaacattagctcactattgggataacttatgactcactgttatttaataatggcttaatgatagttcacgatggtcaatcgtgattggttaattaattaatgtgccaactaaaaactgataatggtgggttgtgagcacatggttttgttggtcgtgctcatgacaattaaggaccggttcacgagtttcggttgtgaaacattaaccgtgccagccacaagccagcatgggcaacgtctttatcttttgtatagcatggttcattgcggggcaccagactgagaagtggcggagataagcccacgggggacgctggggagtcaatgccttgtttataagagggtgattatgatccaggaatggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtcttttgtgattagtctcacccttctcaccatagtaaatgatgctttaactggtaataatttgattagctcctggtttggaatggtatattcctggtttggagatagaactgtgcagccgggatggttgttcacaatggttgggcctatgcaacagggtatgttgtatagcgttggattaatattgtttaattacttaacagttttattaaattctcaaatgtttgctaaatgctgcttttgcaaatgaaaccctactatgccattctttgttatcctgtgcacttgcatatttgctgcgtggcttgctgagtatgtcatatactcaccttgcaatcattcatcagaggaagagttctacagtgaagttgatggtgtggaggattaggtgtagccttggtcaagctgcctgtggagtggagccgtctgcgccgtttatcttattttccgctgcttagatcttcattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccaggcgtgacaagttggtatcagagcctccttgaccctaggttatgccaaatggttacccttagaagccctctaaaagtattggaaaagtagaactgttctcctccctttctcttttaattaaaccaaactaatggcacatgcacttcataattttttttagtggttctcattcaaaaatttattccagtgttattagtactgtacatctattactgtactaatggctcatattccagcaaaagttttacaatgtttttttatttaatcctaatgtaattaaataaatttagcaagttgattttataactttcttttatttcttttgaaacctgttgttcaaaagtacaaaatttgtaacctggtttccaactgtttcaacttatcttgcaagcttggtttactttatttacttacctttttactttgattttctaaactttattcaaattaatcccaaaaacttgtgctattaattggataaatgtcttaactccctcctttcacttgtctttagatgccgcgctacaagcctgagtacttgtttggtgttgagggttttgtccaggagttgcgtacgatgtcctttgtcattggatttgggactgcccctttttatgcccagattcctcatgatcgtcatgaatagaagtgccgagtcaaagtcaccttgaacagtaatagtgaagatattccatcagtgatgttcgaagctggaggaagaaactacatccatgcatgtcaggaggtggcaaggatcaccataggagagctccgtgatcgctatagtgatcagttggccgacactgagtatcgctaccatcctcgccaaccccagggaagtgaccgtggcagttaccttgagactgaaggaattgagaatgatgctaccacgaggcatttggttgagatgctgtgggctatggatgaaagccgtgcggagactgtgttagcggctcaagatcgtgaagaccggaatcgtggtaagatttgcaagttagaagacaaggtggatcgtttggagaaggaactagctgcgttgaagggagaagcaccgccgcagaaggccaggattcgtcttaccgcaaggaagagagctctatttgtccctcgctatcaattggcgccaaaggtccgtgtggtggagaaagaagttgccccaaccctagcggatcctccggtcattatcataagtgatgatgatgaagaagaagaatccaagcgcacccattccaagattgagtgggtatctacccaagatgatgaagacgagccgaacgagccttcaatcgacctccgatgctcggaagaactagagtgactggttaagtcgttgtcttagatcgttgtgttagtttgcttgttttaagtttggttgtgtgtgcctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaggtaattccctgtcctaagtagtttcccccggtttctcttcttgtgccctgtccatgccagatggtgaacactcgcagcaacgggaatggccccaacaaccccaataacaacaacaatgaagggaacccaacccttgctcaagttcttgctcaacagactcagttaatgaacatgatgatgcagcaacttcagaaccagcagaaccagggaaataactatgcacctccccagaacaagttagcagaatttcttcgtgtaaggccgcctattttctctagtaccactaatcctgtcgaagctggtgattggctgcatgccatagagaagaagttggatttgcttcaatgcactgatcaggagaaggtctcatttgcatcacaccagttacatggccctgcctctgaatggtgggatcacttccgcctgaataggactactgctgaacctatcacttggcttgaattcaccgctgcttttcggaagacgcatataccatcgggagtggtgtctctcaagaagaaggaattcaggtcgctcacccagggatctcgctctgttacggagtatctgcacgagttcaatcgtctggctcgttatgctccggaagatgtgcgcaatgatgaagagcgtcaggagaagttcttggaaggacttaatgatgagctttcttacccactcatgactggagattattctgatttccagaagttagtggataaggctattcgtcaggaagacaagtacaaccgcatggagcagaagaaacgccggattgctcaattcaagacacaacaggggaataatcagaagccgcgtcttactttaggaccccagtccatgccacagggaggtttttcatctgttgttcgtccgcagcgtcagttcttcaacaacaatgctggcaacaacatccgcaatcaagctccacgtcctgttgcagctccagcacagcaacaacctgccaagagggagcaaggcagcaagcccgtggtgtgtttcaactgtggagacccaggacattacactgacaagtgtccgaagccccgacgcgtgaaggttgtccctgcccagagcaactctactgtaccagcatcaaaggcccgtgtcaatcatgtcgctgctgcagaagctcaagatgctccagatgtgatttttggtacgtttcttgttaacttagttcctgcaacagtgcttttcgattctggtgctacacattcattcttatctatgagttttgcgggaaatcatgggatggaagtagaagatcttagacgtcctttaatggttagtaccccaagtaatcaagcactctctctgcaacgtagcccctctgtcagaatagaaattaaaggagtaccatttctggccaatcttatcttgttagaatccaaagaccttgatgtcatcctagggatggactggttagccagacataaaggtgtgatagactgtgccaacagaaaagtaactctcaccagcaatgatggacgagttgtaactgttcatgcattgtcttctgagtctttaaggtcaagactgaaccagataactttggaagagattcctatagtccgggagtatcccgatgtgtttccagatgatttacctggtatgccgcccaaaagggatatagagttcagaatagatttggtacctggaacaactccgatccataagagaccttatagaatggcagccaatgagttggcagaagttaagaggcaagtagacgatttgcttcagaaaggatacatcagaccgagttcatcaccatggggagctccggttatttttgtggaaaagaaagatcatacccagaggatgtgtgtggactatcgtgccctaaatgatgtgactatcaagaataaatatccactacccagaattgatgatttgtttgatcagcttaaaggtgccactgttttctctaagatcgatcttcgatcagggtatcaccagttgagaatcaaagaggaagatatacctaagacagcttttaccactaggtatgggttgttcgaatgtactgttatgtcttttggacttaccaatgcccccactttcttcatgaacttgatgaataaggtgtttatggaatacctagacaagttcgtggtggtctttattgatgatattcttatctactcccgaaccaaagaagagcatgaagaacatcttcgccttgcactagaaaagttacgagaacatcaactgtatgctaagtttagcaagtgtgaattttggttgtctgaagtgaagttccttggtcacgtcatctcagcgggaggagttgccgtcgatcctagtaatgtggaatccgtaaccaactggaaacaaccaaagacagtttcagagattcgcagtttcttaggcctcgcaggatattatcggaggtttatagagaatttttccaagattgctaagcccatgacacgactgcttcagaaagatgtgaagtacaagtggtcggaagaatgtgagcagggttttcaagagttgaagaatcgcttgatatcagctcctattttgattttgtccgatccaaagaagggttttcaagtgtattgcgatgcatccaaacttgggttaggttgtgttctgatgcaagatgagaaggtggttgcctatgcatctcgtcagtgacatccgcatgagaagaactaccctactcatgattttgaattagctgcagtagttcatgcgttgaagatttggcgtcattatcttttcggtactcgtacagaggtgtacaccgatcacaagagtttaaagtatatctttactcagccggatctgaacatgagacaaaggagatggttggaattaattaaggattatgacatgggaattcattatcacccggaaaaggctaatgttgtagcagacgctcttagcagaaaaggctattgcaatgttacggaaggacgacagttgcctttggagttatgcaaggaatttgaaagattaaatttgggaattgtcagtagaggtttcgttgcagccttagaagcgaagcccactctaattgatcaagttagagaagcccaaattaatgatcctgatattcaagaaatcaagaagaatatgagaagaggaaaagctatcggtttcttggaggatgagcaaggaactgtatggttgggcgagagaatctgtgtccccgacaacaaagatttaaaagatgcaattctgaaagaagctcatgatactttatactccattcaccctggtagtactaagatgtactaggatctcaaggaaagattttggtgggcaagtatgaagcgtgaaatcgcagagtacgtagcagtatgtgatgtttgtcagcgagtcaaggcagaacatcagaaacctgccggtttgttgcagcctttgaagattcctgaatggaaatgggaagaaatcggcatggattttatcactggtctacccagaacgtcatcaggccatgactctatttgggtgatagtcgacagacttaccaaagtggcccattttattccgataaaaacaacctattccggaagtcggttggcggaattgtatatggccaggattgtatgtttgcatggcgtccctaagaaaatagtgtctgatcgaggcagtcagtttacttcaaatttttggaagaagcttcaggaagagatgggttctaagctgaactttagtactgcttatcatccgcaaacagatggacaaactgaaagggtgaatcagattttggaagacatgttgagagcttgtgctttagatttcggtggaagttgggataagaatctaccttatgcagaattttcatacaacaacagttatcaatctagtcttcagatggctccttacgaagcactgtatggtcggaagtgccgcactccgcttctgtgggatcaaacgggagaacgtcaggttttcgggacggatatcctaagggaagtagaagaaaaggtgaaaatcattcaagaaagattgcg

SEQ ID NO: 59436 - DNA, 1933 bp, Oryza sativa
agggttttcctccaaaaaaatcctccctccgtcaccgcccgttctttcccgtttgccacgtcagcttgccgccctagaggtgggtggcaggggctatttctgcaattttttttggtcgatagattatttctgtaaatattaaaaaaaaatctaaaaccgaaaaaaattcgtctacaggccagtacagttatgtttttctttttactcttcttcagacgatcgatagattaacctgtgcaaatcgattcccacgtgcacaacttgcaaacgagttttcacttctcggtttctgcatgaacacgtctggtcgcctcaccgctgcttatcctctgcctgattatgcaagagatttgggcatttttctgacgttgttgcacgttgttgcgcgccgcgagctagctgttctcctctcggcgtgagggccacgtgaaaactcagccgcggcacggcacaaaaccgagcggaatgttgttcaccgtcgcgttggccacagaccatgccaaggtgtacacgtatacgcatgcatatggatggatggatcgatcagattcagagatcgagatcgcctgcgttctgcgagatggtggggagggtggtgaaaaggccgggggggctgaaacgaagggaaagaatgacaatacaggcttgcagcagagataaggatacctactgtggataaatacacagaatatacacgtcgacgtgaccggacatccgtcgcctcttcttgctctccctagcgtgggccccactgccctcgtagctacagttccgcgccggcgcaccgcctcgatctcatctcccctcacttcggctccaggcccaagcggccaagcccaagcgcggtgatcttctgcgattactgtgcatgttgcattgcgcgaaaaggaaacagctgcctgggatcgcatgcttgggtagcataggaccgcataatcttttgaaaaaaataacagccaatttttttatttaaaacttatttttgaagttggttttaaggtgtttttaccatagtttattttcacttacagtattggttttcaagttgctagaaatatatatatgtacataaattttatacacaaattacattttattactaataagccgttatggcttaatcaaattttagtctactgataggacagatattagcactagcccattttacattatatgtcttgaggaaatctttgagactggggtttaaagcacttttagacttgttcatgaaatttagttacatgaaaaagcttagccaacacggacttgtttacgaaattatttgagagcataaataaataaaatacatagtcttataggaaatgcttatatatacgagtacggagtatgcaacaacttcctttaaaaaaaaaacagaatcgctccggagacctcaacaatatcacagtaacaaaagaaagattagagaatatctataactaatataaatattcgtattttttcgatcgtcacatctaattttcgtccgtttttcgtccatacaaaatccgattcggttagcaatagccaaggaaaaaattgcaaaaaaaaagaatcggcggccgccgacgccactgccaccgccggagggagaagagaggcggcggagggagcgccgatgccggatccgcccgcggtggccgccaccgccaacggatccaccctcggacgaagccgacgccgtcgtcgccgccgttgagaaggcgccatcgccgtcgaggtcgacggggagagggagagggatccatccgcggccaccgccgacgccgccaccacccgccgccggatccatcgccgccggatctaggtcgggagggagacgagaggggaggagggagccgccgccggcggcggcctgcgaccgccgccaccgccaacggacccacccgccgacgccaccgacaccgccatcaccgccggatctagggca

SEQ ID NO: 59437 - DNA, 3289 bp, Oryza sativa
ccaaacaacacttggctggctgtggcggccctgtttagtctaaagggaattggtatgtttagacgctaatttaaaatattaaacataaattaattataaaatctattttataatttagactaatccgtgatataaatctagtgagactaattaatttataattaggctatgtgatgctaccgtcaatatttactaattatgaattaattaggtttaaaaaattcgtctcacggattagctcttactctccgtcccataatataagggattttgagtttttgcttgcactgtttgatcactggtcttattcaaaaaaattgtgcaaatataaaaaacgaaaagttgtgcttaaagtactttgaataataaagtaagtcaaaaaaaataaataataatttcacatttttttgaataagacgagtggtcaaacagcgcgagcaaacactcaaaatctcttatattatgggacggagggagtatttattagtctatgtttaatacttcaaaattagtgtctacgtacacattcgatgtgacatgtactaaaatccagacaccccccgctttgcttccactagctggagttatatatactgtagtagtgatttattttaacccaaacgcattttccaagtttccaaccaggggttttagagcatgtgactgagagcaaatagccaggagtacaataaaataataatataagaatgttacatatactgtcacattaattttgtaccgagagtgagataaaaaaaaagctacacatatatgtatatccagttggaacatgggctctaataaaccccatgatagaaagatgtggtgtaattatatatctagctattataggatgaactactaaattgaccatagataatactctcagtcaattattgctataacggttttacctaagttaacccaataaatatttcaccaccgccaatatatgtaagaaaaggtgcaagaaaaaatgtcaagacaccaaacaattgcaatctaggtagtataaaatttcatggtctgcaaggtctaacaatgattccattttataattatacattaaatatatgaagtaaatttaagacatgaatttatatatgttccatacatataaacttgatattaaaatatattggtttctcactacaaattctagcaaacatcaggtaaaattaattagcgaacgtacgacatatcgactatacagaggtctctaaattaaaaagatatgaaggggagatgaggattgacattttatgtactccatttgctacacgatggccattaaaatctagggcgagaaggaattgatcaattagctgactagtaccattgcaatggtagttacaagcaattatacatacatacatacatacatacatacatacatacatacatacatacatacatacatacatacatacatacatacatacatacatacatacatacatacatacatacatacatacatacatacatacatacatacatatatacatatatatatatatatatatatatatatatatatatatatatatatatatatatatattacaatttcaattcagtattactgtgaattaaataatttagaaatatggaactactacgtactgaatgtctagttatagattatttaaaatatgtgttaactagtactccctccgtcttaaaatataaaagcatcattagttatactatacgtacattagtttcatataaacatatcatatacattaatacttggctcatctctcatacgcaaacactatctcgtagcacgttccgaatctatctttcttctccacgtttatttgtagctgatttattatctgaattgtattgtacttgctctatgaggataataattgagtactccataagcttatgtgtgacaaagattaaaaaaattatgagtgttggctttgctgttagagttagctatacatatacttgaaaatattacactgaatttatagtgagagagaaaaaataaaaccaagtttatagctaacttattatacatattagtatgttaatagtaatttagttatactaaactttttctaagccgaaccagatttggatagtcaataaatgaggcacacctacacgttcacacggtcaatgaaactgggacccactgacatggtgccctgagcaaaggtagtgagtgctgcaagggtcccatggctcagtccctgacaggtgcgcgtccagtaaaccccaaaccctcccggcgttcaactcaccgtgcggagaaggattttctacgccgagatgccatgttgactatcatttcatacttaaatagttatagaaaaaaatttagtaacatcgattgtaatgatataattctacacataaatatgtaggactaaatttgatctacaactagagagataaaactaataaaatcagatagtgagtagtacccctataacgtagataaaatttgttatttttgtttcttcatatgtcgatgaatttagacttgtaggtttgtatagtgtcttattatagtctatcttattaagttttatgaaaattttatataactgtttaaattacatgcatatatctaggtgacatggtatctacactccatctgaaaaaacgaatctacgactagatatgatatcttttagtataataaatatgaacataggtatatctaaattatagtactataatatatcactagattgattttttatgggggataagagagtgtaaaatactttcggtgtccctcaccgtgcccctctctcggcctgcaggaccgtggacgtacggatacagtcaacgccatggaccaccaggtcattggctccgatcgtcctacgtggcaggctacagccactgccacctcctcaacttctcctcttcctcctcgtaacctgcgccctcccgcgatctctctctctctcctcttttattggccttttcgcgcgctttttttcttccccctctcgagatttttttttgccgtcgcagtcgtggcctcgtcccgcacacggatcacccttttgcatggccggatcacccttctaaccggataatagcatgctccctgctactatctctatgactcaaactgtttctctctctacgccgtcgcggtggccattgacgggcacgtactacgtccgtaactccgtcgtccacccggccaccagcccaccacccaccgggggggctgaggtgtggggcccaatttcacgtggctcccgcgtggtgcgtgatcgtatgcgttgcatgcatggaaggagccaaa

SEQ ID NO: 59438 - DNA, 3517 bp, Oryza sativa
cttcttggtcatgcgttcgtttgttacattaattacaacttacaacactccaaatttcgagtctgtgtgatgactgatactagatttgaagagatctcccaaatctttttctcaaactgtcctcgtcggagtactccagtatataagcatttctttatggttgaaggatgaggtagcacgaagaatacgcatattatgggataaattacggattattattagtactttggaatggagtacttgattatctttttggaggattttagcttccgtcctgaaataggagtttgacgtgaattagatgagatatagtaacaggttgaaatggtgttgattgataaattaaatgatagataaatgggatgatgaggtcggtaaaaaaattgatatatttatggataagttttaaacgctaaaaatactatatttttggatgtgtgagtagtattttttacaactgttctgcgtgaaatttaatgtcgtctttaggaattttagtggaaattagtcctacgcaaaatttcttacgtggtcatttggatcgagatgggaaatcatatgagtttcttttggcttggcgttcacagggtttttgaatgaattttaacatgagatgcatgcaattgcttgaataaaatatttgtgattcctgattttttccctacgccctttctaaactatatttgattcaatccatgcatacgttttgggatgataggtactataattcctgtaattttcctattctgtgtctcaaaaatacttctttctgatgaagcagttcttacctaatttgcacgtcccctctttgatgtattcaagtaaaatcgaaggtttttaggtttcatttacaaccgaggaattttatgggaatactacaggaactgaactgatcaacgagaaaattatgaaaattcctctattccaaagacccttgaaataaatcatttacctctcaaacaaccagtaaaaattgcttaaaagagccaacgaaaaattaaaggagagatgaattcagtatctgtgtgacaacatgacagcgagaaattgtgaatacgggacaacatcaaaaccggatgagatgtttttaaatactacggttgcatatctaggtttataggactgtggttgcatgtccatgttcggaggactatcaaatgtttcatccagttctattttttttatatttagaaatatattatatgggcgtgagaatatttttaataggtcttaattttggtgtctatatatcctgatgattttcgtccacttatctctactactaaaggagggagtagtccacgtaaaaatcttataataatcggttgctctaaaaactgtttacttgaaaaagaaaagatcggtgcaaaaccaaatagcccaatctgcttaaatcgtttttaccaaattgaattaaaagccattgtaatgcacaatagcccaatcaacttaaatccttttaccaaactgaattaaaagccattgtaatgcacggtcctgtaaactttaaacatgtatcctgaggacgaactcacaaatatttctttcttctcgcaaaattttcaagctactagtataatctatgttgaatcacatcgtattatatgttgctatattctgaaatggaaggacttatagaccccttttattcaaaggaaattcataggaagtttagagcattttatttctataggaatttttcatgtatagccatttgaatcaaaggaaggaatggattttatagaatcctatgaaatttttatcaaatttttatagaatgtctgataccatgtaagttttagaggaattctaatatgagttagaacctcatggaaactttcctttgagtcttatctctcctctaatgcctacgttttttctatggtcaaatcaaccggttattgctgtgttttttctatattttgcaattctctaatttacatttacatttctattaaaatcctatgtttttttatattcccatattttttaaggtgcccttagtattgccaaattctgacgatagactaaacaagtcctagatgtgatgaatgatatcaattcaatttctcagggaggatggagcactggtcgtgtaataaccggccaatgtatctcgctccgtttacctgggacaacgccagaggcaccacgtgtagcggccgtgcgtactcgcgctatatttcatgtgtcgttactctccccttttcgtgcacggccgagctcaggtggctgcggtgcggggccatcatcccctccctggcctcgcatcgcgaccagcaaccctcccctgacacagcgccgagccgctttaacggccaggcccgtagtcgtagccagccacccagccacggcagcaaacgcacagcggcagctagctagcgctcgcacgccaactcatggccggcttgcatgccccacgacacaaacacacagcagcaacgccaccatctcccgcggcgaaacggaaaccgagccagccacagcccaacccggccggctaccacccgtgtgggctcgtgtcggtcctagtgctttgctttgacccgcgcgtgttctctctcgcaaaccataccgtaggataggaatacgtgcgaagccattttactagtcgtagtactaatgtgtgtgtgtgtgcatgcatgcgctgcgtgcgtgcgtgcgtgggatcgtacggcagatgatagatagattagcctgagccactggcgcgtggtcccccggagtagtggaggggtgcaaaacggctttgccgattcttgtttacacaggtgtgtgtgcgtgtcgtctcggtgatcgatgccacagctgcagcagtgccgagtcgcgatcgtgcagaaggcgaccttcctaaaactaatcgttttttttactggcgctaatgacacaaaaccgatgcactgcactcgtgcgtgcaggcacttcgatttgctttgctactgcaaactactcgtggctttagtaatttgggaggtgaggttagtttatgcagggtcagggtcgtttccagcaggtaggattttgtgcttcgccaaggtgaggtcgacgacgacgacaaggtgagttgcgccggcacacgtcccggtgccgaagtgagatgcactagcacgatcggatggctgaccgggtgcccaaacctgcgatttgcgggcgctttcgggttcaccgaggcagcgcattagtttgcgtgttccgaggcgcctgcgttgcgacccgaaacagtgggggtgctttggcgatccatcgcatcgcatgcaccaacatttggtggcttgtgttggctgctcgttgattgcaaaactgccaagatattaacgctactcgactgtttttttcttcctggggttaagaggtcaggagtactactactagagattgacagggaattgcttgctccgtatgcgtgtgtttgtgcgtggggccgcgggagggggggagtttgtacagccgaccgagacaggagaagcgttgataaatttttgaatatgttggtggtgcgatcaatctaccgagacac

SEQ ID NO: 59439 - DNA, 5708 bp, Oryza sativa
  unsure (1)..(5708): unsure at all n locations
aggggggcgccgccgccgtcgctttagagaggggatcgggggcgccggtcgctgctccgcgccgccgcagccgctcgaggaaggaggggggcgccgccgccgtcgtcgctcgggaggggggaaatgaatcctagggttagggttagggtttgggtgtatttatttaggttaggattaatctggaccgtccattcgatccgacggctgtagctgctcccacgtcgggccgccggcctattgggccaccgaatggaggacgtaaaatagacttcaatggagaagaaaaccggccagacacatagaataaaagggagggaatataaacttttctatattcggcccaatcatagaaaggaggattttgattttttttccaattaaataattgttaaatgcttttttattattaaaaattagcaattaagctatgataattccaatagaattccaaagagcgtagctaatcatggaaaatttaataaaattaaatttaaccatgtcattttatttttcacaattgctttacttgtaaattgatttaattatacacctacctatttaaaaataccaaatattttaattaattacataatgtaaagttttcttaactttttctcaattttttttctgtacacttcctgttgcaacgcacgggcacctttgcttattttaattaattacataatgtaaatttttctttaactttttctcaatttttttttctgtacacttcccgttgcaacgcacgaacacctttgctagtgtatatatatatatatatatatatatatatatatatatacatcgtgggtaagtcaaaattacaacccgtcaacatatacacacatatattgacggggttgtaattttacctcgtttgcggcccaacttcgtcaacatatatacacacagcacaaaacattggcactttgttatgggggtacaacattaattaatattgtctcagcaacgtttcagcttttggcccattaataaattaggagcaatattgtaaaaaaagttatatttagttttcattcaactcaattatattcctacttaaaaaatgcacaagttttttctaacggatggagtatactctttatattataaagacaggtgaagaaaataagtaccaagttagttttagaggaccatttattttagaaagtttctttcattccttatttacaatgtaactagcatggtgacccgcgcagattgcccggctagcatcattatattttctttcatataatagtatatatgttttctcattatattatttaaatatattaaaatgacaacataattttaaattttgcaataactttacaaaactactaatgtgtaatattcatattatattttatatacatgttagttattagtttttttaatatcaaattttagttatttgtaaattatatatattcctatatagactctagactcttcttttaatatttttttttaattctgaattttctgtaaattgtatttctatatagactatgcacttcttccaatattatttatttttatttctgaatttttattatttctagttgtacttctatgtggactctaaactcatctttcaatactctttaatttttaatttcaaatttcagttacttctaaattgtattcctatatttgtatttctatattgaccttaaactcttcttcccatgtttttcttaatttcgaattttagttatttgtaaattgtatttttatacggactctaaactctacttttaattttattatgtttattctaaattccagttagttttaaattcctatatgaactatatactctacttctaatatttcttatttttcttaattccgaatttctattttttttcttaattgtatttctatatgtactctatactctacttctaatattccttatttttaattctaaatttatattatttcctaattgtatttctatatggactatatactctacttctaatattccttatttttaattctgaatttcagttatttcctaattgtatttctatatggactctagtctcctcttctaatattccttattttttaattctgaatttcagttatttcctaattgtatttctatatggactctagtctcctcttctaatattccttatttttttaattctgaatttcagttatttcctaattgtatttctatatagactctagtctcctcttctaatattctttattttttaattccgaattttagttatttcctaattgtatttctatatggactatatactctacttctaatattccttatttttaatcccaaatttatattattttctaattgtatttctatatgtactctatactctacttctaatattacttatttttaattccgaatttcagttatttcctaattgtatttctatatgaattctatactctacttctaatattccttatttttaattccgaattttagctatttctaaattgtatttctatatggactctgctttttctttttctccgattaatatgagaatttctagtccatgagagcgaacgtggaggctcctttttctattcctttaataataattgtatttctatatgaattctatactctacttctaatattccttatttttaattccgaattttagctatttctaaattgtatttctatatggactctactttttctttttctccgattaatgtgagaatttctagtccatgagagcgaacgtggaggctcctttttctattcctttaataatataatagatggtacggtagttgaaaactataattacgtaattaagagttcgctaaaataaatcccatgttgtagaggtcaggataattatattgtattagaccattcccaacccaaaacactagacatagtttccataaactccacatcatcaagaaactagtactagacattactcttccaatgcaaacaccactattccatacttaaatttaatgctatttatatcacatgatgtcttggatgttgtgtagaaactatatctcatgcaagacatgatttccttctctttcctcatttatttacttgccacatcatttttcatcctaggtgacaacttatttaatgctatggacactatcctagtcattgggttgggaatggccttactccctccattccaaaatagcacaactactcttaacccaaaaaacaaaaaataattattatcatattatagtttgaatgatcctaataaatataatgcatatatccaatatgattagataacatgagagtgaaggatttaaaaataataataatttaatggagaagatgccatagttaattgtatacttgcatgcatgccttatattatggaacatctaagaaaattggttgtgctttatattatgcaatggagggagtgtcttaaaaaatatactccagtttgtaattctaacatattaccatgttaattggataaaaattatatatgttagatggtggtggattgaaattataatggttgatataattatattcgaaacacaaatagcatatgtggagattgaagctataagatgtatttcaaatagaatcctacttaaatctactgtatgcaaatgtatctttggaaaaagctacgaattacattaagaaaatgtattttctaatatacactttctctatcgtaaaatatagctatctatagcatttaaaaattatcataaaatataacaacttctataccaatcacaaccttcgacattcaaattctccacctagtccttcttaaccaaacatttcttttctcatttaattttatctacttttttaatcccttatatccaaacttaaaactttctatttagaatggaggtaattctgtatatagattaccaaaaggtacaagagctaagaatcgtgcatcaaattcacttcggaaaattacataagaaaaacatttgctagtttgttctacataaatctcgagaattttcacaacggaacacgaagctaggagaatttcacattttataaaacttttataaaatgattaaaaaatattgaaaaataaattaaaaaaatctaaagtcaacttcaaattaaaaaattaaaattaaaattttggctaataaacatagcaaaagccgaaagatgagactgaaagctacccagatcaaacagttctatcgctatagaggatccgagcaaaaaacagggccggccggccggcagaagaacacaccacaccactccccagtccccagcccacccccacccccccccctcgtggcactgtagccagtgtactatactgccctgcccttcaccactttcacctccctcctcgagtcttctcctctcgtctccccctctccctctcctctccgccaccacgccaccgtgcttccctcccctttgttcctgtagcgttccgaataaaagcccacctgctttcctttcccgcgaccattaccataaaaagagcttgctcccaccgcctctctctctatctccccgtcgctagctaccagcagcaacaagtacactccccccactcctcccccacacgccgcgtacaactagctaatcagaggagagggagagagagaggggtggggttttgatggaagtacaattctagctatgttcttgatcggggccatgatcgcggatctctagaaagttctagatcttccgtgcgtggtggccgggtgggggtgttcttggtagggtaggtaagtgctgcttcaatggatgaaggaggtgggagtggcgtgggtggnatgcagggaacggcgtcgaatcttctggacgccggagctcaggcgttctaccctgccgtcggcgcgccgttcccgttccagcagcttccgcaccagctgtactgcccgcagccgccgccgccgccgtaccaggtcatgccggtgccgccgccgccgccgccggtgggcttgcctgtaccgccgctgccggcgacgatggcgccgcagccgggctactgcgtgccgccgtccacgacggtggtggacggtccggccagccgcgccgtcgtgctgagcctggtgccgccgcacgcgccggaggacgagatcgcccgcgcgatggctccgttcggtgcggtgcgcgccgtgaacgcgtcgccggtggcgtcagagggcgtcgcgaccgtcaacttcttcgatctccgctccgcaaagcacgccgtcacgggggtccgcgagcagcacatccgtcagcagtgccggctcggccagctatacgccgccgccgccgcagcacaccgctttgtctccgacctggcccccgccggcgtgggactggccccacgacgacaaccgcgggctcgtcctcggccaggccgtctgggcccaattcgccgccgcctccacagtcccagacgacggcgccagccgcggctccctcgtcgtgctcaattccctccccgccatgtccgtgttcgaactccgcgaaatcttccaagcatacggtacatacaccacccccgcacgctttcttccgcgaattcctccatgtttcgcttcttgtgtttccaaccaattcattctcttggtcgggtcgcctcgtcgtgtgtttgcaggtgacgtgaaggacgtgagggagtcggagcaaaaaccgagcaacaagttcgtcgagttattcgacacgcgcgacgccgaccgcgcgctccacgagctca

SEQ ID NO: 59440 - DNA, 1104 bp, Oryza sativa
aattagatctatcattgagcatgtgatatcaatataaataagagtatgaaattcctatagagtttttattggacaattatatttcatttgaagaaaaaaaatcatgtaatatattttctacagaaaaattttaggcttcgaataacataagattgtgaacaggtgatgatagccaatcatctagcaaaaccggtatgtgtaataagtccaaatactccctccgttctcgaataattgacattggcactattcaaatttcaactttgatcagttgtattttttgtgttaaatttatataacacttgaaaacatattatattatcgaagtgtgtagcatcataaatataaccatacatttctatttttatcataatataatcacctaaaagtaatccatggtcaaagtgagacggatgtaatcagcagtctcaattatttgaggacggaaggagaacagagggggtatttaaacagacttagcacagcagattagcaatccaaacagtactgatcagattcttgggcacttttgcttgtcttgtttaggcaaatcacccatacagatcaagagccgagacacagcaccatattagtaactcaacggctcggtgctcacccatctccagaaccagaaaagactcacaaccaatccatttcctaacaggtgtaagtctgacacagaacaccatcgagaatagcaggtttaccgagtgggtgaaacttgaaaaaggtgtaccatttctaacctagaataaaccatcagaaataagatggtcaataaaatagcctagaaccttttttgtcctcttgtttcaaggcggaaattagatagtctccaagttgcagttgttaaatctaagtaaaccaaagctacatatgcttccacaaattacgagagcacggaagtaacgaatcccccaactcctccgggatctctttttttctccccaaaaaaggagtagacccctctcccgaatctaatcaaatataggtactattcgcagtccacctccacccacaggaataaaagaaaagggaaagatcttagtagaaaacatccaagagcataacaataataagctactaataaaaggaatagtaaca

SEQ ID NO: 59441 - DNA, 3743 bp, Oryza sativa
cgtcgccggtggacgtgcgcgtgccgtcacccttgccatggccggccgccggctttgtgccgagccgagccgagccaggccgtcgccgcaccgtccaatcgcccccgggccgatccgggccgtcgatcccgtggaccggtgttggaccatccgcgtggtcccggtccacggtagaccgaccacccgtgcgccgctgccgtgtgggccccgcttgccagcgccgcgcccccccccctttgatgacgtcagccccgggacatattgcgcaataaatgatttaaggactttttgttatagtaataaacacagtgaatcttctaaaattcataactaattcattcgtgctccgtttaagccctttcaagtctcagtaaatcaagaaaaatgtgtagaatccattaaaaatggttttgttccctgtttcagtagtcttatagcctgtttgcaatgttagccttgtatgtcgctagattccggttcttccgacgctccggtgtacttcgaaatagtcgccgaggttcctccagcagcagagcaaggcaagtcatgcttgtcacttgaacatgttgatcctatattgcaaatgctctattgtttttcttcaaatatcgcattgatttataatgttactatggggtgtttacctattgtcatagccatgctattgttataccatgtccctttgtcagcttggggttataacatgactagagattggactaggggttgcttagccatgcttagttcaactagtgcacagcggggaaaatccaattaatgtttagactgttggttctaatggttttgttggtttcgttccaccgctttggtgttggctaattaaaataaatcacatggtgggctgtgggtgcatggttttgctggtcgcacccatggcagttaaggaccggttcacgggatgccctagaagatcttatcgtacttaccacaagccagcgtgggcaacggctgggcttgtactgtagcttttctctagccgacgcatccaggcaagggtgggcgtgatggagtttggatgggccctgcgacggcctatgtcgcttccggattcacctaggcacgagaggggactgcccgctgccttgcgaggagtgggagtgaaacctaaggtgtggtgtgcttggttagagggggttatgcgaagggtcctgtcacggactctttccggtatgtcgtggtggcatgtcagcacacggaaacgtgtcgtggggctgtgtcttgtgggtacagttgtacacctctaatcagagtaaaactattcgaatagccgtgcccgcggttatgggcggtcaaccagattcaccgtgattagtctcaccctagtttagtctattgaatttggatagtataggtggatggttgggcctgttgcaacgtgggatagcgttggacagtggatagttaatattaattaattattacaactgtttaaatctttcaacttctgtttataaatgctcgctttatgcaaatgaaccactctagctctcctttgataattccctgcatcatacccctattccggtatgacttgctgagtacagtgggtagtactcagtcttgctctatttttcccaaccccagagtatgagtatgtgtcaaatggaggtttctccgaggagtaggcttcgtccgtgccgtcgaggatgcctgtggagtggtgttcccgctgcagttctagtcaaggcttagctcctgttgtctttcgtttttccgctgcatttttgtaagacttttatgatgtttgtaagacgtggatctgaatgtcaacattgtcgtttgtgtaccccggccggtcctggacggggattttaatgcacattctgcttggaattatattcgggaatttctgggcgtgacaatgttgatcaggcggtatccgaattgagtgatgccggagaaaaaacaccattggctttacccaagcaaactcctccaactcttgctgcccctgctcacttttcaagggtaaaccactcaccttgattccctcttacaatcatttattcatagccgatcacttataaatcttgcatttgcagaaaaagaagactgctgtgaagaagaaatcggcagcagcaccatccaagccagctccaccagtaatattttcttcatgaaattttcaagtctaatcataacccatgtggactaacacttgtcttttcagcctcctcctcctccttcacctcctatacagcaaatgtcaagtgaccgaactccatcggctataggaagtcataatattgaggaagaggaacaatcagccgctcctgccatcccagtaagtctttcattgtcttaacatcttatatcggctgaatctgtttgatcttcaactgtcttcaaatctctcctttgcatgtattaaccgatctattctcctttgacatcaaggattactttgatgaagaagcagaagaagaaaccacaagtaaggctctagcccctctcgatgaaactgtcaagaaaacacttgaagatatatcccttcggctagagtcatcattagataacctggtggccgactgtagttcgatccgggcacgatttatagaaatccaaccctaatcccacattatctagtgaacaccatcactccagcgatgtacgttgagcaacatcaattcaagctggaaaggcctaagcaacggatagccgatcggcgggagcggaaggacattgaagcaactatccaagccaatcggcagcttgtgcaagaagagtgtcacgtcctgataaattcatcccgaaataaaaatcattctctaaaaggaacaatagaattaattaaaattcgaaaagaaattgtcaaaccttaaaatgcgtacaagaaaaatttgaatgtggcccggagaattttcgttaaattctccttggtctaaaatgagccctcaaattttagttgaattttcagaacaccggaaataattattaagcaacaacaacaattatcaaagtttactaaaaagaaaaactaaaaataatccttcttcctcctttgggccaagtctggcccaaagtctccctctctccctcggcacgctgtcgaagtctctcttccctccctctcgttttcctttcccatctcactctcgggccgcccctccctcctctcctccccggcccactccctcctatcctcctcccgcctgggcctgccctggcccaacccgagccgcagccctcccgcgcacgcgcgccgcacgcgcgctgatcgcgtggaccggtgggtgccacccacccggtcgtcgtcctcctcccgcccgactcctccctctcccatgaaaccctatgcgtttcgtccttcaaatctgcgcgaatcaattcccttctttccaaattgattagggggaatgacccctttccttcctcttcaattccccctaatttcccccttgaatggcgccattagtcacccggaacggccgcgtgtcgcgaccgagaaaattgccttttcccgaacgctagtgtattaatccccgtcccaggaaaagccggggtacaccacacaaacatgatataaaagacacatctttattatatcgataatatttacattattacaaaggcgcttcaggcctgacaataaaaataaacagcagcggactagcgggcctacggctccatcttcacaggcgctcaactggggtataagccaggactccacctaagacttcttctccaaagcttctcttactgaagggggaaaagattgagca

SEQ ID NO: 59442 - DNA, 12385 bp, Oryza sativa
agcatctccgcgggggcgggggtgcctcctccctaaggtgaggccgccgctcggccggccagatcgcccgggcagccgcaggcagcggcagatcgggcggagggggaaagcgggagggggttgcttcgagcgccttcgagaaggtgggggaagagagaggagagagagagcagtaaatgccgccgtgttgggaatcgggaatggaaaacggaagagaagctgcagctgctggctgctgcgggacggagagggcaggtgtgcgatatatacggcatcgaggtggaggagacctgcccctgtgcagacggagtggggaaaaaaaggaatttatttttgctcttttcttttttttatctactaaaagattgtccagattcgttgtattagactatattagcttttttttatgccaacatatataaacttttttagattggtacggatattatgaaaatatgtgtgaatgttttaagaaaatgagtgattggttaaaaaaaataagtagataaaagagtatagttacgattggttgagagggtaaggtaggtggagaaataactttattttgggacaagataatatactagaaatagctatattttaaaatagaggtagtagggctacgcggcaccaggaaaatattctttttattttgtgttcttgcagctctgattatcttcttaaacctcatttacttaaatgcaatataatatatactccctatgtttcgaatgtttcgaaatgtttgacaccgttgattttttagcacatgtttgaccgttcgtcttattaaaaacgtttgtgagatatgtaaaattatatgcctacataaaaatatatttaacaatgaatcaaatgatagaaaaataattaataattacttaaattttttgaataagacgaacggtcaaacatgtgataaaaagtcaacagcgtcaaacatttcgaaacggagcgagtataaaagatccgaagcaatttacggcaaaataatttagttaccgttagacaaaaacttcgttgagttgtaaacacgactttttaggctcagtcttgtaggagtataaccgttaggtttaatttactattaaactaaggtttttcttgcggaaaatattaaactaatgtttgataatatatatctccatcctaatataagtgcatcctaatataagtgcacctagtaccaatatgatatttcatggtacaacgaacctacacctacacatacagctatccaaattcattgtactataaaatatcacatccagtttcatgtgtatttatattgggaaggaggagccccatcggttggcctaataaaccaaagcaaaagctaaaatttgatttttgaactgaattttaacaagattttaaaatattttcaatgtaattttgctacaaataaaagtgtaaaagttttacctataaattaattttattccctaataagccaaaccgatggggctagtagtatcctcgcatgattctttcagtacattccaatattacaataacatggttgtaacacatgaaaacagtctagatccaaataatgcaatactttcttctatcataaatatttgatatctttgtataaaatttagaaaaaaaaacttcactcattaattttacattatgacaagatgataaaatttattaagtttatgttgctaggatagtactccaaaacattttgtgtgtatgagaattgggaccatatattaacgatgtagtatataattataagtaactattgtataaatgaactattaaattggttatagatgatttggagctagtagttggctatctctaagcactttcaacaaaatggcattatcataatccactatccaccataataccaagcaaaacatcagcacacagaaccaatattttgtgaccaagcttaaagcataagggagagaaaagtccctcgtttttcatgcgcacgcttcctaaattgtaaaaggtatgttttttaatatatatatatatacatacatatataatgttttttaaaatcgtattaatctaccttttaagtttgaaataattaatactcaattaatcatgcgctaatcactcacttaaatttatgtatctttttaatcttcctattttccctcctctcaaacacacccttagtagttaaggcatactctgtagcaaatcatcacaagaacattgctcgacgtaggaggacaacagtaatgtgacataataatataactaaaatataatatattcatttgttgcgtagagatgttattgttattgacccatatacgtgtaacccgccctcttgccctacctgaacctgccaactactcatccacctcagtttcatactactcgcatgctagtactaaggttggtattcaaggaaaagcgtgaatagtaggtcttcaaacgtaagaatgaggtcgtattagagaatatgtaagccagaagtcattggatgatggtaacccatggtggagacgatgggaggtgagcaggggcttggcctccctcataatttgaggtttgcaatgttaatcactattgcttaagtggttttgcgtaaaattactatctctctttgtcctctttagcagaaaaatgaaaatagaatttaggattcttgttgtgtcattggagccgatgaaggacccgatgaagagaactagggatgagcatagatggtgccttcaaaatggtgctgcaataaatgttcataattgaagtcaacagttgggaaatcaagcttctccaaatttccaaatttgtagtacattttttattttgaattccatcctaaaatataagacacgatccattttttcccgtgtctcataatataaggcgtgcatgtatgcatacattaactatcaccttttaggccgcgttcgttacctcccgttcccaacttcgctccctcgtttttcgcacgcacactttttaaactgctaaacgatgcgttttttgtaaaaaaaaattctatacgaaagttgcttaaaaaatcatattaatccatttttcaaaaaattagcaaatacttaattaatcacccgctaatcattgctccgttttccgtgccagggagtgagggttcccaacccttactcccgaacgcagccttagatctataaatttggtttattttaaatcatgtaccatcaagtattccaatcatattgcttgcatatatggatgtgattcaatcgaggaggtgattaatcttttcttggtttttgtgttagaagtggttgagccttatattttgggatgaagggtgtagtacacttcatattgaaaattcataattggttattccatgttccaccaaaactcagctaaccgctggttgaaaatactactccatccattccattttgatcaccttaaaatttttgaggtcttccgaaaacagtcattatctaacaagggtctctttatttatttgtgcagagagtacatgtgcataattgaatgtattgcatgcatccaaccaaaattaatttctattgatgcaatggcatacagtatttaaaacatgagaaatccgcaggacacaaagcgatgaagcaccttaaccgaggaggattaatttaagaatgataaatatttttgggatccatagtcttggtgtcatttgcttatgggatgatcaaactggtatggagggagtattactaaacactagacacttagggtccgtttgatgcataggagttatcaaaaacatattcacatgaacttcgtaggagtcaattcatattatctagatttcaagtgcctgaaatttcccaaaaaaaaatcatatgccttttctaatccatacttatcaactatcactccccagtagtttgaaatctaacatagaaaatgtcgacgtttgatgtcgtgattccggtatttgcataatatggggatcgttggtactaggatatatgcgagactgaggtaaaagagatggggacgaggatttttatataggttcgggcccctgaattgtcaggtaataaccctactcctgttggccgaaaccagtcgttgctcttattcatcataatcacaccagtacaatatttggggtagcctatctatctgttgtcgacttggcggccataaaaccatcccgtagccgacaacagagtagtcttcctcctcgaatctgtatccggcgagatcaaagacagcgctatgtctctcctgatagtatccgtagacaccgtaggggactagccatgcttatctctgaagtcgatatccggcgtcttgtcttggtgtatgttgacttgtatgttgatcttgtgtattgatctattgttccgtctcccctctcctcctagggggccttgtatttatacccataggtgtccccttgtccaagtagaactaaggaaactaatatggatacaatccgagtagttcttgttgtttccatgtagaactctagtcatcctcccttatgcggaactcctcctatatccgaaggttgtttccatataagacaaggtatgtggtgggtcctgccgagatttagtcaactactattaggtatgtgctatccataaccctgacagaaaaaaattacaaaattagatgaaaacaaacttaattataactcacaaacaatacaaagtcacataaaaatcaaacttagacaaaaaaaagaagtaaaactatctataacaacatatttgcttttgaaatgaataaaagttgcacattgcaacttagggttagtagtgtacaattttaggtgactagaaatttataaaatttcaggcacctaaatctgttatggttatggataccatatacctaatagtagttgactaaatctcggcaggatccaccacataccatgtcttatacggaaactgacctcgagggagttccggataaggaaagacaaccagagttctacatgaaaacgacaaggactactcggattgtatccatattagtttccctagttctacttagacaaggcgacacctataggtataaatacaagccccctaggaggacagcgggacacccaccatggggtgatcaacacagacaatcaacgacctcaatcaacacccaacacgttacacgggacaacatacaagcctacatacgccaagacaagacgccggatattgacttcagggataagcacggctattctcttacggtgtctcaggatactgtcaggagagacgaaggcgctatctctgatcttgccgggcacggattcgaggaggaagattaccctgttgtcgactacgagtcagaccttcagaccgccatgtcgacaacagttagataggctaccccacatattgtactggtattattatggtgaataaagagcaacaccggctccggccaacaggatgtagggctattacctgaccgctcagggacccgaacctgtataaaaatcctcgtctccatctcttttaccttagtctggcgtatatcttagcaccaacgatccccatattgtccaaataccgtagtcgagacatcaaacgtcgacaaaatctagcaattttcattcttgaaacaattgtttagttttatgaaatcatactgttatattcctaggacacgcgaaagttagggtttgattgactcattaccgagggcatgttggaaagagttgtgtggctgttgtgcttattcttgcacatgaaactgaacggatcatcactagcacatgattagttaaatatcagctattataaatttttaaaaatgtatttatttgatctttttttaaaaaaacttctatatagaaaatttttatacaaaacatcacaagtagcagttcggaaaatgtgtaaatgaaaatcgagtaagttgtcgtttggagttgttggaaataacagcctaagagtgtgcgaaggcacaagcctctggaatacatatctaaagttggtcataataattctttgtatataagcaattcttctttatcactgggtataaatcaaccgcggctctgataaacaaacgttttgaataatgtctaaatacaaagatgatatgcatatcttggtgagcaccaaacaatgctcgacatcatgagaaccttatcccttggaaaaaagggtgctgtgctatctttttcttattaagtatgggcgtgaagcatcagaaggggtttcattggttaggcggttgagcaccgcaaccttcttggctcttttccacggagagtgagacacatgcaaatggagaaagcgactgagagtcgatcgatccgttaatatgaacactgctctggctctcgatggagtctcctcgatctcctggagccgacaattcaagagccagcccaactgtgatggaggagggaagaatcatctccgccaggtctagccaaacacaccaattaagtgattaacctgacagattagcttgatcggatccagtgtgcagacgcgtgctgcgcctcctcttgcctaggtctagttcttttctttttaacttcaaacttcacatttctcgtattttattaacacgattttcaaactattaaatagtatattttttaaaaaaaatattagattgtttgaaaaaaattaaataaatcattaattgctacttaattaattatatgctaatgagttttatcttttgcgtgtgctgaaaatctttctctaacttgagagactcagcttagaataattagatatcactgctcgatcaatggtttgggttagcagtaaaattatcatggcaaaatccatactgtaggtgagagtgtgagaccatgcatgaaacctccttgcaaatggaaaagaatatagaaaagaaagtagatattcgatgttcatgtacacatagaccagtggttagtaaaacactgccacataggtgtttaacggttcataggaataacacaatgattttcggtatcgatgtaaatcggaagccttgaaatagcttttatacgaggatctcaattaattagaaatgctcaaatacatgcatatttgttagatcctgcgaaatttatctgaagttatcactcgttctaattaattaaggcctccttgaaacctataaatattccatatatgattcatgtgcaaaacaaagttgcattcttacaaaaccttacaaaattaagccctttgattcaaaggaaaatcatagaaattttagagaattttatttttataggattttctatataaaattatttgaatcaaaggaataaaccctatgaatcctaccaaattcatatggaatgtctcattccaatgtaagttttgaaggaaatttaacaagaggtagaacctcatgaaaagttttatttgagtctttatctctcctcaaatttctatgcttttgtgtgtgtctattgttagaaatttggtcataattcggcatattttaatccaaaatattaagataatacatatgacatttgtaatttgagtagatctagtgaaattgctagatgtgtacaacatgagcatgcttaatatagaataagtatcaacatagacaagagaacgcaataatattgcgacctacagttataggaaacgaagaacgaacggtaatagtgaaacgttatacaccgagaatggccatccgctggagtttgagacagtattgcctccgttggtgttgacgggaggctcctcctccttgtcaccagtgttgttgttgtcgccggttgtcgacatgttggtgaagatgatgcagagcagtcgcgcttgaagcgctacccaaaaacatgatcgcccgcctacccgtgcaggttctcaagcggacggagtttcggaggcacctgctcgttccgatcacctgtgtgcacgggatgaacagaaccggggaaacagagagacatcacaggaacataaggagagtatcaccaagaaacaatagcagaaggaagacacaatctttgagagcctctgttttgctttatatatagagagagatctccattaccatacaaataaatctcatttattgtgaaggttaccacaaaataaatctcatttgttgtgaaggttaccacacaatgaatctttcatttgttgtgaaggttacaacaaataaatctctcatttgttctggatgttacaacacaatgaatctcttatttattgtggaggttacaacacaaataatttcatttgttaatggtgactttattctcgtctgttacaaaacggaagagcagcaggcaggctcggctcggtcggccgcctcgtctcgctacgcccacggccgaggccgactcggcacgcgcgcatgcgtgtggcagtccaaccatcacctcaaccggtcaacaagaaatccccaatatcactctatttaagttgaggttcttccacctaaattttcaatgcagtattattgtctctaacattacttgtgggctattaagattttaatttaattaaattgggcctagcccatttattccaacatccattgctcctaatcaaaaggtcattccggtgttttattatgttttacaatcctatattttatacttatattttgtcaaaattctatatttttgttccttcttttttattcctacaattgaaaggggcatagtgtattctaaattcctctggaaaatactcaggacacttggcaagccaatcgagtcacggttgtccaagttaaaaaaaaaaaaagagccatggttggaagctgccgtagaagatcatttggtggcaaggaaagacaactgccgcgaagactacagacaagcctcgccgtgtcagtcaactccaccacactcatgtctccacgtttattattctgcaaacgattttccctccccaatttatattattccactcaaagagtacattagtaatttcgaacgaattggtctggtctagtttgaagactatatagtgtgaaaaatgtgttaccttaagaaaaaagaacttcactctagctaatcgataatacgatttatgtgtcgcgctcaaaaaaaaaaaaaagcccatcaatgccctcatgtacgcattgcatgcatatgctgttggaaatatggttatatatcggtatattttaatccaaaatattaagacaataattatggcatgaacaatgtggggtgatctagtgataaaatcaaacataaacaggagcacgcttaagatagaataagcatcatcatcatacatagaacgcaattgcattgcgactaacagagatatcaaaaaccgaaataacagtagagagttataccctgtgaatgtccctccgctggattgtgaagcagagctgcctccattggtattgtcgatcggtgcacctggtgcggcagctcttgctctggctcccggcgcgccatctccaggtgcagatgcggcagacatggttgatgcagacgtacggtcgacgacgaacagaggacgaggagcagtcatgcggaagcactccccaaaaacctgatcacccgcctacccggtgcagatctcaggcgaaggcgtggttccggaggccctgctcgttccgatctctcgtgcgcgcaagcgatcagaaccggggatgtagacagaagcagcacaggcagcggcggcggcacgcggaggaggaagaaccagcgtttggaaaataaccgagaggatctgatcgggttcccactttccttatgggcgcaggagagagatccgcccgtggaggaagaaccagcgtttggaaaataaccgagaggatatgattaggttccctctttccttatgggcgcaggagagagatccgcccgttaccgcagtaacgacgcgatcaatgggtattgaatcgggttccctctttccttatgggcgtaggagagagatccgcctgttgccgcagtaacgacgcgatcaatgggtattgaatcgccctctttccttatgggcgcaggagagagatccgtccgttgccgcagtaacgacgcgatcaatgggtattgaatcgcctacccgttgtcgcaacgccacgtctcgccctggccggctcggctcagcgtgcgcgcacgcgtgtggctttccgatccccacctcaaccggtcaacagggagcctccaataactccctatttaagttgagatactcctcgtttaattcccaaggtggtaatattattcttaacatttattatgggccttttgagatttaatagaaaaatcaggcctagcccatttattctaacatatgcctccatccacctgttacacaatgcacacttgaaaatattttttttcctacttatatagtttagccgaaaaacatagctatacataaatacaagagaattttctatttggcctccaaagttgatcgattttctcattttccccacgaaattgattgtccctctaatgccttgcattcgtaacttttgtcctccatggctccatcttttattttgtttgttttccatcaagtaggtgggtaaaaatgacagctttgcctcagcttgttttatgcatgtcagtagtttttatttttcttttgggtgggattatactttgttattatggaccaacggttattgaatatttctcacgaacctaaatgttattttgagtaatgaagcgttatgaaaaaccctttgaatttgataaataacttttgagaacgaagggggagccaatttcgtaaggacaataggggaaccgatcaactttggagcacagataaagaattttctcttcgtactacttgagtgaattgcagtttagaccacccttttatcgttgaagtttcactttagattatcccatatattaatcaatatttcttcactttgagctaggtaattttatttttattgcatatcaataatcttgagtacacctgtccctgtaggttgatgaactctatcacctatgcatgtacctttactaaaggagaggctagacatgattagagaagtgagttggagtggtccataatgcaaaagtataaagttacctaccccaaagtactccctctatccgtgaatataagggatttttttttacaagaatcaaggaagtagtaaaataacatgtgatgagacaaaaggtgatggataaaagaataaagtagtataaagttagtaggtgggagaataaattagtataaaagtaaatgatggagaaataaactagtatataagttggtacatagaaaatatagtactgtcttgggtcttaaaaccccttatgttgtaggacaaacttgatggagaaaattccttatattatagggtgaatagccgaagtggtccttcaagtttcatctgaggctcagtttaatccttgatgtttcaatctttccatattagtcctttaagtttttattttagtttaaacttatccttgaaccaacaactctcttgataaataacacttatacccccatcattcacatatataagagaaaaattgtatgcttgatttttttatagataatgtatagtaaattatgtaaaacgaaaataaattatgtactagcaagtgtatacgatagcaattgcttaagtttcatgtgcacatgtagaaataatgggaagtatatctacaatgttatttattcatcttggttttatcctttttatatatagttgtatataaattaagggcaaaagggacattttctaatagaaatattgactaaaaatagccatatggcatgttaagtgggcccaaggatgatgtcaagccaaaacaaatatttagaggagctatgtggacaaaataaaaagtgaaggaccaaattgagccttcgataaaacttggaggactaaattagctattcaccctatattataggatggatggagtagaaagattagtgtacaatatacaagctgaaaatttgataataaaagttgagtcaaaatggaattcactctagatactttgacgaagagtatctcattactgttgtttcaatgtgccaaattggaatgtgatgcatactccctccgtccaaaaaaagacaaaccctggtttccgtgcccaacgtttgatcgtccgtcttatttgaaaaaattatgaaaaaaattaaaaagacaagtcacgcataaaatattaatcatgttttatcatctaacaataataaaaatacgaattataaaaaaaattatataagacagacagttaaagttggacacggagaccaggttttgtctttttgttaagacggagggagtacatgcgtggccaagagttgttaaacccgctgaccacaattccagaagcatatgaaagctgaaattgtccatgcatgccagccgagctaaccatgcatgggttgacagctatcgcgttttatgtacggaaaggtcgtctcaatttaattggcatacggatcatccaacaaacgggagtcgaaatgaaggccccatacaaatattttataccctctcgtatcgaatg

SEQ ID NO: 59443 - DNA, 6320 bp, Oryza sativa
ctgattgtgagtatatcagaatgtcgtcaatgaaaaccacaacaaacttatccaagtattccatgaacactttgttcattaagttcatgaagaaggcaggtgcattggttaaaccgaacgacatcaccgtgaattcatacagtccgtatcgcgtggtgaatgcggtcttcggaatatcttcttcgcggatgcgcaactggtgatatccggaacgaagatcaatcttggagaataccgtggcacctttaagctgatcgaacaggtcatcgatccggggaagagggtacttgtttttgatggtgacttcattgagggctctgtagtcgacgcacctcctcttcgtcttgtccttcttctccacaaaaatcacaggagcgccccagggggaagtactcggacgtatataccccttctctttcaactcttccaactgtttcttaacttcggccagttcatttgctgccatacggtagggtcgcttgtacagaggagtggttcctggagcaagatctatccggaactcaatctctcgcttgggcggcataccgggtagttcttccggaaacacatctccgaactctctgacgatggggatttctgacagtcctatctgatgaagttctgaactactgacagaggttgggggtgcaaagaaaacaaccggttgttccggtcctcggtacagagtaacagtgcgtctcgcgcaatccactactccttgaaattgagccaaccaattcattccaaggatcacatccaagttcttggtgtctagcagaatcaggtccgagggaaaaggaatcccctgaatttctatagggacggcaggactataatactttgctgtcataacccctccaggggtggtgatgagcagagggtttctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccctgaatgacatccttcccaccgttgttggagcggggaggcgcttggccttgctggcgcctcggtttcgggcatttatccgcaaagtgcccgggctcgaagcagttgaagcacagacgctgctgaccttgagcgtccctgcagccttgaccagactgcacggctggcgtaggaggacggggcgcacgagtcccttgctgactctgctgctgctgcggctgtgggacgcgcaccacgtattgaggtcgaggcacggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcagaattccctttttttaagagccacgactccggcgggcacatgggttctccggaaagcggcggtgaaacgggcccaagtaataggctgcccctctggctgcgtagcctggaaatggtcccaccatagagatgcgggcccctgcagttggtgggcggcgaagatgactttctcctcatcgctgcactgcacagtgtctagctttttccccacggcatgcaaccaatccaacgcatccacggggttgttggagctagagaaggtgggtgggcggatgcggaggaactcggcgagtttagagtgttgcgggggtggtggtggagcattctgttgtggcggattttggaggtggtggaggaaagcagtcatcatgttggcctgctgggcgaggatttgggtgagaatggcgttggtatctggtggtggtggtggaggcggaggaggaggtggaggtgggctgccatggtggttgcggttgctgccttcaggttggttgccatcaccggcattagcacttctcctggtcgtcaccatctgaaaaccccacacagaaccagcaaacagagagagctgacaattaaggctaaccatccacgactaccataattcttaaatttattactgctattaaattggttcattaaagttcaagttgcttaggcaaataaaataaagacaggctccgacacagttatgccacacaccggcctaaccatgccccacacaactccaacaagaagacaaacgaggaagaacacacgcgcaagcctactaactgctcgtctaccactgcgacgggccagggcggaaggtgagcaacagcgcatcctccgtgctaccaacgccggaggcttccccctcctggggaaccacaggcgcgggctcggcacgaggggtctccacgaagcaggtccacgccagggactgacgaacaagctcgggcctggaggtgctcttgcgggcggtgatcttctggctgcggcagacacggcgacgcttggggcggcagacctctccctgggcgatcttgagctgatgcagctgcgcctccaccgcgtctaggtccttcttgagctgcaggttctcctgacgcagctccaggatcttcaggttgttctcgaccatcccacggcgcaccatctgatggaagtcgatacgagccgcgtcgtacgcctccaccatgcgcgccaggtgcacgatggtagcgtcgtcctccgagctagcatcccggaaggtggcgtagtcgcgggctcctccgcggtgagggtggtagcggtagggcgagtgctgcaactcgtccgggtagcgctggtgaagagtgccgatggcgaggagagcggcgttctggcaagcggcggggaaagaatctccacccgcggtgactgccagcgaagtccgctcgggagagccagcgaggatcactgcagtgacctcccaagcagcgtggggctctgcatcgtcaccctcctgcttcggaagcggcctggcctggtagtccactccatgcggataccccaggaccacgcacatgccccgcagctccaagacgaagccagtcatgtccaaaccacgacgggtgacgctgccggccatctacaaacaaaaacaaaaagaaaaacaacattttaaagatcatattttggcgataaatgaagcagcaagacagagagagactagacagttttcacaaataacaaaggatttttatttcgaaaatactgctaaggcttgggatctaaggctcgtcctagggtcaagggggctctgataccaacttgtcacgaccggaaataacccaacgggcgttccttacgtgcgtgcattaatccttgtcccaggaggcaaggtacaccaacagttgatacaaatcagagtttaacaagcggaagcgtaaatagttaattattacatgggcagcgacggcccagcacactcaaagacaacgaaaaacagcggaagactagggcgacgaccacaggcgcttgacggcaggcacgagctagacaccaaaacctccatcttccaggaactcttcttctgggcttgggaaaaaattgagcaagactgagtacaaccaccgtactcaacaagacacacccacaaatgcagaataaatgcaagggagtacaaaggagttatactataaagggttagggtttgcagtaaacagcatttaaagatatttagttgctcagagctattttgtaaacacgattctagaactgtacaatattatttatcaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgccctggagatgtccatcgacccccgacttcgtccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtatccagatgatatgaatatttcccaaagtctatagttgaaaaaccacctaatgttacctaattaaattgcgaagcatctacctaaaactaaactagtggtgccatgagtagagtgtccactagttgaggttttgtttattctagggtgaacaaggtaataataacaataacaataataataaggtcataacaaaggtaaataggcgtggctaaataaaacagtgataacgcgggaatttaaataaagcgataatgcagtaatttaaatcaacataattttacaaactgggattcaatatattcaaagatgatgtgacttgccttgctcgctttcccaaacgtcggcttcaacttccacgaagagcggatcttccgaagctgcagcgtctacacgaccaacggaaaagaaaaggcttttactctaataaactccatataacaagcagaagcaaagcacaaaaatgggttcttgacttcttaaggaaaaattagagacttgaacggtccaattccgagttcaaatggccaagttatggccatttgaagtttatatgctctttgattgaatatttgcgaatttcttcatttaaattttaatttaaaatcggatttattgcgtcagccggggggaggggcgcgcggaccgggtccacgggagtgggcccacgcggcagcctcacggtccacggtggaacgggtgcacgcggcttacgccggccggcgccgtgggtcccacgcgtcagccgtacccgaggcgcgggcggctgacggccgggccccacatggcagccgcggggcgcgcccgaaggcggcctcgccggcacagccgacgggaggcggcgcgcccgcgcccctatggtcgccggcggcggccataggcacggcggagcggcggccgagagaggggagggaagggggaaacgaaatgggcggtccacggctcaccccgggtcgacggcgacgacgggaacggcgaccggagcggaaaaaggcggcggcgcggctcgggtcgacgaggacggcggcgttccggcggtcggcgggcgaaacggaggggtggacgaggtcggcgatgttgcggcgaacccgaagaaggcgacgccgaaacgggagaaggtccggggcgacgacggcggcagaccggagctcggcggcggcggcggagagagagggcgacggcgcgagctcgattccgacggggagagagagcggcgagcggcggaaacggaggagggaggcacggggatggtttatatagggttgggagtgagagagggcggccggaggagaaggaaaccggcgcggcgctctcgggctccatcaatggcgccggcgagatttgcgggggcaaatccgcccgtttgaacgcgagagagagaggggaaaatggggggaaagggagagggaatcacggggagtgatttccccctctttattgcacgcgggggcggcgggatgcggcggaatccgcggcggcggcggcgctagggcacgggcgaggcggcgggagcggcgcgaggtaggggatgacgggtgggccccacccgtcagcgagggtggcgggcgggcccgcccgtcagcggcgcgcgcgcgggggaaggccggatgggccgcgggggagaggagagagagggagagggagggggggaaaaagggactttttaggg

SEQ ID NO: 59444 - DNA, 1636 bp, Oryza sativa
tctcaatgatatataggacccacatgagtcaatgacatgtgggtcaggatagtatatcttaaattttgtaaaatttataatggcatggttccaattttcccaaatttaatttaaaagctaaggtaaggagtaggcatcgtgagagatatggtacgtaggcccatctggcctttctaccaaatcgccaaccacgcaccttgattccgtatcacgcgacctccagcggttgacacctgtgccgcttctctgtcgcaggatcactggtcagatcggattcgacgacggggaaggagacactcgtcgcgggcagcagcacccgacagaagcacgcggggacgtctccccgtcggcgccagctgccttgcaaagccaaaactaaatgggggcatttgcaaatttgccaccgattttttcaatattgcaaggatgccactcgaatgatagttttaatggtatttttgtaattttctagtgacagttttataataacgattcaagatagtgataaatttacaattgccccaaactaaattaccccaccaacccgtaaaacggagcaatcactagtatatgattaactaaatattaattttttaaaaaaagtaaattaatatgattttttaaaaaactttctataatattttaaaaatacaccccgttcagccgtttgaaaaatgtgtgtgaaaaatgaataagatgagttgagaagtaagagtggtaagttgggaaaggagaaagatcggtgaataactccactattccatcttttcaaaaaatacattagattgaaaacccaatgtacatagccatagtgctcgactattccacgcagttagacgtaaaatgtgtcaatttcctgttcttgttcatattaaatgcctttaaacttagcatttctttcttaagaaaaaaaacttggcatttctttcatgttagaaactagcagcatttactaaggggtaaactcgtctaaaatgtccagcactatatggaacgatatacattttcgtccattctgtaaaacgctacaacaataggaaatatgattaatgaaatattcctggaaaaatcctttgtcttgacgaaataaagtgtgcattatatttttgttcatagattcatgtcaccgcttgtgtcgggaatactatgtgtatcactcaagtaaaacaaatgttttgtaggaaacatgaatcaaccgcatgtgttgggaatacatattttttcaaagaagatgaatggtcaatcatatcccgttatatattaaaaagttggagggagcaactattataaagttaaaaatatattttttttgatttttttaaacttgaatataacctttttcatatatcgtttagtagttaaaatatgctcacaataaatgaggaagtagcccaatgcaacagctcttcaagctctgttcgatgcggcgattggatttagttagttattagaacatgattaattaagtgtaaacaattatattttaaaacataaatatatttatgtttttctttagaaaatttatatagaaagtttttacgtgaaatacgcactgttagctgtgagcttacggtaaacaagagatgaatcgaacctaatctcagtttataacacgatcttaagtatcctaaggaag

SEQ ID NO: 59445 - DNA, 515 bp, Oryza sativa
cttgatcgtatactatcctgaatttgttgagagcaaactttaagctaggagtatactactactcctactttcttgcaaaaaaaatggtgttcaaaatgcatgcttcagatcgacctagcttagctagggttcgaaattttgaccaggtcgagaaccattcaatatcaccatctggttccaaaacaaaaaataaaaataaaaaataatattcaacgccaccaaatcgtgagcttgaattcagaccagtgaaagtgaccataagacagttctggtgttgcacatgtttcagaggttgaaaaaagggaacaagagtttttcagaaacatggttctaccgatcaaaagatacaaactagaataggatagtaccatattacagaatgcaaaagagaaaaaaatgaaaaaaaaacacttggtagaattaaacacaaaacattggataatctcactgacctttggtttattccgagcttgctcttgcaactctcctctagcttcttgcccccacagatgtta

SEQ ID NO: 59446 - DNA, 3094 bp, Oryza sativa
ctcatttttggtttatttcaccttaggtcatgactaatattccattcgcattatgtttttcttattttgccatattctggattttattatttgacttccatctcaacatacacctcttatagtatttgaattaaacaatatatttgcaatatataaacgaataacaccagcatgatgcaaagtttttaaaaagttcgaatttttagtgatttttattattgaggatttttaggatgttacatctttctcatggggcactcgcgggtggatggtcttcctcacaatgaaagcaggtagtggcacacgagctagcaacatgaccgatttctccacaacgagagcatgccttatgttccattttattctggttgaaaccttggggagacttctcatcttcatcatctgaggagacttgatctgaatcttcactatcatacactctacctccactagctaaaagatgctctgtcaactgtggtgcacctcggaaggaatttcttctctgacgttttgtcattcctggtggaggccattctgtgctggtaatgatcatcttacggacttcatcttcggttcgcattggtgcttttcttttctgctgaggacagttccttgcatagtgcccttgttcatcacacataaaacaaatgattcttgcttcttttgagtcaacatgtgacatggcatgaggggccttctgggatgttggcggtgcgctgacttgtggtgtgagtgcttggactgcctccaactgcacttaaggttgcatctgactccggttcagaattggcgtccgatgctgctgtagtatctctataagcaatttgttctgcttaatcaagtgttggaccactgccacacaattggtgtctggtgcttcattcactcgggagcttgaggtacccatgtcctgacttctgaccttattgcctttctcattgtcagccatctgttgcaaggtttggagagggagagagggaaaacaaaggggagagacagatcaaaaactaaggataggaccttaacagatctaagtcttttgctgttatgatgtatgttaggcttattctgcaagttgattaagcaaacaacctagcatggttacatcacaccccactgatgcaaaccacgtgctacacacacaagcaaggaaacacacgactatcgaaaccctagagggtggcttaggttctacgacgggttctctaagatcttcactcctgcttcacatctagcttcactgcttccttcgcttcgctagcggaccctgcggtcttccggagcttcggcaaacaattggcgacatctttttcttcgcaaaactaaccatctagtactagttgaaaatctgaaggaggaagaagagaataaacattttgcaaatagcattagggaaaggaggaaaaaggaactttcgcaaatagtttcatttataaaatatgtccttaggttttatccacttggcttatcctacagtcgagatggctctgataccaccttgtcacgaccgagaaaatttgcattttcccgaacgctagtgtattaattcccgtcccaggaaaagccggggtacaccacacaaacatgatataaaagacacatctttattataaagataatatttacattattacaaaggcacctcaggcttgacaaacaaaaaaaaacagcagcggactagcgggcctacggctccatcttcacaggcgctcaactggggtataagccaggacaccacctaagacttcttctccaaagcttctcttactgaagtgggggaaagattgagcaagaatgagtacaaccaccgtactcagcaagccacatcggcagatgcatgattaatgcaaggggggtacaaggggataataataggggttaggttttgctgtaaacagcatttataagtcacttagttgcccaaatctattttgtaaacacgatccaagagctacacaatattattaatcaaggccgtgaacccacatgaacctgccttaacccaaggcctacgatgattcagactgaactggcaacccgacctgggtcccagctagtctcaagccaacccaggccaacctttccacattttagttattaagcaaattttaagaattaaaccactaacttgggtacattgctaggcttgcccatatctgagggctcggctattcgaatagatttactctgatcagaggtgtacatctttacccacaagacacatctttactccgcattccatgggcatggaacccgtcgtaaacatgtgacataacccttcacccatcctagccgtgtagtcttcatttgcctagacatctcgattaccgagccgcagctcgcgtagcctttatttggctcagagatatccatcgtcgcaacgacttcatccatctctatccatgtccttttgttcaggactagactgagcaccaagttaagccttacccattagacatgtggttagtacggtagtgctttgcaacagaggcccaaagaccggtccttatagtggccgaggtgctactagcaaaaccctgcacctcgagcccagcctaaaaccattttgggagttttgaatagaggggggaggtgtgtgttcaattccatcacaagccaaccattccacagtgtccaaatgatatgagcatccccaaagtctaaagttataaaaccacctaatgttgcctaattattcagcgagcatctacctaaattcatactagtggaaccatgaatagattacccactagttggggttttattttcctagggtgaacaaggtaataataaacaatagcaataataataaggtcataacaaaggtaaataggcatggctaaataaaacagtgataatgcgggaatttaaataaagcgataatgcattaatttaaatcaaaataattttataaactaggattcaatatgctcaaggatgatgtgacttgccttgcccagagagaacggccttctgaaccttcggcgacgaccgcaaacgaccgcaagaatgatacattaatggtttacaatgagaagtgccgagaattgatggatggatttcggctggtaactttgacgcatgtgtctcgaga

SEQ ID NO: 59447 - DNA, 29962 bp, Oryza sativa
catttctacccctcattgacatgcattatacttgtacttgtgaggggtagaaacgtcatatcgtgtgtgtggctggatcaagacggacagaaaacgatcgagaattgacggaagtgttaaaaatgggaacatggtgaactttgggtgctattaaagtgaaccggtaactttcggtgctataaaaccaaaaacgtgaactttcaatgctatataaccaattttagctttaattagttaaggcacgtcggatatctggttttaacattttttagcttgatgacaagttgagggaccttcggtgtactttttcctttgtcctgcgtttccgggtcacggactccaggtttcggcccatgggccacggcctcatatgggacgccaccccacgtgagtgttgacgcggcaactgggccgttctttcagctcaatggttaaatggtacttcatctaccctaaaatataacaacataaaaatcagatggaatataatctagacataccccttacatattcatactattattctacttcctccctcccaaaaaaaacaccatctaagacaacgaatccggacattgattttttttcggacggagggagtatctgattctatgttcctataattttcatgatggagatggtaccattattttagagtaggaaagaaccaataaaatgatataaatactgaaaatagattaagaataatattctaagaatttaatctgtaaacaattttttttagaaattgcacgtttagtttttgttaaaaaaaataatccttagttcctctcatcacgaacaaacttacccagggctgcaagcatgtgtattggctttgtagtgccctgcccttgagaaaaatagtagagtacttcattttacaatcctttgattgctgagatgaaattaaacctgtttaggacaataatagtggtagctagtactcgattgttcggcctcgcttaccatatcatgcattccatacggcaaagtggaaaatgtcttgggtccagaaaatctaaggcgcgaggaaaatagtacaggctggttttgggaacaagggacgtggtggagagcaaggccacgctaagccaacacgacctccacggcatgagtaaaacatagttgcaccaaccgtcaggcattcatttcggatggtttctcacgaggacatgagagatctcatagggtgtgtttggtcgctcttgcagcgaacatggaagagagtctcctatataacacttcgagggccatatgccatgtagaagcaccgtgactgctcttagggcaggagcaatacaacacacgcaatcacgcatagcgtgtctctagccctcctgaagatgcgagattggtccaaggccagcattttcacagtgtaggcgcgattttggatgcgacacgaggagacgaggagacgaaggcacaactgtgaaaccttgggtgtgtttagttcacgttaaaattggaagtttggttgaaattggaacgatgtgacggaaaagttagaagtttgtgtgggtagaaaagttttgatgtgatggaaaagttggaagtttgaagaaagagtctggaactaaacaaggcccttttagcttgctaagcgtgaaatgtcagatatgactatccctcaaaattcttcgcgggcattttgccactattgagggaattcaggcccaaatttctgaacgagagttcagcccaggggtggatctacaggagaagagccggtgtcagacgataccgacgactttcggcaaaaactatagcgaaactgcttatccatatgctataacatcatgatctaaatataattagcatactatgacaccgataagcacgttctgacaccaacaaatcgattttctggatccgccactgcttcagcctatacgttttccttgaacatttgatcagctcctccaccactgggctctcgtttccacatgtgcttgaccagccgaaaggcgagactgtctttggcagtttcagcgttgcaaaaacacaaatgtttcagtttcagaaacgaacccaatcgatcccccctactactgcagttgctcacacacccacaccccgactgcacacgtcgcctcgcctcgtctgcgtctgcgtctgcgtctgcgtctccgtctccaacccaggcggcgtaggggaaggagaaggaaggagagatcgcgcggcgcgctggctgtcgctgtcgccgtcgcgcaggctcgtccacctcgcgaaatcgtgagctcgcgcgccgctccgggcatgcagggcgccacgccgggcgatgccgctggagaggaggtgggaggcggcggggacgtggtgatggtgaggcgggcgagcgtggcggcgtgcctgacctgcccgctctgcggccgcctcctccgggacgccaccaccatctcggagtgcctccacacctgtgagtccccctcctccaccctgctccgctcacagtccccacgctttctcgccccgcgcgctggggaggtcgtccccacgcgtcaaatctgcacatttgcgcggtgattcggggtgggtttttgaggtgacgcatggaaggtggcagtttccgccgttccatgagctatttctgcgtgggcttatttttttttccccgttggtgcgtcaaaggtgggatgattttcatcgttcgttcgcgaaataggaatttggttgtgccatttccgtggggttttgaggtggtgcgtgaatatctctcgatgtcggcatgtcgaggagggcctagcttgtgattcctgggttcgttgctcatcagctcatgtgttctacggggatttgggatgaggctatcaggccagtggaagtgatcggttgcggtggacttttgtgcggtgacgaattacgtttgcccagaaaggggcgcacgctacttatttaataatatttaatttcatgatgatctatttcttcgatgcgaggattagaaaacttgtcaggcaaatatacaaaaaaagattaatgaaatttatgaagagagtaggaaggtcctccctattttcatcaggaagaaaaggggcaagaggatgtgtaaaaggtggcacttttggttagtgtagtgtatgccattttttttttattgtcaggtgcttaaatgcatgaagcaaaggttgcatacacatcgttttttattgtcaggggacttcattctttgaaacatgttgagtggccttgttataaacaataactagttactgttcattcttggaaacatgcttagttctttttctttctagtttgttgaaatatcgtaactgtgccattgtatggatgcttggcatgtaatactgatcgaatgatgggtgagctcattaggaagttaggcaaccaaatatatagataatctagtattctgtattcggttggtccttcttatttctaagttattctggaataagagaggagaaaaatcctaatgtgggcacactgattcattccatattttttatgactcttgcaacgtattcataaagcaatagtattggagtaacaactctacccagtgtccaaccaaaattttgtaaatttggggagtcttactgccaacagctgccaatagaaacacttgatctgttaccagttaattcttgtaatatcgtgcttcaaccattgatttatacctttaaccagtctgcagaaagtgtatacatgaggagttcgtcgataaggagtcctgctgctgccctacttgcaacattgatctggggtgtgctccgttggagaaactcaggtttgtctttgtcactgtttccctgaaatattttatctacactattgcatacttctgaggcttaaaaccattgttcagttattgtattattttcttttctatgtcatgcccccaatttgatattgcgatttcaatgcagcgcatgtacatacacctaagaagttagtgacatttgggagttgggagagttttttctttaccacctctgctctcttgcatgtacaaatgagatagtcttctgtgagcaatcatccttcctccatcaatataacaactattgtgtcctgcttttttgatattattatgcatacaacactatgttcttcctcaattgccagtgataatcgtgattttgcaataccagcctagtgctgtgccactgttctgtttgcatcacatggactgttataacatcataataatctccatctgttcaatcttggcttggatggtcttaaagactttataattgttttgtttttgctcggtttattttaatgattagttgtttgttcgttacaagttataacttcgaaaggggtgagatgagcccaaacttagttcacacgatcacaccttgattaatctttagccgcttgataccgagttatcagcagcatataacaaacaagttttactttccctttttgtgatattgtagcttatggtattttcaattgtgttttgttcagagttgatcacagtatgcaattcgtaaggtcaaggatatttcctttcaaacgaaggaaggttgagaacccagaaatcatttgtccagttgcgtcacctgtcaagaggaaagaaagatcactatcttcacttacaatccctgctcctcaggtgtctatacagaaatgtttgacaaagaggagaacgaaagcttcgtgcttacgcaactttcctttggtatgtagttctcttgtaatagttcccctgagaatcggatgtgtgaagaattctaatttcttatctgtaaatccactattagaattgttcaaatgaatgtgactctgcatcaccagaatgctgtaagcaaccctataggttaggtcataccatgtatttccattgttttagtgccatagagccatctacatggtatgccagctattgtcgtattattgcagctggcacaatcacagatgtgtgctaggtaacagttcttggcactgtccgcatgtgttattggtatgctaaaggttgtgatagtcaacatgtgaatatttacgggctaatacataacaaatggttatctgaatcttctgaatttatttatagtccaggcgacattaatgatagatgcacaatacttttattttgccttcaaaactcaaatagtttcctacaaattgaggcaatccatagaaatttcatactccaaatacctttgttccaaagacatataggaaagtttcgttaggattgaaattcttcaaaaatcctccaaataccttttgttgcaaaggagatgttatgcatgaattaaatgcaaccgatgcccctcccctccaaattctaaatcgatgcgatttttattgctgttgtgtagagtatttttttctggtctgattttaatgaataaattttcttttccccgccttgtgatgtagcattctacctcgaggggcagtaaagatacatcaaagaaacttgggggttggagaccattgggttgtcaacttaagcttggcaaagacaaaaaatctctcaaatcaagtgtaaaagatacaaacagaaccaaaagtaagtctggtgatacagatgatggtgctcctgctagtaaagcaaaggctagagaaccctttacaagatatgggcgtgcagctaagaggactggaagaaagaaattgctcatgttgaagaacaaaaagaaaaggttcaaggcaaagcagcccagtaaaaagaggagattccgagcactatggttttatctacttgctgcttttgaccagtgagaaacactagacttgtcttgtgagatttgtgccgtttcttcaaaggaaaagcagaaatcatgctttgtgtttgtaattatttcaggagaggagtaccaactttaccacaactaccagcaaagtatttgaggatcaagtgagttatttggttgcacttttctagtcaaaacagtatttgttaagccacactaacaactgccttttgttatatttgtcaaagggatgttgatttgcctgcttctattatacagaagtaccttgcacagaaacttaacctctcaagtgaaactgaggtatgtctttacatatttctttcttgtagtgatcatcaaaaccagtctgttttttgtgccagtatccagattagttagaatcagcagtgagaaagaattccatcaatatttggctttcctgccagggacaagactggctaactggagctaaaatctcacaatctaaacatagttagatgtagttatggcacattcttagctgttctttggaggaaaacaacttacttcatgattatatttgaaaaggcaagaaaattcaccatactgtttccaattggtgcttgattgaaggctgaagctgaccggtgttcagttgattttgtgctgtagatacttttgccactttgttttgcgcataaccacgtttgtctttgcaatgaacaacataactgttcgctgcttcaagtttcatggtgctgcttgacacttgcaacatgtgaaattattaccctatattgacaaaagttgacagaacattctgctcattgcacagcctattttcttctgctctcaccaacgagtcgtggttgcaggtagaagtgttgtgtggtggcaaagtagtgaaccaagggatgacactgcatgatctagcagattgctggcttgagaaaggaccaaagagccgaatgcgctcatcggtaggctccccggccactggattcatggtgacattgttctatagaaggccagatgtggatgtgtcctcatccccagctccaccccaacctgacactgaaagttgccatagctgatgcagagctttgcttcgtttctgaaccatctgtgattggcttcactcattgggctgtcagcccttgattgatctgcgaatcggttccaatttgtgtgaggctcaagccacaccaattcactaatatgtagataaatgctactaattttacaagccatgttgggcttctgatcatctaccttcttcaaccattattttccttttttttctcttcaaccattgtacctaggtatgtgatctgtaatgagatgttaatcgttaagtatcagttgttagagctagggacttcatgttgtctccacgtagctagtagtactagattatgcttgtgtatttgaatttgctggtgcattcatcatgcatgtatatatataagctctggaattccttgtagttaactggatgttaagctgagaatgtataagctctagattatcagtttaccactccatgcgtgatgaaacgtgctactgcttactctgttcccaaatataaataacttgaaattgtttaccagagatcaaggtttgaaaagaaaatgctacagtgtttcttattaaggccgagtttagttacaaacttttttttttcaaacttccaacttttccatcacatcaaaactttcttacacacataaactttcaacttttctttcacatcgttccaatttcaaccaaacttcgaattttagcatgaactaaacacgccctaagtggagagtggttagggctcattcgggatgtaggttgaacgaacacagtgattggaaaaaaaataggaatgtgataggaatacatgtacaaaacatatgatttgaatatacataaatttcgtaggaacagatggctaggtgaatacacagtacagggtgtgtttagttcacgccaaaattggaagtttggttgaaattgaaacgatatgatggaaaagttgaaagtttgtgtgtataggaaagttttgatgtgatggaaaagttggaagtttgaagaaaaagtttggaattaaacttggccacaatctaattaacgcaatataaattcattttgtatttcattctcttctttttctgcttattattattaccccctatgtttcaaaatgtttgacaccgttgactttttagcacgtgtttgaccattcgttttattcaaaaaatttaagtaattatttattcttttcatatcatttgattcattgttaaatatactttcatgtacacatatagttttatatattttacaaatttttttagtaagacaaacggtcaaacacgtgctaaaaagtcaacggtgtaaaacattttgaaatggagagagtattatttttaaaaggaagccaaagtccaaactcgaaatattcggggctcccgcccaaggggtcccgctctctcgtctcctcgggactcagccccaaaaactcaaatcccccgccttcttgtcccctccgcttccccttccacttccacccccacgtcgcctcacctcgcctcctctccccctccaaaccccaccaccacagagaaaaccccagggagaaggacaagggctccacataccaacggcgccctcctcctcgactagctcccgccggtaatcccctctccccctcctcgcgctgcttcgattgcttggttcgcgtggcgcgattgcgcgtgcggtggtgggttttggttggtagttttgtctctgccttggttgcttgtgggggttcgtcgctgatcgtggtgtcgtggggagagctgatcgcggtcgcgtgatgcggtgtgtctgcggcgtctcggtcggctcgcgtccggcttcacgctgtgttgttttctgacgcgatcgtacattcgccgagattttttttttgggtgtatcggcgtggtgggtgaggcggcgattttgttcgtctgctccgtatcatcttcgatcgcttgttccactgctgatgctgtgcgcgagcgtgtcctctatttcgtctgtgcgaatgtggatgagtccatttgagtttttggtgccatttttttcatgctccgagtagcatggcgctttgatggttaatgcggctggttttgttgtgcaggggttgcgaactcggcgatggatcagtgacccgccgtggtgaagcctgcagattctacctataaggtatatcgccccacccctcttcctcggatttactagtagctgaattgttgttgactggtgaatgataatcgagcggaagctgttcaggattttgcactgctgcttgttatgctctgtgtggccctctagtaatgtggctttcattaaatcagtggttgctgcaccactgttgaaaatgcattgcactatttacacattcaacaatctatgtggtataatactaatgagaataaagtgtttattacattattccattatctaaataaattatttaattttagtgcactgtagtacgttacacattcagcaatctatgtggggttgttaacttagcgcatttgtgtttgcacatgggaatgggatcaacttgtgttgtacactagtataactgtagcttccttatggagcctagctcaatatgctatagaaaccgtctgctgaaactaataggattctccaagaaggagatgatgcggtgatggtgtgttgctgttattattttctttttgtaaactgtttttgatgtcatacaaacttcttgatgtacttgctaaactcttgagttttgcattttggttcctatatttgttttgaacttctaattgaaatgcctgcttgattccaaatttacaggggagctatggcgaaaagtccacgttctgttgttaccacaggtcttcttctgtctactttgtaactgcttatctcactttcacataacatctcatgcatttatgatttaactaagttttagtcagatcgtaaggcagtttatgcagtgtagcttacagcttatttttaccattgtgagttactgaattcaactagagccacacacatatataattatatgcctgcatatatcactcataatcacttggagttatcatgtttgatcttgcttgcaatctagaatcttgcaatagctttctacatatacatgcttgacagttataagtaagatgctgatgttgatttacttgtttatatttttaacgtgcttggttcatctgatggatacatgcttgtatggtatccaattatttcaaattgtaatataaccaacaccattttgtctctcaggaacaaaaaggcgtagagcaaaggttcataaagaagatgagcctgttgagaatgaaaacttggagagtgaatttgatgtttccaagaaagagagcaatggtgccactgaacctggtaatgagcctgttgccagcaagagaccgaagagagcagctgcctgttctaacttcaaagagaagtcattggacttatcagaaaaagattcaattatcacaatcaaggaaagtcgggttgaagagaaggaaatagaggctgttaatttgacaaggacgggacctgaagatggtcaaccttgcagaaaaatcatcgatttcatcttacatgatggagatggtaatctgcaaccctttgaaatgtctgaagttgatgacattttcataacagctcttatcatgcccttggatgatgatctggaaaaggataggggaaagggaatatgttgttcggggtttggacgaattgaaaactgggcgatttctggctatgatgaaggtgctgcagtaatttgggtctcaacagaaacatcagattacaaatgtgtgaagccagcaagcagttacagatcttattttgaacactttagtgagaaggcacgtgtctgtgttgaagtctataagaagttagctagatcagttggtggaaatcctcaggtggacttagaagaattaattgctggtgttgtccgttccattaattcaaacagaagcttcaacggaacagtaaccaaagactttgtgatctcctctggtgagttcatatataaacagcttattggattagaccatacagctggcaatgatgatgagatgttggccacactgccagttcttgttgcactgaaagatgaatgtaaatcaagagcaggattcacacatttgccagctatgccctcgaatggaactctgaggattaaggatgggcaagacaagggactgactgaggatgaggatgcaaaattagcaagactgttgcaggaagaggaagaatggaaaatgatgaagcagagaggcaagcgtggaacttcacagaaaaatatctacatcaagatttgtgaaactgaaattgccaacgactacccacttccagcctactataaaccatataaccaagaaatggatgagtacatatttgatagtgatattggtatgtattctgatgatgtacctgtaagaatccttgacaactgggctctatacaattcagattccagactcatttctttggagctcatccctatgaaagctggtgcagaaaatgatattgtggtatttggatctggttttatgagagaggatgatggtagttgctgttcaacagctgagctagcacagttacattcttcctcaagtaaatctggccgggaagatccaggagttccaatttatttgagcccaattaaagagtgggttgtagaatttggtggttcaatgatctgcataaccattcgaactgacgttgcttggtaaataccctggcagttctattttctttttgtattaccattatctccaaggggtaccatattttagctttgttagtcttgatcattgccagctcatgatggaaaaataaactcaatgcatttcggataacatatcttacacacacacacacacacacacgaatttggcattttgtttgaagcatggaattttgcaaccatgttgtgtttaccttctctctaatttacatctggtaatcaattccaggtacaaattacgccagccaacaaagcaatatgctccatggtgtgagcctgtgctgaaaacagcaaggctagctgttagtatcatcacccttttaaaagagcaaagtcgcgcttcaaagctttcttttgctgaagttatcaagaaagtagcagaatttgacagtagacaccctgcatttatatcatcgaaagcaccaaccgttgaaagatatgtcgtggtgcatggacagataatacttcagcagtttgcagactttccagatgaatctgtcaaacggtgtgccttcatcacaggtcttctagcaaagatggaggaaagtaggcacacaaagttggccatcaagaaaaaatctcaacagatgagaggggagaatctgaacccaagcgcaaaaatgggtccaatactgagaaagaagcttatgcgtgctacaactacaatgttgatcagcaagatatggggtgaatactatgccacttatttccctggggatacaaaggaagaagatcagaatgaaccaaaggaaattgatgatgatcaagaagaaaatgaagacaatgatgctgaagaggaggtaaatgttcaagatgagaaggccacaaggactccaccatcaacacggtctagaaagtcgtcagcagatactcgcaaggaaatcaaatgggaaggtcaaacagctggaaaaacagtgtctggagaagttctgtacaaatgtgttattgttcaagacctcagtatttctgttggtgcgacagtcacaacagaggatgattcaggagaaaccatcatgtgttttgttgagtatatgtatgagaaacttgatggtaaaaatatgattcatgggataattctgcaagaaggttcacagactgttcttggcaatgctgcaaatgatagagaggttttcttgactaatgactgtttagaatttgaagcaagtgacatcaaagagttggtgactgttaatatccaatcactgccttggggccacaagtacagaaaagagaattctgaagctaagagaattgaaaaggccaaggcagaggagaggaaaaggaagggcctgccagtggaatatatttgcaaaagcttatactggcctgagaaaggtggattcttctcccttccgtatgataaaattggaaatggcacaggcatctgtagctcctgtgagagaaaaccagttggcaatgaattcaagttactttctgagagcagctttgtctttgagaatattacgtataacatccatgactttctgtatatcaggcctgaatttttctcccaaggggagggccatgagacctacaaggctggaaggaatgtgggtctaaaaccttatgcagtctgccatctgctgagtgttcatggtcctgctggatcaaggaaagctaatccagaatcgacaaaagtgaaagtaagaaggttttaccgacctgatgacatttcatcaacaaaagcctactcatcagacatccgagaggtttgccttttttccatcatctgcatcattggcaatactgtgatttcacctaaacctatcttttttggcctttggtatttgattgttgtgtactttgtgatttgatccaggtgtactacagtgaagatataataagtgtacctgtggtgatgatagagggaaaatgtgaggttcgactgaaggatgaccttccaaattcagatcttccagcggtggttgaacatgtcttttgttgtgaatatttatatgatcctgctaatggagctctcaaacaggtcagctactgccaaatttttcttcagaatccctagttatctgcattgtttccactgggagatgtctttgtattattgaccgagcttgtcttgcatgatctttaaccagctaccgcccaatgttagacttgtgacactgacaaggaaggtacctgcttcaaaaaagaacaaaggaaagcaaatttgtgacattgagctaggtggttcagacaaaccaaaggatgggcaatcagagaactgtcttgcaacacttgacatttttgctggttgtggaggtttatctgaaggattgcagcgatcaggtatgctttgctcatgtagatgttgcttcataggaacattttgactccagttaccttctgaccattggattgtacaggattgtcacttactaaatgggctattgaatatgaagaacctgctggggatgcatttggtgaaaaccatccagaagctgcagtatttgtcgaaaactgcaatgtgattctgaagtacgccatttttgtttaccctctttgatatgcttatcatgtatatgtaaattgtatcttcagcacgtatctctatacgatcatgcagggcaattatggacaagtgtggtgattctgatgattgcatctccacttctgaggctgctgaacgagcagctaaactttctgaggacaagattaagaatctgcccgtgcctggcgaagtagaattcataaatggtggccctccgtgtcaggtcagttgctatgtggcttttgcctgtataccagggagctcctaacaacacattcgacattgcaagccaattgcttgaccttttgacctatccttttttagggtttttctgggatgaacagattcaatcaaagtccctggagcaaagtccagtgcgagatgatcttagcattcctgtcatttgcggagtatttccgtcctagattctttctcttagaaaatgttaggaactttgtctcgttcaacaaaggacagaccttcagattgacactggcatcactcctggagatgggataccaggtgcttgacacttcctcttcacttgtgcttgtgctatagcatttccatttctgtatacattctaaccttgtttacatgttcttaggtccgatttggaattttagaggcaggggcttatggtgttgcgcagtccaggaaaagggcattcatttgggccgctgcacctggagagactcttccagagtggcctgaaccaatgcacgtctttgctagccctgagctgaaaataactctacctgatggcaagttctacgccgctgtcaagagcaccgctgcaggagcccctttccgctcaattacagttcgagatacaattggggatctaccagctgtggaaaatggcgccggcaaaccaacaattcaggtataccctacatatcgcactagcttcactcgccaagttctcctgttcttaagctgccgctttatgtcagttgaataaactttgtatgatgtgctacagtacggaagcggtcctgtgtcttggttccagaagaagattagaagcgacatggcttcactgaatgaccacatatctaaagagatgaatgagctgaacctcataagatgcaagcacattccaaagcgcccaggttgcgactggcatgacctgccagatgaaaaggtactaacatttggccctctaattaacttctcctgcctcctgttttatttttaaactctgtaaacaccaattactgttcattgactgtgcaagtacaggtgaagctgtccacagggcagatggtggacttgatcccttggtgcttgcccaacacagccaaaaggcacaatcagtggaaaggactgtacggtaggttggactgggagggcaatttccccacttctgtaacggatcctcagccaatggggaaggtcggcatgtgcttccatcctgagcaggacaggatcattactgtccgtgaatgtgctcgatcccaggtacacataccaattttcacaccccatacattcactgctgcaacaggttaatgatgcttaactaatcatcaagtcattgactaacccaaacaaacaaattttcaggaagttttatccttcaaagtaaatttagtactacattttgtctcaatcagcactgtagcagtagatttagttctttaaccataaatcaatggatatattgtcatctctcttttcggcagaactgctttgtccattccttcttgaacctgttcaaacatgcattcattctaccgagatgccattattgcatctgcaactttgttgccctttttctgaatcttctgatctgtttctgaatcttctgatctgttcctacatgacactgtcaccattgtatgcacgcagggcttccccgatagctaccgtttcgctggcaacatccagaacaagcacaggcagatcgggaatgccgtgccaccgccccttgcctatgccctcgggaggaagctcaagcaagccatcgacgccaagcgttgagtggcttttaacttcactgcatcgccctcattttttggtcggtccaaataggtttaactaagcattacagttttctatattttgtgagcaattggactcctaaaattaattctgggatggttacatggattaccttttgtatatctaacttgctggtaggactctgataccatcaagatattggttcatagaactatagaagttcagaagagaatcatagcactgggggggggggggatagaaagcttttgtaaacagtacaactcttattaatatgactgcaatatgatgaggattagcataatcagaattaattctcgttttccagagttgtgtattggcaaactggcaatatcagcttttgtgctaggcaaacatgtccctgcttcaaggtcagttgccacttgataatatacagctttcttacacagctaattttttcaaaataaatccttttcttgacctgttggtttattcatatgaacattcgatgtattgcattttgatcttgatgttatgttcagttcacaacttgatttttctttctttctttttattttgagaagggaaggatggatggcttacagttaggcaggctgacaattttcctccaaagcaacttgaaatcatcataatcagcccaaaaaattcacccaaatgagcatactacatcaaacaaatgtaaaactcccttgaaaaatgaaaacgaaaattctatacacaacattgcaagctacagaaatccaagaacacaagcacaagatcagaatcacatcaagaatcctcttagaagaagaaaaaaaaacaccttcgtctcatctcatttcagtgtgttgatgcttcttcatcttgggagcgcgtagccgccataggagctccccatgaaggacgatccgtcgtacgcgtccctctcgtcgaggtacacgttcatccggaacgcggcgtgcgcgccgatggcggcggcggcgaggacgagcgagacgagcaggttgaggccggcgcgggagagcgcgacggcgaggacggtggcgacggagagggcggcgagcacgacgcggtcgtcgacctcgcggcccatgcaggcgagcggcggctcgccgtcgccgcggccgaagtagaggccgagccaggcggcgaaaagcgcgaggaaggcgagcatggagaccgggcggtagacgaggccgaggaagacgagcacgagcgccggagcgcgtagttggcgcggaagtaggctaggtttcgccgcgcccgcgccctcgcctccccgcagctctccgggcgcgagaacgccgtcgcgtcgagcacctccctccacgccctcggcctccccgccgcggcgcccgccaccgaccttgcccgcgagaagaacgccaccccggccttcgccgccgtcgcgggcgacggcgagggcgccgacgtcgccgtctacccgtccccgcccaccaccacctcctcgcgcttcaggggaggcgccgccgccgccgccgccggcgggacggtgccgtagcgcgaccatgaggcggtggaggcggccatggcgaaggcgaaccctaggctgcgatcggagtggatctaggaggccgcggattctagctggaggagacgaggaggggaaatgatttggaagctgtttttttttctttgaataaagaactaaagatccaaattgcaattggggatttgcgagttggagggggtttatttatttaaggagtagctcgatcggcatcaagtgggaaagtggcttgttgttgttgtatcgtcggcagatgaaatcgggcggaattaatgtgtgcttcaagtgcgatggaccgtgaatgtgtctatcaagaggacatatggcgtgttagcgttgagcatctactcatgtcacatgcaacaccatgtctcttagaaagccgggtttcaaaattctatattttcttaaagttaataaaaaccttattgatctcaatcaattatattaaggtgataaaattactccgagaacactttctatctctgcatagctaaaatgcacataaccaaaacatacacccacacaacaaaagaaagagatcatatggagtattaaggatcataaaaaattatgtatttaaaaagtgttcaataaatcggtcaattcttttaataaaaaaattaacatagtaacattacttttttaattatgtcggtttttgtcgtgaaatcacttaggagctataattgttcggtggtcgcgttcacatcttgtgaaagattcgtgtctctcaaattctagttaaagtttactcatataaatttcatatagaacaatttaattttccataggaacaggaaaaaccgtagcatacgaaatagtactaggaccttgtctgtttttcgtcgagttgttgtcaagcctatatcatcacagtgcatttgctaacgaggatctgaacactcattccatacacaccgaatatccaaggcatcactcttagtacacaccacgaaatgcctcaaaaattatccacaggaatcctattttctccaggcaatataaacagttaaacacgttgtggcattttatatttttttcagcacagtttgtttgcttgacagcgccaatcatgtccggccatggcaccctaatgttgggtgattccggacaagagagaaacgtccaccaccactaccattttggattttgtacacttgcacgttgaactgatcttcatctttcccgtgtcccaaccgatgtaccaacacacatccatccatccagatctctgcagatcagattggacagcagcaacagaagaagggatcgaggcacgcttttcgcagcctcatcacgccgcgaaatgggcgaggatgacacacacaccatgtgcgtgccggccccgtcacccaaacgccgtccaaagagatgtagaaagacggccccgagcccacgatgctatagtaatactttgaccatttgtttaatagatgacgctgttgattttttctcatatgtttgaccatttatcttatttaaaaattttacgtaattataatttattttgttatgagttgttttatcactcatagtactttaagtgtgatttatatcttttacatttacataaaatttttgaataagatgaatggtcaaacatgtgaaaaaaagtcaacggcgtcatctattaaaaaatggagggagtactgctcctttcgtccaaaaatataatactccatctgttctaaattaatgatctctttaagatttatcacaatagagtaatacttgttccctcaatcacttttaattcaaaaatttctcttttctaccctcaatcatcctctcacatccaaccacacataatttaacaaaggacggtataatttctttcttaaaccttaatccatactaaacactttagaacgacatctaacatggaacgaggtagtacttatttttctcatcaaaactaaggagtaattaacccatctaccatgtaacaaaagcaatgaacggtagtattgtatacacatgtatcatgtatgtaatcaataagtagtagtaaaataacttcttgggttccaatcaacaatttaatttagcacataaaaattacaaatatatcttaaacttttgaaaaaaccaagaaataaaatagatattgtacttttggatagagagattaacaaaccatgcaaaacgtgccgagatcgcttgtcattttttttggttcaaaaggctgcctcgacttgttcgccgctgatacttcaaattttggggtatttatcgtgattttctaatctcaattacaagctcacacgtctagccatacatagtgatatacttaatactccctccgtaggaacatataagtactcatagagattaaggatgaaaagaaaaaaaatacgatgtctcttttaaaactatagggtttgggaaagttgggcgatgattgatggtaagattatttagtaaaaaaataaaatagaaggtaggtggtaggtgaagtaatacctataaatatttgtattcgccgttaaatattaaaacctctaaaatgtcaaaatgcttatatttaaaatcagggtagtctaacaagaaaatgtcgtctagtaggccagccgaaaaccctaggtgtttctcaaattgagacacattccaagttaacatatgagcttcactattcgaatcctgaacttgatactattcgaatcctgaacttgatgacaaaaatcaacaaaccctagagaatttgaccttacattaatctactggacttcttcaaattgttaaccacttcaagacaatcagaaacaaccttacgccgtcggaatccagagtctaaagccgacgaaattgcctcattgcaagccaaatcaggattcagtgaacttatttgcatgaaagccaaatttgggcctttttgcttgcctgcgttttattgggctccaaattttctacagcacatctccaagcctctcaggccttttctggccaacgctcaaatctcggcctaatctctaaaagatgggccgtaatttcggccttccaaaacgacctcgaagtttattgaacagaaagttgaaagttaaggtccgttcagattgtagccaaaataaacctagcaagatggtaatattatcaaaattttgacatgatttcttatttatttagcaaatttagcaacaaactaaacgtagatatttttttgataactttgctaaaaaaatggtatggttgaaaatgacgtcaaagtgaacagatccttattttaattgaactattcgtactaagataagctgtattgttcaacaaattaatgggagacctacactttgattgattgttattgtatcctacaacgtgtaagtgctctatgttttttttcctccactacctggggtatatttatgggttcaaattatgccatgtattcaatcatatcatcagttaaaaggaggttggcttcgataaaaaaaatggagaatttcatatggaattgtttgtgactgacactggtggagatgacggctggaatcgaacagcaagccgatgatatagtatttccaccaaacaaaaacaaatgaaatttctgttgacttccaaaatgttgatccattcatctgccagtgagctggcaaaaaaaatacagccaaagcgacttattcaattcagtttttatttctcccaaaaataatgccttactgaattttagtgtctaagacttgcagtcataatcctataaataaaacagctataatggtttttaaaggaaaatgtttatgagctcatcaacttctttcaagtccctgtacttgataatgagcataaaatacttgaaactgcagaaaagtttagttccatgtccacacttcagtttcaatgttaacaaaaaaaaatataaaagcaaagtcaaatagcatccagaccgtccatcctaccgacggctgtgatcacttgatcaggagcagtctcgttgactttgctaaaattttattccaatggtgttcctcctctcactcccagatggaattctatactccccgaattacttcctgcacaagtgaaggacccaatgagatttcatttgccatcatataatggtagtattctcctcctcctctataaaatctcaccaagatcttattcataaactttttcctacgccaccatttcttgcaatcttgcagcttttcatctcttgttcctcctagattttcatagagaaatctgtttcatccaatcttacaaagctccttttttttttcttttttcattttcttggtcaaatttgttcttcatctttgatcaattcagttactatttactacctatgatctgctcatttctgctagaattcattgatttctcagctgaaaaacactcactgttccattgcaacaccaagggtgcttgaattttactcggttttcgccatggatggggtggaggaggcgaacatggcggcggtggagagctcgaagaagctcgtggccatcctgtccaagtccggcgacccgttccggctgatggcggccgtcgcggagaccgacgaggcggtgtcaaggttcggcaaggtggtcaccatcctcagcaacagggtcggccatgcgagggcgaggcttggcaagaggaggagctcgccgccggttgatccgggctgcctcatggaccacccgttggcggcggcggcgagctctcctgctcccagcaatggccgcctccatttcagtagtagtgctgctactgcgtcgccgtctccggcaacggcggcggcggcttcctccgccgcgaacgtcacgccggcggtggttgaccggagcttgtttcttgagacgacgctcttggatttgaacagtcgcggcgctcctgctccagctgcatccatggcggcggctgccaagaacagctcgaagcttgcacctgcacccatggtgaacagctcctcctccgcaaatcacatccagttccagcagccgatgaagagctttcagttcgagcagacgccgatcagcgacaagttccacatcgagatgccgagaggcgtcggcggcggcggagggaaggaggtgatcagcttcagcttcgacaactcggtgtgcacctcgtcggcggcgacctccttcttcacctccatcagcagccagctcatcagcatgtccgacgccgccaccaactccgccgcggctgcggcggcgccgacgaccaagaagccgtcgtcgtgcgccaggaaggccaccgccgacgacgacgccggcggcaaatgccattgcccaaagaagaagtccgtgtcaatctcgccaccgtttctcggccatttctgccatgatcttgaccgtgttcttgcttccgatttcttcgcaggaaacccagggagaagaaggtggtcaccgtgccggcgatcagcgacaaggtcgccgatataccttcggacaattattcttggagaaaatatggtcagaaaccaatcaaaggctctcctcatccaaggtagtaaatctcactactaagaacaattaatcatctcaaaattcagtcatagcttcataatactcgttcatctcagttactgctactgatcaacttctttgcaattccaattactatgatcagtttcaacttaagacaagaataaccatctcattatcatctttaaaagacaatagctaatgatcaacttatctgtcatgcctattaatacggccacttccaactgatctgcaatctgtaccctgtactctgcttaatcatgatcaaatgttcagatgaaaaaaattagacaaatttgatgagattgattgtgtttgggtttgatgcaggggatactacaggtgcagcagcaagaaggattgcccggcgaggaagcacgtcgagaggtgtcgcagcgacccggcgatgctgctcgtcacctacgagaacgaacacaaccacgcgcagccgctcgatctctccgtagtgcagcaagccaccgctaatccccagacctgatgatccttagcttaatcaccatccgtgtatctatcagcatcactgcaaatgcaaatgcaaatgcaaatataggattctggaaatctgaacttgtccatgaacagctacttggtaatatcaaatttgtgactagcttgttatgtttgatcatgtacgagtagtagctctaaaaacgtataaatgcggacgctcatataaaagtgcacactcacaattatgaacacacatacatatatacagattaacgaagccaccaaatacgtctatcatgtttaagtcttaacagtttctaccacatcaaaaccagctgagttacgctcagttcgcactcactgatttctctttctggaagttgcaacgcacaattcgtcaattcctagtgtgtctctttccgtctgatgtgtagatgtcaagcatgagtgtggttcgaggggaatgaacagatctaaactgctgaatcattgcaaattctagatgcaaacatcaatgattagtgtggctaattgcatttcgtttctgagagatcaacgtgcggttaagcgcgtttcttgggcccttattgtactctgccaccaaccgattcatgtgatctgtttgttactgatgagtcacgataacactgacacttcggtgttttgagaaatgtgtttttctgccgattcctagagaaaacgaaccgtttctcgtcaaattcttgcaaattttatttgaaacttaacccttaaccgaattataaatgtagatagctggatactatcgcattctgaataatacaacggtgctgggtggttgcatggcaagcattggatagccttaatctaatttgcccaatagacttctatatttttttcaatacaggttatacagcatatagattataaaaaaaaacacaagtgaatcacattgcagccgcaaaccggccctaaatagctagattaatatccaaatcaagatactaaacacttgctcatgctaaattccaaccctagatcaactaggttcatcatgtgaggtgatctacctggagctgcttatgacacccacaagagaaactagctggaaacattgacaaaatccaatttaattccatccaggcatggtgttttcacagatgaaacatatatattcagttaaacaaaaagcagatgacagagatgctaatctgtctcgatcagtctctgacaaaaccacatgaagggaaatcaaatcaacaaagtcattaaggcattaaatgcacctcccacaaagagcgccgataattagtggtgctaagcatgtgcacccgtgcaacttagcttatcaattggcaggactgatcgagctggccaaacaattatttcggctaggattaagcttaattatattttagttgtttgtttaactggaactcgtgcgtgctcatgtgattgattttctgcgagctcaaatctcttccagggtgaacaaatctaaatctagccttgttaaataggagtacttatatatcagacaagttcagagctaatgcgacgtccatatgggcttcgaaatatgattagttgatgtgttccttaatgttctttatttagctcagttgctttaccctcgactttttatgccttgattaccttgatgagaagcatatgggcttcgaaatatgattagttgatgtgttctgtgcttaatgttctttatttagcttagttgctttaccctcaacattttatgccttgattaccttgatgagaactgctcagatatgaacttgctcaggatataaactgtgcctatatacggtatagcaacaatcatggcctttggacaatttgaaatgggccttcatattatgcttacacccaagtttcagcatgttttccagtgtatcagtgcaagaattgagtgttcttgataaatttttgcaacccttaggcctacagtacgttgcagttgcagatccgagagcgaacaagcacgatcttcaggacaagctaataagggcatgtttttcacagctcaagaacaatcttcaggacaagctactaagggcatggttggcacagtttcacagaaaaggagtaaaggaagtgctctcagaaaatgaattggcatagctctagctccagcctcacctgtcctgaagctggaacccaaccaaaagaaacggtttcagctccaccaaaaaaaaagggttaagtagactggggtgctctagattcagagagctccacaactgcactccaaacacaacttcaagattaaacttaagagttgaaatcctaccaaccaagccctcaagtaaattctatccaccagaatcattggttcatgccataggtaggttaacacctcatcatcagggatgacagaacactggttcagttcaacggatgataattgcaatagaaataacatgtttggatataacttcaaaatatctggggaaataacatcagattaaccaaggttcaaaaagtggctgctcggtggacacgctattaataaagtactttggagttccttgttcgacagctcaagctacatactggaagcgcaaacagctgcagatgatctctcacttgagagggataaaccgtgaggagtgggtagcaccaataccaggcctaccgtgcttgactggcttgtacgagatggagaactctgcgaggtagtggccaatcatctcaggcttgatctcaacctggttgaaggtcttgccgttgtagacaccgacgatgcttccgatcatctcaggcacaatgatcatgttcctgaggtgggtcctcacaggctctggcttctcaccagcaggtgcatcctttttctgtttgcaagaattttacaagagaacagaagattagcaacctactagttaagtttgcgtgcaaagcgaacataaagacaagatgattgtctgaaaaatggcataaaagaaccagtaaaggcagagaggattggaggaaacaaaaaaaaaagaatgcactaatagaactcaatataccccacactcatacaagcttcacccagatactttgctgaaccagccagagagtaaaaagaccagagttagctaaattttttaatctaccagcaagaaccacattctagcaaaaatatccacaaaagcaacagttcttatatagactttatacatcacacctacataactcactacaaagtaacttccagcttcatagaaacctagtctgaagacagtaccttcaaaattactgccctgatagaataacgacacgccaactaacatttttcagaaccaaaagggtaaaaagactaactaagctagcaagcatggaaatgtgagacccaaatagcaaggaaacagtaataaatactccctccgttccatattactttttggattgaaatttgacagtttatagaaacatgttttccacaacaccaaactagtttcatcaagtccaccatttcccaaaacatgtctatagtatatttgctttgttttgggaatattgctaattttttctacaaacccaacacatcctgtaatatatagaacaaagggagtacaccgcgacaaataacctaaaaccccatgatttggtggtattaataattcactaagaaaatatcagaaaccagactttgtggagtgcaggaaaaaaataaagcagacaagccagaacaattaatgtgaaaacaatacgtaacacaaaaatactgcgttcctccaactgacaaactaaaaacaaaaaaaatacccacagcataacctataataaaactgagacactaaaaattgtggcaaaactactgccaacatgttaagttgccacaaacaagctctgggtagatttaaagcactggaatgaaccatgttataggtttcaacatttccagtgcaaatacacaaaacaaattaatgtcagcgcattaacagaaagtgaataataaatatatacaaatcatatatcaaacatgtaaccaaaaaaagtgttgttctgcatcagttattcattgctaaatgctaaaagcaagtccagaggcatacattatggtaaataacaattccaacctctaaagactgcatcaaatcagccttacatttccaaaggcaaatttgcattgaattgtaaaacctaaatgccgacccaccacagcattcttttgagcgagtgcagtattaaaacaggcagttagtagcactacggtacgaaatctaaagagacgcacaatcaagttacagatccccaaaatataaaaatagcaagataaatacttaacacataagatctgtatcgattccacattttaacaaactttccatcaactcagaacaaatgactgatgagtatatcaacactcaccgccttgcggagcttcttgatgagcgccatgggcttcctcttcaggcccctctggaacctatcgaaaccaaaaggcacacaacacatcagatcaaagccacccaaccacaaacaattgcaagcattccagcgacgattcaaccttctgcgggcgcgcgcggggaagagctggacgaggtcgtcggtggacatgtcgaggagcgcgtcgaggtccacgccgcggtagctgtacttgcggaacgtcctcttcttcggcgctccggccgcggccacctccgcctcgacctcgacatccgcctaccaccaccacccaaaaaaaaaaaaaacaccaccacgcgcggcgtcaggcatcacgagcgaacgcgccgacacgcggctagggttgcgggagaggcggcgactcaccattgttgaaggggttggggagagctggagctcgaggcgaggggtcggaggcgcgagctgcttggatgaggaggaggagacggcggcggcggcggttagggtttgggggaagagctctcggaagcttatatagtggttggtggtgcgcgtcaagggctgtttgagtgggctaggcccacgtgttccggcccggcctggcctggcccatttcgacgctgtaacgaggccttccgctgcaagcctgcagactcgggcccagagtgaacgctgccgctcgtggtcagcggcgttgtgttgacattttgcttttctatttgaaaaaagaagacgaattgcatggtttgctttgtgcactggacggttgcgtcagctagattccgtactttaaaatactgtgtaaatggatggattaacatccaatccggttacttgcagaaaagaaagttgcgaccctggtttcacaataccagcagattcaatctcttgactatggtatgtatgcaaaatagtatattatggataagtggatttttatatgaaacagtgcagtccaggtagaattcatgtgtagaccatcgttccaaatctggcatggatgtgaatggcgtggaaatggatgctaggttcctcttaccatttttggcgtggtaaccacgagataaaccgtggttttaaaaattgaaaagattaccgtgcatggtaaccgcgataactgcgcggttttgtaaaccctgtttaggtctcaaattcagcatcgcttcctaaccgttgccagcacctccaacaagccctatgtccgctcctcgtcttgctcattaaaagagcgtcgggtctgactttaggttggatccttcctctccagttgccactagcacagccaccaagcttgtcattgtcgtactagctagagccacctcccaatccacatggttcgatttaggcctataaaccgacgatttagcagccactgcccctagggtcattgccactaccatgccgaaaagcaccgccacaatagtcatcaccctcaccgtcacacagtcagatatggatgaaaagtttccactagtagccactgctcctagggccatcacctgtaccaccaccatcattgtccacaccaacacgccgtaaagacaatactgtcccatcatcactcagtcaaatctaggtgtagaacccccattggtagtcattgtccctaggctcaccactatcagggagccacacaaaaccgcgcgattaccatgcacggtaaccttttcagtttttaaaaccacggtatctctcggggttaccgcgcggtttcgcgataaccaccttgccgtgggggtccaataaccacgccaaaaacggtaagggaaccctagggccaacactgatgagcatgttgctatgtcgagacaaccttgttatcgtccatgtacccttgcaacctaatctgggcactgctctgtccactcctcagtgccgagaagcctaccaacgcaaccacttgcgccgccatgcgactagatctaggcacgaagacccaaaattcgacaaccaccacctcaggctccactgagacatccaccaagaagcctagccaacattgttcttaccgttgtacggacgcacgacaactggtttaaacggcggccgcactaccagaaaactaattttcccaagcggccaaaactaattttcgcaggcagaaggaaggtccgcctgcaacacaacgtcgattttcgcagtcggggcaacggtccgcctgcgaaaatgcaaaaaaacgaacaaaaaaaatcgccgcacgcggctcgccgccgccgccacgcctcgccctcctccccggccggatctgagaggggaggggaggggagt

SEQ ID NO: 59448 - DNA, 2171 bp, Oryza sativa
gtgagacgaacctgcgagggggtcggttgaatggccaccttggaggagaaatcaggttcccccggcatggttccgtctcccccgtcttgcggagccgtttcttcttgcgctccccctcgggctgcgacgtcggcgcggccccctccgggcgccgactggtggcacgcgccgccccgccccctcggggaggagatgggggaggtgttcctcccagcttcctcttcccctgggcgtcggcagggcggctttttcccgagcccccggcgcggggcccaggagcacgactccctcctggggcagattgttcccctcggcggcgctcgcccgcgccatcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctactggtgcccgccagctggagacctgtgccgggggctggcttggaagtcggaggcgcgcttcgttggtgaggggggtgtagaaccagtcgctcttccagtcgtcccacttcttgcgaaggacgcaggggatgtagcggttcagcaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacgaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgacccccttaaggaagtctgcgccacatatatgggataagtgagcacagctgtgctcacctaacagcatttattgcagtctggtcaagcgtgtcacgctgcatgcagcgcagtacggcgcgtt

SEQ ID NO: 59449 - DNA, 74098 bp, Oryza sativa
cccgcgcgcgttgtcactgccgacaccaccgccccacgccgtcttcgccgccgtcacccccgccggcctcccccctcccttctccggccatatctgggagggagggggcgaggggagccgccgccgccggccgcgccttgccgtccccgccgcgccgccgcatgcagtcgccgtccccgctgcgccaccgttccctccgcaccgctagagaggagaggagaggagagtgagggagagggatctgagggagagaggtgagggagaggataagtgagggagagaatgagacttagaaaaaaactactccagcctagtctattaatattgctcctcattttcacaggcggaccatataaggtgcgcctgcgaaaatcattttcgtaggcgccgcttaagtggtccgcgtgcgaaaatagattttcgtaggcggacagcgaacatcaccccaatttatatttttgtaggcggtcatttgtcttcaaaaatcagatccgactgcgaaaataagacccccaacgttagggaaaatgttttttctagtagtgccggtgaggcggaaggcgttggagatggtaaactataacaaatgaaagtgcttctgtttatagcagaaagtgcagtcggtattattaccccaaaacgcgattaatttactttgtggtaacaaaaaaagagagaagaatttactcgatcggtccttttccaagtctatcgcgtgatcgactgtaaacaacaaatccacaatcacatccaatccaaggctgtagaagtaagaaatgtaggccgtagaaacgcagcaaccaacacggctaagatacatacatgatacacatgtggccatgggtagagcaggctagcaagcagttctatgaaccaacccgacatgcacggcagcaaaccgagcaagacgcagctagtggttctccctgcgaaagcggcactggtttttgctatcagatgcatcgcagttgtgcaaacaagtcaccgtttcatcagttgcgtcatgtcagaaaagaaaacaagtttatcccatcataactaggtataacaaatctaaccttttttttaacaaaggtacaatctatcattaacaggctataacactctctttgtttagactaacaagccagtttatgagcccgccgctgagcgctcgaggtagccaagcctgccaccgttggccagtgagagagaggagaggactggaggtgagagagagatagaaagaagataaggatgatacttgaaaattttttaaacattgaaatggaataaggaggtaagttcgacttctgggtgggtccttaagagattcgtctgcgaaaatagactcattttctatacgggtacgctgagaggttcgtctaaaaaatcgatttttacatacgggtctcttaaaaagccatatgcgataatagatgtcgatctttatatacgtgactaattataatctacatgccatctaaaggggtctcgtccagtaaaccgtttccgtagtacgtcgaatctaaatggaagaaacaaccctcacaaataacaagaggtagttgacagatttctcaactattaggaggtagccgttcactattacacgattgattttcctggacgcccactctttttgtttccatgcggtccgtaagtggaaccgcatggaaaaatagggaaccggcgctggggtatcggccgcatgggaaaattgattttcccgtgcaggcgtcctatcccaaccgcacgggatattcctccctcctttccctcccatccacttcaaatttttcatatctcctcctttttcccttttattctctctcaaccactctcacctaaccaggtccgtaccttatctcttgtcaatcggctcccacctctctctctctaccttatctcttctcaaccttttttcaacccctgaaccggtcggcttcccctcctcctccccctcccctgggagaggcggcagctaggcgaggcggtggccgggcgcggcggcggcctgggcgaggcggccaagccgaggtggcggctgggcgaggcggcggccgggcacagcggcggcctggggctccttgacgctcccaccccgctcgtcgctaactacgttctccaccaacctgcggccaccaccaccaccagacgttccaccgactcggtggcgtctttcctgtccggcatggccacgctcggtgccaagctggtcacggtggtcgaggaggaaggcgaagcggaggaggacgacggcgacttggccggcgacgctgcagcggccgggcgcggcggggagcagcgaggcgctggtgcccaggcgatttttccttttttttttggttccgtgcaggcggtataacacaaccgcacgggataatcgattatcccgtgcggtcggtccacccgcgcgcgaaaatactgattttcgtagacagccggctgcagcgggccggacaaccgcacgaaaaaaatcaaaatgctcgtatgaaaaaatcttatctgtagtagtggttgttcttcgtcgcatgctaaataatggtattatatatgttaaatcaaattataaccgagtctctgtccctttgttcttcgtcaacaacgtctaataatgatcaacgaagacgatatggaagtggcggatccagcatgggggcgacggggtctcgagcccccactactggcgtgaagactacgagagaccccacgaagaccccactaaaattttttaccatatgtagataaaaggagggactgtaattttatctagtttgttcagactccactgctatttatttctggatccgtcacttcatatggtggagactagcaggaggaaaaaaaatctcatgcggccatgccagatgctctgtacatgcatgacatacatacataacccgagagagataaaggtgtagtagttctcttttgcgcacagccactcaacttccaccggtgatacggggtggggcaaaattgatcgaaaccaaaagaacgaaccgaaaagatttaagtctaaaaaaataggtcccgactaatcaaattttatttggtcatcatccttcatcctcggaaagattgagtctaaaaagttaggtctcgactaatcgaattttatttggtcatcatcctcggttaaccaaacaaaatttctcggtatctgccattgcctaccatccagagtgtcctggttgatttagcgattgatttctattagagatgggctgcttctgcctgtcggctgccgtacgtcccgacgcccgacggtctgaccgcgacgagtcaccgacgattacatccatggattcatgcaatttatacatgtactctagtctagtccagtccagccctgggatataaatccagtgcataactgcttgttttagctgtgattcgtgtgaatctttgtatcctaaaactgtcatatgcaactaatttggtcacaaccgagaccgaattgattgatctcgattattttgtaatgtaatttggtcttcagttttggataatcgaaatttcctaaaagacgaaagaccaaccccaagatgatgctatcagctatccattgtcagtagcagatccaggaacttttctaagcctgagaagcatgacgacggataacaagtatatgcaaagattatccacatatgcaatgtttatatatagaacacacacgagagaagatgtgctcgcaattgatgccactgttactgcatgatgtcgaaccatccgttgaatgaaccaaaatgggcctcattaggcacaacgcgtccagactcgatcatctgccaagctaatgccagcttgtgcgctagcttgttttcctgtgaaacccatggatttgcctatagcatcaccggtggagcaaagcaaaagctccatagctatccggtgctgttgggccctaattctacccttgtccactaccacgacacaagtttatcgatttatcccatgaaaaacacaacacatcgaggcctagaggttggcgatgggtgggcgacgggaaaggcaggcgacgccagtaatggagtggcggaggaagaggagtgaagtcttttatccactcatatggatgtccaccatgggccgggttagatgtcacgcgaatgcactaagattggtgcgtacacatatactccctctgtactcataaaggaagtcgtttaggacaatgtttaagtcaaaccttgggaatataaatcatgaataactctcaagttgttgagtttgaaaatgtaaaaattatatgaatagatttgttttgaaaaatactttcataaaagtatacatatatcacttttcaataaatatttttatagaaacaagaaattaaagttgtgttttggagaccgtgtcgctgtcctaaatgacttcctttatgagtatggagggagtactccacacgaggaagatgccatgcactcggcggtcgtgggtgctagccccgatcctcagagtcctctacttgttttattttagataatgaattttcattaatccggtctctatatccatgaagaatatactcggccaaaaaaataataatacaagtgcacttagactcataccttaacaagaggagaacacacaactaagagaaaaaattacaaccctggcaaacacatgtttccagacatacttttatgaaacggccaaatttgacgagtgaaagtcatctagacgctgctgcctctagtgcatcttcgttgtgaacagttggtaccatcttcatctgtttcgggtgagctgatgccatgcgccaccggatagcccatctttatctgtcgtcatccaatcagaactagcctgacgagacgcgagtcgacgggatacactttcgctttattagattgctaggtctccgctgcccatagggccgtcactgtcgtaaggatcctcttctgcctcccagactcccagcccgccaccacccctagggccgccacctctgctagagtccacatatttttgtcgaaatctcagtcctccaccactgtcgctgaggataacctcttccaccaggaatcccatgcctccgccgcccttagggttgccaccgctaatgggatccacctctgcctcttcctccccaagaaccttgtgccaacgcacaggccaccgccaccgccgccaaggagatcctttccgcctgtcttggggaggtccccactgcctgtgggactacctccgcctaaaccaccttctccatgccgaggattggccgtcaaagctcaggccgctgccgtcctccgccacccctgccatcggtcgaaggggcgccgctgccgactcctcgctagtcgccgctacccgtcgccctcccaccacttccgctgtcgtcaccaacaaccacagccaagcgtaggcttggtcgcctccgccgtccatgctctccttcgcaccgctctaaccaagcagcaacgaccaggacgagaaggcacatatccaagtgagggaacgccagatctggcctcatcagctcgtgtcgcgcctcgccgactgccacaatgcctgtatctttcagaaggaattttaccatcattgatacctcctagtacctgccagtacactatgtatctgaaccatccgtttgatttgatctaacggttcataaagaacggtaccaggaggtactgcctagtgagaaacgaaggttggttcaagtactaactgtgaaagggcagctatgtaattggagtaagaacttatctctcccatccctctctgttctctcttccctaccgaccaaacagcccgtggtggctctcgttgaggtcatggccgatggaaggggccatctatacgagaagaggatgatggtgtccaagtcgtctgatgttgcaaggggcttcatgtcacctcccgctagagatccaagtgccatgatgtcctctttatctcttccacctgatccatctcacccgcctgcaaatggaggccaagcaataagttgccctagtgagctcccttacatgcaacgagctactacccccatagtatccacagttatctgaatccgaatgtagcaacaaccatgctaaaaaacgatgattcggcagatatctctttcttgtaataacgctatagtagtctcttttacttgatataatataatcagctctgttgcgcaaaaaggaatatgagaatttaccgcctccttaaaatttttataaatctattgtaaaccacatatccaaaatcacatccaagattgtagtaccaagcgataacgacataacatatataggccacataaatacataatataagcaataacatgagtcactaacatgtaggcccattaaatatatggtccatatcggcagctcaaaattagaggttcgcactgtagaaaatctgttcacggacacgtgtcgaaagttagaggattgtaccgtagaaaatccgtttacggacacgtgtcaagtgtcgaccacaacatatgtacagtcatcgtgccattggtagcaacgctagcagcagtcctatgaacacgacatggaccggtagcaaaccgagcaaacggtgtagtactacatatatgtcgttctccctgccaaaagcaacacgtagtcacattgctgcagttgccctaatgccgcgatcagatgcaatgcaaaccagcccccgaaaaaaaaagttacaaaccaaagtatatcccagataggagtacgtcgcaagctgaatggacatttacatttctgggtaacatagaatacagatagcttaatcatcatgttcgttcgatgtcgctggaccctgttactgaaagcggcctcttccaaaaaaaaaaaaaaagaactttcgatcgaagcgtgcagcttcaattgctcattttgctcgacgagaagagaaaaaaaatggagattggaacgatgtattatgagtatccgcgaccacgagcgctgcgacatgcttcgaaatggcccctttgacatcgcgtgtgcaggagccttttacgtgcagatggggttcaccaagtgtgtagtaattaatttcggtactgaattccgaatccataaggaagaatttaaagaaactaaccctcacaaggaacagcaatatagtattcagatagattttccagcaaggagccagcagcagctcgtcaattacaggctaaattatggctttattatgctgcatctttaactaattaccaagtgcctctctgtacttttgctcttcgtcatcgtctaataatgaccaacaggagcagaaaaaaggagagaaatatcccatgctctgtagatgatgcatatataaacctgagagataataataaaggagtagttcttcttttgctcacagccactcgccttcactgcaggtgatgctatcggctatatcccactgtcacggttgcaaaaactttcctgcgacgaaaacacgaccttttccggtttaaagatgcgaattttctcgctcagattggtgataatttaactttctcgtcgcaaaacgagattgttaatttgcgcgtgcagtagcatcagtttgagctgatttggccgtaattgcagccgaattttgggcatatttgtatcacatattttaggacatacatgtttgtgtgtgcagttcagttgctgctgtttgggcgatggatttgagatgctaaaaatgggtttaagttcgggagaaacacgacgaagtgagggtgcccaggtagaaaagctagggtggtttggaacgcggtcaacctcatgtttagtgctgtcctcgctagcagccaattcatatcccgtgcagtacaaaactaaattcacaattcgaaataattcatccttgaattccatcatatcagcgagtgaaattcatatttagcaccatggcgatagtcagatggccaaccataggtttcgtgaattaaaccacagcatatcatacgggtgagctgatggtacacctgtattgccctaataccatcttgctgtatatctgttcatcgatcttgatccaaatatgatttaaccaactcgaatctgcagatcaagataaggtttatttggttttgaaaacgccaagaaatgagtctatccatatgcgtgtccagttcttggtcgcccagacccacgatgaaccgagaccatgcagctaaccgatcctgggttcggtagacaaacaagtttcgaacaggtttgagttttttctgaacttgatgtccatctttgacacgttggaaacatcggtttgatttcattttgaagcaaaagtttacaattcgttagacgttctatgtgttggaattccaatttgaccagctcatgccaacacataagaggagtactgcaccttgtgcctactttgacctcttcctgcgcaaatcgattcgtcaggacagtaacgaaatctctcaaaaagttcaaaccaactcgtaattccatcacgaatccgacgcagaattcaaactgcggtgagaaaccgacggataaatatgagcaaaatttggatacatgaagaacaggcaaactcgtatcacctggtaggcagctatgctttccccaacggcagcaacgagcttttgattactcccgtgcagattaatccggtttccgacgtgctaatgcaaatgcagctgcagggtcgccgccgagatgaccggagccaccggcggaggccatttctccggcgagacggccggcggccgcgccgccgcgggggccaaacccggggcgaactcgcacaccggcggcgagagtgctccgagggtgtgtcagttgcgccgcgttcaatccggccgtagaccatcgaaacggcggcggatcggcgaggttccaggctcgccggattcccctgctagcctgctacatcttgaccccggctagccgggatgttcgccggagcaccaccgctcgccggccggaaatcccctccaaactcacacaaatccgccgcccagaccagtccggctttgccgatcaatatctcccagaatacccaaccaaatcgaacaaatttacactcgtttgaaagccatgctccgtgcctacaatctggaaaaaaacccattcaaattggtcgatccaattcggagaaaatcgggtgcaaatccggaggagaagcacacttctggatgggtggggatgaggccgggcggccaatccaacttgaggggggcagcaatccgtggcacgggatgaggggtgcacacgaccgttggatgggttcggatcgggcggctgagattcaatgtggggcgcgtggggtggcgatccgtggggaggccgtttcggccaatcagagcgcggcgttggcgtctccccgtcatcgcgaggcatcccactatataaccaccgattcctccgccccgacctcctcacccacccaccggcgagcagctgctccgacaagcgctctctctctctctcaactccggcgaggctcacgcgcgctccgaagcttcggatagcggcagtagtcagtgcattgatggcgaccgacgtggcagcgactgagcccgaggtggcggcggaggaggctgcggccgccgcgcctgagaccacggccaccgccggggattccaagccggcgaaggaggccaaggccaagaaggccgccgcgccgaggaaggcacgctccaccgccacccacccgccgtacgccgaggtaagctttgattcgttgctgctgtttgctgtgtgttctgtggctggatctgacgtggtggttggtcggtgctcgtgcagatgatctcggaggcgatcgcgacgctgaaggagaggaccgggtcgagccagtacgcgatcggcaagttcctcgaggacaagcacaaggaccacctgccatccaacttccgcaagcagctgctcgtccagatcaagaagctcgtcgccgccggcaagctgaccaaggtcaagaactcctacaagttgccgccgacgcgcgcgccggccgcggccaagcccaaggcgaagcccgccgccgccgcaaagccgaagccgaagccgaaggccgcagctaagcccaaggcggctgccaagccgaaggccaaggctccagccaagtccaaggccgccgcgaagcctaaggcggctgccaagccagccgcgaagccgaaggcggcggctaagcccaagtctccggctaagccagccgccaagcccaaggctgcccccaaggctaaagccaagccggccgcgaagccgaaagccaaggcggctcccaagccgaaggcggcagccgtgacgaagacgaaggcgacctcggctcccgcccggaggccggcgaaggcggcgaagacgtcagccaaggacacgcccagcaagaaggcggcgccggcggccaagaagcccgccgccgcggcgaagaaggcgcccgccaagaaggccgcgccggcgaagaaggcggccgctccggcgaggaaggtgcccgcccggaaggcgaagaagtagagctctctctccggcgagcgagcaatctagggcttcatggttgttttcttagctgtttttttttctcttctctttgttgttagttgcgaggaggggtcaggggtactagcttgtaaatttgatatcgcggcgggggtacactggtcatttcgtacccaggtggtggtgcgcgacgatgatgacgacgacgacgagacagtttgtttttagggcaatgtatttctgagtagattggtggagtttttattgtggtaacaatcttgtgatatttgtcgaaatcactttagctaagtaattaattatgcagtaattttacttactgtattggcttgaccacaccctgtattcctctgaattttcagatctggaaattgaaatgaaatataggatttgtgacttggcgtgtgatttgggttcaaaacaagcatgttattgcaccgatcgtacgctgttccaaatttcaggtcgcgtgtggtaccgaactattgttcactttatgagctgtaaaaaaataaattcggtcttaaatctggatgtatctgttgtcaaatttgaatattcaatcaatgcaagtatccaaactgatattaggccccactaatttcgcttatccatttggtttatgggccttcctagtgttatcgggctttgaaacttcaaaaggcccgggcaaatttgaaacttcgagaagagagagagacgcttgtgggctgggctgcctgacaggtagcatacgtggccagccgtttcgttggacacgtggcagtctcgtcctaacggacacacgtggatgccatggacgccgcgggaggccgcctcgatttttgaaaaattgtccggaaatgtaggggtcggaaagtaagattcgctgtacataaccgccagtgtccagtgacctggaactatttggatgcgcgctccgtttggtttgaatttttttttttcacttttgaccctcttccgggcttctgctactttctctgtcctttgctttctctcttgcaagttgtgaaacttgcaattgcaatgctgctctctgtgaccttctctgctactctctcccgctgtctggcttggcctaggaggatcaacggtgtggccttttggctggcacacagaaacttgcttgttccgttaaccaaaacaagccgtttgcgtgcgtgttcgttcaatcccatgttggcattcacaggcttgtttgtttcatagcgatttttaggctatgcctcccgacacggaaaacaaaacacacgattgtagcgagattaattaagtattagccaaaaatacttaaaaaatatattaatatgatttttttaaagtaactttcatataaaaaaacttttgcaaaaaatacaccgtctagcggtttgaaaaacgtatgcgcagaaaacgcgggaagtgggttaggaaagatgggataataacagagccttatacctgtttattttcgttttgttttttttttttgcaaatggtaaggatgtggactagtaagtgatatttttttggcatttattaattatttttgcatggttagattttttttctctctccctaccacactcctgccgtacctgtatatttcatgtgactgcatctttcgtagcagtaacctttttgttatctcatgccagtagccagtgtatatctacatgactaatgaaaatattgtaggtgtaatgtgaatactcaatggctgtaagcagggtttcatttaccgccggggccgcggttaccgcgccccggcggtaagcacggttaccgcacggtaaccgcggtaaccgtgacaaaccgcgacaaaccgtacaaaatttatcaaaaattcaaattatttttcaaatttatttgaatttgacgcggttaccgcggtttaccccttaccgtacccccgcggtaaacgcggtaaccgcggtaaccgcgcggtttaccgcggtaaatgcaaccctggctgtaagcctgtaacgcctaacgaccaaggcaatctaaatctaaagaaaaggttcagaacaaatggcccagtccagaccatccattggcaaagccatctttacacatcatctcccagcccaccaagcaactggcccgttaggccgtcacctctgtccaggcctccaacccaaccacaggcctagcagtagccagatcaggtttgtttgacagaacttcaactctaaatttaacttgaaaagctggtttagagtggagtcgtggagcagttaaaacacaacttcattatttttgtgagatcactctctagctccgcttccaatcagtgatgctgaaactattggttgagctaactacaagagaggtagagctgaagctagagctctgctaaattgaccctttattaatcctagtagtcactagtcaacggaagaaaaatgcttagccaatggctaatactcccttagtgacagcacgttacatatcgaaagcacttttggtatccttaattttgcggctaattcggtcggcgtgaaaggcctacggcggcgcctaatgccagacacacgtacgcgtgctgacatatagagtacatgataattaaactattaatatgatattaaaccactcttcgtttggaaatctcaaatcctgctttatgagacttcatctgtaagctctacaagatgatctcgaaacctgatttacttggagaaagataaagcgctaattggatttggtatcaagatatcatgatacagatgcattagctacccttttgcttacatgcatgaagggctgcctttcgtgctaatcaaagaagatacaccatcatctaaggtttttattatctctcttaagatgattatgttagacaacactactgtagaaaaatcattatatactaatacttctatcacatacgtcttttagtcagtgacacatgcgactaaagtaaattagctaggcttatatgttagtgacttaaagacttaaagttatatagtgacttaagtcaaaggattcttgtcagttttttctactactctgtaataatgtatcctgatggagattatttttgcagctctcattttatagcagtgcaggattgaatccttttgttaattagtaggcactcactgatcactaatcgtcactgctatatgtgtactactaatgtaggagtacatcggttagttgttggtgattagaatttagaagtagagcactctaccaaacacgtcgtggacccaaccaaacagcggcattaaaatgcttgatcactctggaaaaaccggccaatcgagaggtgagctgctgtgaggccaacggttgaccagccgaattgtcaggtagaagcatccgatgttagagctaagggtgtggtgtgacaggtcgcctccacattgtctccccagctatgaggttttggatcttctatgccaattattgcaaaggttcattgtatcagtgctgctatcactcacctaaattttatgtattagccttgacagtatgtagataacatgttgaatggtaaatatgagggatcaaattgacactatatatttgaatagcattctgggtgtgttcggctgcaagtttctaacagctgctgaactgcatgcgtgtatgcggctgcggcgcacagccaaattgcactagccacagctgcaactgcagccgaaaaatggctgccgaacacaccctctatagtttgctagccatgtctcctgcatttagacaattagccgtataacaaaataaccaattcataagagccgtatttgtatgatagaaatttcttgaattcgccttttggtgacatcgagttcatcaaaagaaattcaacacaaaccaaacaaaatatcagatcgaatagggtagcttcattttctcgaaatgcaaaatactatattatatatgtattagcataaattaaaaatgtccaacgatgaacatttctctgcgataaaaacatgtgaatgttgcagagcataacctgtgcttttttgctggcacaaagaggagaggagcccttgatgccaacgcctcatttaagcaaaagacaatcttgatcccggaccaatcaaatcatcaagccaagaaaaatggttgatgctcagcctaacttgtcaactggtttttcagagagagaacatggatggatagtggatttcttattgattgttgatcccacgtgaatagatagtagaggaaaggtaccaaagagaaaggtaggtttaaacacatctgtgatgtggtatttcttagcgttggtaatctaaaataagtgtaattttacaccgttcatacccaacgtttgattgttcgtcttatttaatttttttttacgattagtatttttattagtattagatgataaaacatgaatagtaatatatgcgtgactaatttcttttaattttttttataaatttttgaaataagacagacgatcaaacattggacacggatacctacagctgcacttattttagaacggaggtagcatgtactctagagtagtactataattttttgagctatagtactgtggctgtgtttagatcaaagttaactttggatccaaacttctaactttttctatcatattaatatctcatacacacaattttttagtcacgtcataccaatttcaaccaaaacttccaactctagaagcaactaaccacagcctgtattagtttttcttacattttttcagctgataaattttgattttgaacggcaccgaacgcagcaaatggcatatgaatctgtgaccgtgagctgggttccaccacttacacgtgggccctcccccctcgcccacgcacacggcacacctggggactctgaagaaactctcggcccctaccctctcgcacgagggagccacgcacattttcacacttcactctctctctctctctctctctcgtgcgccgcgccgcgccgcgcggcgagggtggtggtgggtgagcggcgagccgagccgggccacgggcggcgccgcgggaggcgtcccggcgagcggaggggaggggggcatccgagcgctgggggaggtagctcagcgggaacgggaacggggcgatcccccccggcgttctcctccccggtctctcctgtagctagctagctagccatggcggcgaatggcgagggtggcggcgacccggcggcgcggaggcggtgggatctgacgaacaagggtgccgagagcatgtaatggcagtggcaccagctgcatttcggtttgtttgtttattatttttttttttttttgggggggggggggggtttggctcgtggtgtggcgatgttcatggagcaatgttggtggcggagttcatcttccagctgggctgctggatctgctcgatttgtgcttggtttatgcgagtttttggtgatttcagatgggttttttccccttggtctacacggggcagctagggtttcgttacctggagaagatagattggccttagatactgttgttgttgttgttgttgctggtataaatctcaatacggtagggtgggagacggatttctgtaagaaatgagcttttccggaggcaaacgaaagagggatttcaatattaactagtggaataaaaaaaaattccctgttggggaggaaggatggggtagatttataggcatatcatgcattattgtcaaggtcattgcagtgaatttatgtgtgaactcgtattttaatgactcaacctttcttcttcttgagcatgctgaaccattcaaggattactgtgagaaatttctgatggatatgactttgaactttcctgcccaatttcatatgtactgtgtcacatccctgatacatttttaattgcagctgctgattctaagattttgagacattgcctgactcttagtgggcttgctgttaggattgtgctggttgactttgtgtggagatatcttatgatctgctgatgcacaattgtgatatggccattttttatgcaaagctttcgacttttgtttagattctttgttatccgtattagctatacttttatttttccagggtaatttagttttaagtgttcaaatcggaagcactgaggctgagagaaatgctgactagtttatgtacttacatacctaaaaagccttctgtgtatgtgcaatattagataatctgtgtgggcatcaacttttgtactatttaggttacaagccttatttttgcaggaatgcactaaatgctcctgttctgtagttattgtttctgcatgacctgagtactttagtgtttctatatattgtgtagttgcttgcatgctatttgtggtgaataacttatgaggttgtacttttgttataattgtggttaatgtactttaatccttgcagtccaatggtgaaagaggctgtggaaatgtccacagacgaagaatcagacggtgtcgttatatgtccaccagatggcaacaatgatgatcgagaggaagccattagtagtaataatcatgataattgccaggaaggcgaagtcacttgtgttaaagacccggttatagacagtgaaacccaggaagacaagtgtgtgaaccaagattcagttaagttgatagatcaagagaagtctggtccacccaaatcaccatctaaacctggcatttctgggtcagataggtccaaacgtactgttcctcaaccatttgccctttcttctcaaagaaaatctcatggaggaaatagtaaggcggctcatccatctggcaatggagaaaattctggtgataagagcaactcctctccagcaagtttgacaaagaaggtatgactattgtcatatatacagtattatccatatatcatgatgctaccaatatcatttgactcttgttctggtttttattattgcttaccattttatgtttctttttattttttgtattctcaccctaaatcatatcatgtatcttagtactgcctaggttgtctcactgagtatatcatgttcaaggctctaagctgcctttagatatcaaatttattagattgatgagccccattatatgttgaaggtttgttttgcaagtaaacatcgtaagcttgttctgtgaagtgtgcctaaacctatttggtggcatacctgtcttcttagtaccagactaccagttgatgtatctatttgcctgaaaatgttatgttgtaagcctaccagagatagctggttctgttgacacaactgataattattgcagactgcaccgattactcccaagaagattgcacagcctgatcatatgcttcaccatcaagaggaggactcctgctctgtgacttcttcgtatccttcttctatctaataaaaatacaccgtgtttctattttttttgggttgtactgtgatgatgttttctgcctttatttcttgtgaagatgtttctaaaatattgcatgagaaaattcatttcacataatgatcagatatttggttttcaattctagagtgatgactggaaaaaaaatcgatgttaaaaatgattagttctgttaaccttaattggttttcagttgatttgatattattctttgtagtgaaaacattgccaaggtgatgttctttctactcattgtttgaaactattgtatacaatttggcccctttttttttcctgagctgtgtaaagaaccacaacttcaacaagagctggcaaaaccaaggcaactgttggtgttgccccttcatttgtatgtgctgatcgtgctgacaagagaaaggaggtgaatatgtagtttgattgcattatttcaagatggcctcttaaatgtgtttgttatttacaaatagcgatggcattttcttttctctaaaaatagctggtgctcatagtgattgctgtttcttcagttctacacaaaattagaagagaaacacaaggccttggaagctgagaagaatgaggccgaggccccggaaaaaggtatgaatttccttgtgggggagaattgaattgtaggatacttaagttttgtttggtctgtgctattttactgggtctgttaaacatggttttaattcggtaatagctaaatttactctacgcttctgtgattctccttaattaatgcttatgaaatatttgtctcaacattcttcgcccagattcagccattatctctttttttttcatataatatattttggttcttagatatatcatggagagaggagtaatacaacgcctaagatttatgtgctaggcagaacatttgaatatgatactttttgttgcccaaatctttctataagatgttcatgttgatggacaactcctggcaactatttatttaccaatttacctcaacattcatgttcatttttttttgtgtaggaagagcaagaaacagccttaaaacaactaagaaagtccttagtcatcagggcaaagcccatgccaagcttctaccaagaaggacctcctccaaaggctgaacttaagaaggtagttctgaatttctgatgttttgtgtttcttttggaaacatgtacttgtgattgtcagtcttggcaatgtggagatatattgctaacttctaggaggagattgttggttcactggaatgagaggagtccttaatttacttattttcactgaacaacatatttgccattttgcccaaaatgccaaaactagttagatgtacagtgataacacaagaaagctacatttgagaaagcttttccttctttacaaggaatatatacaaatctatattatttcttgcatcatgtatcttaagcacagttttaatttccataattgatgattctactggtgggcaatatgacattcacttgtctttgttctttgaaggtccctccaactcgtgctaaatcaccaaagtttacaaggaggaggagctgcagtgatgcaccgccgacgccagaggcagcaaataccaccgcagcatctagtcgatcacatcgtcacagcattgcgaaccctaaagatgctaacagagtacaatgctcaccaaaaaatggcgtcgctgccaaaactagagctgtcaaacctgtgagctgaaggccctctggagattctagatcagccaagtgttgcgaatgtcgctgtacaaacctaactttagccgtctctcggtttcatggcattttgcatttgatttatacttcctgtcaccaaaagaaggccacagtgccgaggccggtgtgcttgcagctgaaccctttcatttcttttcttcttttcgcgttgctgtgtaagaactctgttgctgggaccatgtactgtgttccttgttgtaaatggtcgagggtttctgtcagaactcagaaggaagacactctgcccttttaaagcccttgatgaaccgttgcaatgttttgcttgatatttacctgggtttgcagatcctctagcattctagatccctgtcaaaattctatgctcccatcctgtgaagcgtttggttcatggtgtaattatcatttgccctaaatcaaatttaacaaggtgggggtcatttcattacacagctgacggctcatcgtctgcaacatttgagagatgaacgaatgaattttctgagtattgccgtatcggatagacagattttaccatgaggtggagtgatttaatttaatttaaccaatagctagtcgttattggcatcatttttgatgaaaattttatgacaattttcttgtctagataatgctcaggagtcgctgacacatcgatcggaggccgcttaagaggataatctaatctgacgaagttataataaccaaatcgggcccacgcgccagcgtcaagagtgcaaagttttacctgtgttgggtccggccggtgtgctggacatttcagccactactgtcaccaaacctggctactggggtacttaactgtccatgatcaccatatttttcccccaaagaatataatcatgccaactttagctctccttgcaaaatgtaaatctaccgacatgtttcattttaaatttgatcgttacctgtttgaactgcatgaattttcagttgaaatggaccaatatcaatatttccagggttgatattgttaaaggggagatgaagtataactgacgcaaggcatacattgtttgcagctaaacagccttttctgcttgctatttaattcataaaacaaaggaaatgataaagaaaataaaactagatgcgaaatatgacctctttttagttggaaactgtgaaagctatctgtttcagattgaaaagaaaagatcaacattaacatgtctcttcttttattcccttcaatcttctgttctcttccagcctgtaatgacgagttctgagaggctccccatctcgaattcatgctccatttgacaactctttctatgccctttttattttttttttgataaagaatgtagttattgatgcaaagtaaatttcttattttatgatttgtctattggtacctttggtagttgacgagtagtgctgcaaggacaaggaaaaggggagatctgaggagcagtttcttctttcctcattcctctctcctaccctagaacaagaaatgatccttgatcccttctaaaattcagacgcaggtatgctagatgagtcattttatttctcttcctttagtcaccgaggcaattggagaattcttgtttagtttgatttgctttacatttccgactagattttgttctgtgaacatgggaggcttgggctatgcaatgggttcctcatgtgggttttttgtgctaatttttgtagatgattttgaaagttaaaattgtccgcattcttgctatcttgcctgcttactggaagttggtcataattcgtccgtaattttggaccgttcagagttgtaagttgtggaaatagtacaagataatttactgaaattttactttgggaaatttgatattgaggaaattctcttgttctgctgcacagctgcaaccctaattcttgctaaaacccttgaccctgattctctctacaaaatggtagtttactgggatatatcaatctttagccgaactttttagtgatataacctcatactttgctgctctcatgcaaaatattatctttcaggaaatataaattcagtgacaaattttcatccaaaattgacattaatggctccaagaactagtactgttataacctggagatatcagcagctctttgttgtactatcttcagtaatcctggaatgggttttgatgcttcttctgctttttgaggggctactatcctatctcgttacgacattcgcaagcctttgcaagctccaccctccatgcccaatgtgcacaaggctagatcatgtctttggcatggcgcaaccaggcttctaccgtgaccttatgtgcaattctcacaaggcagaagcatcatcatgggcattctgccacattcaccaaaagcttgtagatgtccacagcatgtgtgagtcctgccttctttcatttgccaccaacaagaagtcgaaccttgcgacataccggtccctggcggggaagctcggtgtcggcatcggcaatgaaggtttcaggcctagcttcagtttggacaattcatctgaagcatcagttatcaaggaagatattactaatattttgtgttcatgttgctcaagcccattgaaagtgaaatcatatccttctatggttcttcagaacatagctagtgccattgacactgaggtgaatactagacatgtctcaagagatcagcttattgaggagatcagtcttgtcaggtatagtgagctgaagacttctgactctgaatcagagccctggcaacatggtggtgttgctagcttgctggatgatgcagttgataatttgaaggaagattttactttgagccatccaaaaacaaaatttgcaggtgttattcctacagatgacattgcacaggatcaagtggctaagaactctgacttgatacaactccagaatggtggttctgacagtaagaattctcaagtttcagcagagttgtaccacttcagagctgatggcaatgcagatcttcagtcaactgacttttccagcaaaactgttcagcatcctaccgaagattcagacacaacaggtttgcactatcctctccaaatgttaaaaaaaaaaacattgttggattaactattcacttgcttagagtattgacactggtttttcttttcttaagtagataaatctgaagatgatgtttggcacaatgctcttgattccatcagtgaattatcagtgactgataagcctgccgaaaccagtaccgcggagaatgaaccgaaagctgaatttaccgatagaactgcaatgaaggattctttcaaagctcatgaagatctgcagttactgttgtcacaagtttctccaaatgatgccatcaatatccctggtgtacaagagcaagccatactgaacaatatcactagagcactctctcttgacaggaattattcaggtagtatttctgagagcatggccattgatgaagctgaagaacattgtacagttgatcaactgaagaagcaaatcgaattggaccggaagtcgataagtcttctctggaaagagctagaagaagagaggaatgcttcagccattgccacaaaccaaaccatgtccatgatcaccaggctacaagaagagaaagcagcaatgcagatggaaaccttgcagtatcagaggatgatggaagagcaaagccagtacgaccgtgaggatcttcagaagatggctgccatggtgcaagagctcgaagccgagatcgaaggctacaagaccaagctgagagaccaatcgctcgttaacgagatacgcgacgcgatgcgcatttcacgttcagaggaatgtgagactagcatgtcaagaacagctcgatcgctctcattgttcgaagacgagaaggcgtatatatcaaaacacctgaagaaactaagacagaatctccaccaattctcaaacaacggcaagttcatcgacccgaaaaagattgacgacaaagaagacacatttgatgtcacaaacagtgaggatgtataccaagatgctgatgaagattcagaaatgaccaattcagagaattcagagatgaccaatgtgataagaaatggtcgcaacttcaggtacttatctaatggtacagagggattgacaaatggtaaagatgatcctgagggtcagtactatgcaatggtcagtgagaatgacttggttaattttgaagatgagatctctgaactcactgcaaagctgaaggcactggaagaagatcgtagcttcctagagcacagcataaactcgctgagaaatggccaagaaggcaaggagctgatccatggcatcgcttgcagcctcagagagctccggaagatggggatcacttggaaggattgtgattagctgaagcttcatcagaggatacacgtttgacagaggtaatgcagattcagttaggtagaagttcacaagtactgatctatataaattcatggcacattatacaatgattgttccttaattgatttctttatctctctcatgattgacatggatcacttatcatctcaatggcctcttattatttatctgttagcttatcagtcgcacagacaaaatttaaaatttcaaacttaatttatttacagttgattttcgagtctttcgtcgtagtctatttttcacctctgacttttaaacaactaacatcatgaatatagaagttttacacataaattatttttagttgattcttcttttttttacaatttatcagctgtagcttgaccgatcacttatcatctctaattgacagttgaccacgtggctgcaggatgtaaactgtaaagagtgatggattaagctgctgactgtatatgtgctaatgtgcatgtgcacacggcggttgctgtcatgtcatgcggtggtggtaggttttgggccgttgcaagtgcgccgtgctcttcgcgtggagtgttccttgtacaaatgcagtgtggattttttgagtgctcagaattgaccaatatgcatacacaccttttctcagtgcttgcttaatttgcagttttgcacatctttcatgtatttctttttatacttttaagtgggattgtcagcttgtctgtatatattgtcaaacaatccagcatttcatctcgacaagtcgacgacaggttgagtcaatcaggccaaaatgtcaaagaatcgactgcaaaaatttgctcatgcattgcatcgttaaacctttttcttttgtgattgtaccgatgacgcatacgcacacacaccactaacacacgctcaaagagacggaggcgaagacattatacatgccagttgtttcctgggtcctgtttttatttttctttcttggggctttttgcccttcgacagtataatgttgttttgaaaccgactcgatttggttggctttcttttctcgttcttggttggatgaggtgcttccctggctgctgcgacattgtaatgtcgttgtaacatttttaccgtattttttcctctaaattttattgaaattggtcggccaacctttggttggcccggtagaaaaaaaacgactcgactttctctcttaatacaattcggttggtcgattttcggctgaccgggcataccatcttgtcgaaacttaattttggcatgcagctaaggtagccggctagccgcaccggtcggtttcagcgcgtgtgacacgcagattcaggctacagatcgaagagctctgaagtctctgaatctgacactcacgctgaccagattaaccgaaagagagcaatgtgttaggcgagttgcatgatccaatcgatcgatccaattctacctgataaacaagcggccacgcgtacgtaacgtacatctctctttctctcaggtggactccaaatctatctccaattggcctagcttccaaagtgcgtgcatagcttaccgtttctctgaaaactcttgccgacaacgtcttctcttccagcttcaatcccactgacaatcacacacacgacaatgcacgcacgcgcacaacgatgagagagaaattagagagatggatagagagagagagagagagagattgacacgtgagaaaaggaaaggaatgagaattcaccacgcattacattagtttccttgctgtttcttctcgctctgaagaagaagaagaagatttgctgaattagtcgcatcctgtggagtgttcgtccagcatccaagggaatgatcggctgctagcgatagtcaaaccacgatccaattacgtctctctcatttccaaatgaggcacgctcgatcgtgcattcatgtgcccgtacacctgcgtgcgtgtatatatatacacgcacaagaactgaagaacacaacaaaaaaggcactgcaaatcttgttcagataacagcaagtatatattcagattgttcatagttcatttattgttcataattcagataacagcaagtatatatatacagatacagatagttcatagtcgattgatcgatcgaccatgaggcatgttactttcttcgcggcggttcttgttgccatcttcctcacctccggtggcgggaggatgagcagcacggcggcgcggccgacggcggtgggcggcgccggcgcgccgccggccgccgtggcggtggagctggccggcaccggcaccggcaccaacgcgtcgtcgcagccgtcgaactgcacctacggcaacaacgtcggcggccagtgccctcccactcccggcgctggccattagcaagagcagtgcacgtcgctgccatcaaatcgtgcagctgagctgcgtaattacgattagatattgtattaatcttgtgaatttttttttcatccgatcatgtagtattaatctttcctgtagcttgaaggtgattgcatgatcaattgagtctgtaattctgttggtttggttgtatttttttttaacttttttaggtaaaaagtcgggtgaattgatcacctgtttaatatactgtaattatctgttgcatggttaaacagcagtaattgcttcgtgcaagttcatttcgccggtttggattaaatgattaattacttcgaccaagatcaattcgctttaaatgattaattagatcaaagatcaagatatcacgattcacaaggccgagcccatggagagattcagctgggccatgggcttttttggtccatatggtgacagcttttgcgtcccttaatttgcagctcgctctgtcgaataatttcaacgtagttgtctgttactctgctagtctgcttaactgcagtatcagtttactttactacttgtcgtttatactataattttgctaattacagtgtcaccttatcttgtttggtaacaattcgtcagtcaagaatggcaagtactcctatttgtgaacggactgagtcataggaaatgaagcagactatcttttttttaacagattcatcaggtttcagtcgtgagaatctgtcagctagtttctgttgtgaaatatgaaatgtagaggacacatatatagtatttcttttcttgtactgctcattgcgtacatgtgcagctaacaactcagccgttcagaggagaggatggataaacaattcgtgcatatatacccaacaaaccattgctttactaaagcttaattataaacattaagcattagttgcgaacctgttttgatcatagcaatcatttgcgttttgatcatagcaatcatttgctcgaacagaagtagttagagcatctctaacaggctctccaaatctgactctccaaatatttatttggccatctctccatctaatttgacaactcaaactcttttttactccaacagcctccccatctatcatctccattacaagtttatgacaaatgggacccatatgtcagcctcaactacccttcttccatactgattctttttccccacctatactacatttcctttcttccttccgtactactgccccttccccgcaccctctacctcggtgcggcgacggcgacggcgacggcgacgacgacttgcgtgcgcgcaaggcgcgggcgggcgaggcgacggcgactcgcgtgcgcgtgaggcgatggcgaacggcagcgacgcctcgtgggagcccaaggcgacggcgggcacgtgaggcgggcccgcgaacaacagcgaacgtcgagcggagatggcaccgagccggcgggatgcatcacgcggatccgctcctcaccggcctcccttgccgtcgggccctctcccccgcaaacgatggcgatggtggcggcggcaaatggcaacgacgacggcggccccgggaggcataggcagaggcagcggaggccgccgctgccccagaatccaccccgccagcaaaatatgcacgaggtaggaggccgcgcggcggaggtcgccccctcctcccgaatccacgccgtgctgcccgaatcccccctccccccgagtcgaggtcgggtggaaccggaggcctccagacgacggcaatggatggcgacggtgcagacgacggcggcggcggctggcgatggagaccttggcagcaatggaagatggtgtcctcgatgacgatggtggcgtcggtgcttctcacactgactaggggcatgggaacagagaaaagggcaaatgagtgtctgacagcatggggcccacggttggtaacctggtttggccagccgtggaggatggccaaatttggctagttgggaagccagcttggccagccaaatggcttgccattcgtttagcaaggctgttggagtgtatattttcatcaaaatagctaaattttagcttggagagtctattagagagtctgttggagatgctcttactacttactactggctagtactccgtattacatatgccaagagagaatcgttcatcagcaggcgaggaaacacaatgcatgaagagtgtttgtgcttgtgaactatatgcttttttttcgggaatacgcaaaaggtttgcgcactttttatattaagagaaatgaaatttatacaaatggcaaacaaagaagagagatagggaaaaaagggggaaagggaaaaaaagacttaagcctactctcgctaatacaatgtgacgactgaacgaccaaacacgctaactagggagcactggtgacaggggattggactataagctttgatgagttagtttttgtttgagatgttgtttgtttttaattcgactagagccatgtgagaatactctacctccaagagaacacgagattttgtttccatgcatgcatggacaccattaacatccacacaacagcttattacataattcaatcatattaagttagacacgggagcgaagaagaattacgcattcgattgattcgaatcactagttgttcatggaatcagaaaacaagaccgacgaacagctgaacatcgatcatgcatgtttcttgcagaatattacaagaatgcaagagcacatgaatcaatcaaatatcccgaaactgatcgaaactactcgaattgatcacaaaatcaactcgatcgcacaaagaatttgatccgctacgtactactacaaactaatcttgctcttcttgcgattttcgcggctgcgctacgccgcgcgctcgacgccgtagaggatgaagcccgcgccgtcgaacgccaccctggccgccgccgccgcctgctgcttcgtgctcgcgcacggcgacgcggccgcgccggtagacgagccggcattgtcggcgccgaacgaggaggagcgagaagacgaggcggtggcagcggaggcgctcctcttgtcgccggacgcggcggtcgtcgccgtcgccgtcggcgggggcttgtagtacatgcgcgccgtctgggggcagtgcgagtaggccctgacggcgaccctcgcggtcatgcccagcaggtccccgtacgccgcgtacttccccatcgccatggatggagctcgacgcgatcctcctcctcctcctccggcaagaacaagaacaaagaaccagagcaagatcggctccaagaaccgcggacaagcggatgatcccctctctctctctctctctctctctctctctcgcgatcaagctagcgatcgaattggaaggattcctgtgtcgcgagctcggattctcctccttggcaatggatgtgtagggtttgggggatcggtgtatttgtagccggtggggagttcgattcggagtccgattcggacaaggatgatcttgctcttaccagccgcggcgcgtggacgccacgggaattttcccgggtgtcatgggcaaaaatctgggaataatgtccgattcgaggcccattatccagctcggcccacgaagacacgaggcccattcgatctctcgtcttccccctacaaggcccaccaaagtccatcaaagtccacgcctcgctcggcttgggctcgctatcgcgttgagtcgagtctgagccaccgccggaggagaggaggggggccgagcggcggaggcgcgcaagggtttgggagccgccgccggcgaccttggccggagcgcaaaagactgaggaggcgtggtcggggcttgcctgctgccggcggccggcgaccggcgaccaacggccaggacaggtctaaaattttactgcctcacttgaatatttcgattactgaatctgcagagaggaagcgtattattccctctttttagctggatcgagtgggttaaagcaattacgatagtaaaaaagagaggagggttaggatgcagtttttaggggatcgaatacactgtggaacagaatgctgcattttgctctatctgtttattactagtacttgttgaaggatggaattgtaggttttcccctttataaattggatagaggacttatgcggattaccatatgttgaattattgtgcaagattttttttgttaattgttcaaaaccattgaaatattgggtgcctctaatagtggaggatagatcattctgttacaggcaggtcttctgtaggcttaggtttgggggtcctctactttgttctgggcttgtggctgtgtagtaatgctagttgctaggtgcctgaccatatgcttatcaccttagaagaaaagctgcttcaattctaaattctaacaaggtaattagtggtaaatcatacttattccattcaaagggctgtgaccttttgaagtcactcggtctgagatgaaaacccagagaaatattatgaatgaatcctgacctgttctgagaacaacatcagcctttgttttgggatgtacttaagaggaaagcaaatttttggcctttagatttaattctgttctatcatctatctgatgacaaatcaacttagtatgattttcttttatttgcagctgtcctcaaatccatccctacattccaccaatgtatttaagctgttgaccacttgcacttgcacttgctctctgcctaaaatttgatgtataggctttatataagatggtatattgataataaactactgtttactaatcaactactaggctcctagcatgctttgatgtgtatttgccggcacccctatcaacatgcttgtgacacttttatttaatgttaacccgtttctcttttccaacagcttgtgcttatactgtcctgatggaaaccgacagaagccagcctgctccaattgacccaagaagagctcgctttccttgttgtatagtatggacaccattaccgttaatctcatggttgatcccctttatcggtcacattggcatctgcagagaagatggtgtaattttggattttgctgggcccaattttgtatcagttgataacttcgcgtttggagcagttgcacgatatattcaagtaaacagtgatgaggttagtacttagtattatgtggttaatatcactctcattgccgcctcctagtgacaccttatcaacatgtaatgtataattattgaatactttaatcatgtatagcactcaccaaacattaatctcttgtaatctgcagtgctataagcttcttgaacctgaaggagcatcaacatgggatgacgcgctgaggaaaggcgtgcaggagttccagcacaggggctacagcctgttcacctgcaactgccactccttcgtcgtgaacaatctgaaccgtctgttctactccggccatgacaaatggaatgtggtcagcctcgctgctgtgatgttcttacggggtcgctgggtgagcacagcgtcggtggtgaagacttttttcccatttgcactggtgatcaccatcggcactctccttggcggcgcgacattcctgatcggcttgcttgctttcgctgcggtgatgactggctggttccttgtgggcacctactgcatcaagagccttgtagagttgtagctggagtagtatattggattgtacttggttttgggtctccttgtgatcaaagggtgcatacttctaatttttatagttgcttgtaaggtttatttttgactggagagatctatgaactggaatataatttgtagcttgatgaactggtcatcgatccagacggttaattcttgactggagagacctatgaactgcagtagaatttgtggtttgatgaactgctcatcaatccagatggttgcggcatgaattgcgttttgttccatgctcaggaagtcagtacgaaatggtgtttgtcttcaattgcattaactatgtttacaagtctattacccatgctcctctacaatggagtatatttcgcaagcagcagatcaaattctatactgactcgtcttttcgcttatacttatacttatacttatacttatcagctaaaattttaattttcaactttaaaattggagttgattttaggaattttttttatcgtagtttattttctagtctttgtttttatatcattaggaacacgtatataaaagttttattcccatattattttttatttgcaaatatgccgtttcgcttacatgcttataatcagccaaacaatggcgcccgtagaatcggaaacttttcaatgcttcatttgcaggaaacacttcagttctaacctattttcgtaggggacggttcaattcctgcaatatttggaaaaaaaatatcgagccatttaaaaccataactatcaaattatgcctatcaaatcaacctatgaactccctttttggcttttgcttgaagggccgctttatattggtgttagaacatgcctgattgttttggtttgaagtcaaatcattgacagtatcgatgttcaatttgatgctttctatgttgtacttgaaatttagctctaaattgaccttaaaccaaatacaactctatcctaccaagaactcgataataccaaaacttatctagattttaacacggccaacattttagtagggtattacaacaaagctgaaaatccagatatcctccactgagtcacagttccactctcagcctgtccttatccaagaaccatctagaagctctcgcgccgaccgtaacaaatggacggccaggatgaactccaccccagccgatccaacggctgaggacgcgccaagccaccgatccagtgggctcccgtcgcggcgcgtccgatccgaccggtggccgtgttcgcgtccgaggaaaccagaaaaggaagagagtgaaagcaggcggaggaggagaaaaagggaggaggaggagaggagcgcgtgaagcatttcggctcaaaggggaaataaaaaggggaagattttttttgcatctcatcctctcgctctcgccgtctctcgccgctcccccccctttccaggctccaatcccgccgccgcgtaggatggccaagacgcggcagccgcagaagcgggtgctggagtcgttcaccatcaaggggcccgacggggtcatcaagcgtgaggacccctttcttgatccttttatctatttatctaggtttttgttgttttgggggaaattttggtgcgtgtataggttagcttggcttcgattatagatcttaaatctaggtttttggtggtagaatctatactttcatccaaaggtaccaaatagtgttagcggagtggtagcggattgatatcggggtagcggcgagattgcgggcggtatcgcggacgctacattcctatagcggttttgatatcggtatagcggattgattgcgggtggtatcgcggacgctacattcctatagcggtattaatatcgctatagtggatagattgcgggtggtatcgcagacgctacattcctatagaggtattgatatcggtatagcggatagattgcgggggacatcatggatgctacattcctatatagtggtattgatattggtatagatggaagttctatctcaagtttgaacctataaaatgttagatcttctttagttttaggacaacctgcaaaaagaagtctatgtgctgattaggacggtagctctgtgtacagggccggttctatattttcgaaggtcctaggcaaactctgtgctacgggccctaaggatttttttacttgtaaccatgtattctctaaaataacatgattaataatacgtagttgaaaattgtaatttggtattttattctcgataaatagtgttgatagtataatgggcttagttttaaaaaacatagtacaatagacaactaaaagaaacccgtgcaaaaacgaagtagtataaatagctcaaataggataaaataaataacaaaaagaacaaaacaaaaccgaaacataattttaggaataaatagatgcaaatgaaaattgagaagatcagaagaagtgaaaaccttatccgagtcacgatgagacaatcgggcaaggcatgggccatgggcgtcgggcgtgagagcatccggctggctgctgccacgatgttgccggactctagatcgtgaagtcacggtcgtgctgtggcgccgtcacctgtcggccatcgcgatcaggagagaaaacgctgaggatctagaacgaagtaatgaaccgacgcgtcacggtttcgcccttgatcgatggtttgggctcgatcctcgattgcgtgcgtggcgtgcctccctccctgccaatcgacgtggcaacgacatcactgcaattgggctaaccggctaactaggtcatcctgggatgctgatggactatgatggtgatgggccctctaccggcctgggccctaggcggtcgcacaacctgcctaggcccagagcctgccttgtctgtgtatcacaaagcttagatttttgtgtttaactatacttgtttacgttattgatttgcgtgatcagacacatttcttgataaccttgttctacctatttgcttatgtaacatctgattgtatggaagaattaagttgatggaggtagtcttgattatgtataagcttccacgtagcaatggtgtactcctggttataaatccaagtttcttgttgggttaaccaagttagcattttggtttggagtgagatgaagactgaagttatttatttccctgcaaaatttaaattttaaatacaaaaaagttcttgcaagttaaaatttatggtggaattcaagcaaggtaatcaatatcgagatgctaggtaggatcgttttttattcgtagtatcatagtattgggatactaccatactatcaagatactatcagattttagaaagtacatattttatataaatatataatatgttgtataaactaaagcatataatattggttttgataaatttaattggtttttatgtaaacttgagcatatttattcacattattttaaataatattttgtaggatcgtagaatcaagatactacctaagatttcgtagcatcgtggaaatgaatagtaagatcgaaatactatgaaaattaggatactggtgggatcggtatcgtttcggcttggtaggatcgtagtatctaagatactaggatatggatcggaatactgacaaccttgctgtgaagtaccgacagttaattctgcaaaatcaactcagcattcaacttcattcgatattaagcacactcatcttggctacttgttatcttatataactattggtatttttttttgtcgaaaggcacttcttgtacttttatgtaattgctttgattcagtatgaacagtttctagtgttgtcaggaatgttttccaatattagcaaattaatgtaatttgtgaggtacaacaattattaggaaataatattggcatagtcttttagtgattatgttgtatgtctgttccagctggggatactgtgctaatgatggcacctgactcatcaaagaaaccatatgtggcaagggttgaggaaattgaggcaacaggacctcaagcctctcaagtgaagatcaaggtgcggtggtactaccgcccagaagagtccattggtggccggcggccattccatggttcgaaggaagtatttctttctgaccactatgattcgcagagtgctgacaccatagagggcaagtgttatgtccacacctttcgagattacaccaagcttcgatctgtcagcgctgaggacttcttttgccgctttgagtacaaatctgccacaggcagctttgtgcctgaccgtatagctgtgtaagaatccaaaccttcaaattcgttagacatgattccgtacttattactactagtatattctagcatcattagaaagaactattgacactcaggatatttcagcaaactgttcatctgttgtgatcttgttgactgctatatggtttatggctttctttagaaagttaacatatgattttcttctgaatttttcctagctttgatagttttcagattgtctccctctatccaatgctaatgtctgggatctttctaccaccttgttgctctgattacaccattcacaatttcttgaaatatgttgccctgtcgattcttatcctagcagtcccattggggtcacagtctgtcttgaaaccgttattttctgcagttctgctagattattcagtgctgttcattagcgcctgtttgaattgggagaatgcagttacaagatctacctattcagattgcacatatcatatatttgctctcacgtattggtaggcaatcaatcggcgtagtggttgaaggcttgggcatttctttacccttttaaatgagtgaagttttcaacctgtagtgacaaacttgacatacctctcctgtttgctagtatgacacatgctcaattcttcaattgcaaaaataatttatttgatctgttgttgattgacataacaggttttgcaaatgtgagatgccatacaatcctgataaccttatgatccaatgtgaggattgctctgactggtgagatacagctgacgcattcaactagtttctgtatttttgaatgttaccaaacctgagaaaatctttacattaactgcaatcagtaaagctaggtgtatgtcttgctagaaacctgtttcttattagtagtgaagaagctaagcttcacatgtgcaaaccatatattctacagaaaaacctataaggatttctgcaggctagaatagctccactaaagtcaatacttgtggaacattagaaaaaagaacagtattgctcctcacaagtataatggtccattgtggacagtatggcgcatgctgtaattcatttatggctgttttatgtcaagtatgtgtacggactacagaagtaatggaactcataaagtcaaagtgaaatgaacaaaaggaaaactgaggaactatatccaatatacacctgagaaacctcttgagtttacacttagcaatttcatagtatcttgttgaagttctaaaatattttcctgcaggtttcatccttcctgtgttgaaataaccatcaaagaagcgaagaaactagagcatttttactgtaaaagctgtattgctgaaaatggaaaggatctacaaaagtccaatggtgctactgtgcaatctgaagaaaaggtaaactgagtaatctgatgaaaactttggcgcgtcaccaacagtactgatgaatatctatagttctgatcatctaattctaattgaagttgaaccagagggcgccttacatatatgatgtatgtcaggaggttgcagtgaacataacccatgtcagatgtttaaaatttgcacaaaattgacaatgccactgaagtggatcaattcatatcatacaattttacaaatgcaatcttcctcatttctgccaatgtttgctcatccatatgctcctgcttgcatcaggtgcagtccaaacgacggcggaggtgatgccatggagacagaatctcaatacctccaaagtggatgtaacaattctgtggggagcaaagcctcatcactcctctagatcttctctcttctcttcctgtgcaaggctgcttgcagccagtgaccagtgtactgtgtacatatttaccagtgttttctttttgcatcgtttgcatggtcgtcgtagcgtcgtcgcatgtactagcttggagtcagtcagtcagttagctcgagcaaagggatcaaactccctcttggtcataaactcataagcgatgatgatagatgaaactgggcactacctaccgtggttgtgttgttgtccatcaataataccttgacgacttgctacctgcctctctgttcgtcgtctccatgttcgttcttttttttccctttcttttttactttgagaggttcatcagttcatgttcgttctgtttcctggttttgatatttgaaaagttgtatttgaaagaaaaaattgacccgaaaaaggtctccaatgttaggtaaatgggcgattaccagctcttcttgcccctactttgatgtgtaatattgattttgcccctgtttttttagggttttcgtttttacccctacttttttaaatgaatcaaccgtttgcccctattatgttaattcttgttaacggtgttaaaatgtggggggtaaaaggacaaatatacccttagacatttttccgtacttttggcataatcaaaatataaatctattgatgccatactatagcagtaatttaattgtccaaatttgtgaaagtgtgccaaaatttgggtcaaatttgaaagtggtacaaaaataccggaaaatatctaagggtatacttgtctttttacctcacatttaacactgctagcaagattatcggaataggggcaaacgtttgttttgtttaaaaaaataggggcaaaaacgaaaaccctaaaaaacataggcaaaatcaatattgaacattgaaataggggcaaaaacgaaattgcctcaaaattctagggatacacgaaggccaaaaattctaaatttacattagatatctgttttgaatggcgattaaggtcctgttcttttctccgatgaagatttagattttcgtggcacgctttttaaactgctaaacggtgcgtttcgtgcgaaaactttctatatgaaaattgctctaaaatatcatattaatctatttttcaagtttgtaataatgaaaactcaatcaatcatacgtgaataccacctcattttatgtaaaaaaacttaatcttaatcttcaggagaaaagattaccacctaagggatgcggttcgatcaagattcaagagcaagacatgaaatgaggaagccgatatagacttaccccaaacacaaattgcgcgctccacggcctatattcggcccaacctgctgccgggcccgccgctctcttcatgctgggccgagccgacaggccaactccacggcccattaggccgacgtcctcctcgcagccacgcgctacgcctccgcggcttatcgtctcctccaccgggcacaccgccgcgccaccgccagtgagccagcgacgccaccgcgccgcgcgccatgccgctcctcctccacccgcgcttcccctcctcccacgccgcggcctgcgcccaccgcgccgccgccgcccaccgcgacgcgcggcccgcgcttcgcctccccgagctacacgcgacgaggcggaggcggaacaacgtcgcgtgccgcgcgaccagggccagggaggcgccgccgcagcagcagaatacggcggcggcgctgtccaaggaggcgcacaagtacttcgaccacgccgtggtcaccgtccgcgcgggcgacggcggccacggcgccgtcctcgccatgccggcctccccctcgacggacgcccccaaatccccccgccgcaggtcggacaagggcaagaggagcggcgtgaagaaggtgtcgtacaagaggaactacgacgggtcggtggcgctgccgatgggcggccacggcggcgatgtggtggtgtacgccgacgaggcggaggagacgctgctccggttccacgagaaggcccgatactgcgccaagaggggaggcaacgtgggcgccaccggaaccctgagctcgcggatgcacaatggcttcgccggggagacgctcaggatacccgtgcctgtaggtttgtagattttggtggtgttggaaatgcatagcattttgctctgtgatggtaaagtcttcttcggttaatatctgccgcatcgaatttgcaggtactgttgtgaagcgcaagaaaggcgctgttcttgctgatttggctcatcccggtgatgaagttattgttgctaggggtggacaaggcggggtgagttgctagttgttcaccatcgttatgcttattcaagaggagggctgaattcgtagttcaaattcccaaattttttgctgtgcttagcgaacatttctatcgattgatgtctttaatcttttgagttgcgtttataatttggagatggcacaagtcagaaccatgctaagatctttcaatggtgcttaataagctttcgctaccatgctaagatttttcaatgtttatttctacacaaaggtgtaaactgggcggtagccatcccatatgaacattttgagatgtactagtttcaattctagtaaactccccacaaaaaaaaaaatctagtaaactgccaaaacatctgctgaattctatatcaaatattataacttgatttttgccagtcgttaataaatatagttggtacttgacagaactgtatctgacctcgagcagttctttagaaacttcattgttctattagggcagttaactgaagcatggtaatcatgatgattcattggcgtacataacttagttgactgatcttataaattgttacttcctacaactaaagtacacctactacttttacaaatatttatgcactgaatgatactgtcatgactttacagtcgggctttatttttgcagataagcttgatcgatgtgcctgagtacagaaggaggaaagccatggttttatcacctaatatcatgcgtgatgttagtgacagggtaatttgttaccttatgatacaccgggatttgaattgatggtagctttaatgttgtttcaccgatagcctgttttagttggatcgttaaagtttttgtgaaggattagctggagcaaatagtttcatgtttctgttaatgtagtttccacatagatacttgtataatgggtctatcagagaaaatagtgcaatttgcaagctagttgacttgattgtgttcagtttcttggctccttgcacactgcagctacttgcattcttgattcttgcgatggcattaagctatgttcaagtttgtcaaaacttccacgacatatactagtgaatgaatgatagtgagaagacattaatagattctcaagcactaacgccaacaatcatgtgcagattatttaacagtactgaactgctggtatccatcgctctgtgattgtatcagcatgatggtttttgataatccaaaggatttcaaacgattacatgcatttgaattccatagctttcattttcttttttcatcatattttttattcgctctgtccttttcttgttgtgtaggtgttaattcatggtcagcctggtgaggaagtaagcttggagttaatcttaagggtggttgcagacgttggtcttgtggtatgtgtgtctctattctatatttctcatggttttggtcttgcttcacagttttgggaacaagaaagtgttcagatcattcctagtagtttatatatcgtacacaagaatcttgctcaaaataatgtaccatacataagaaaatttcaagatattggaagaatttggtttggaaaggtctacgttgtgattatcatacatgggtttagatgctttacattcctttttttaggctttatttatgctatttcattgcagtcgccattgtttgcatgatgtcttacatgcattttcagggacttccaaatgctggaaagtcaacacttctatcagcaataacacttgcaagaccagacattgctgattatccattcactacattaatgccaaatcttggtcgtcttggtggagatcctgctctaggggcgttgcagttttcctcagaggcaacattggcagacttgccaggtctcattgagggtgctcatctgggcaaggtgctcttttacttttatgcactttgcttatttcatacaaaatgtttctttgcaatagccatgttgcttcccctcattattttctttggcatcatcacttgacttaatattacattgcagggtcttggtcgcaatttcttgagacatttaaggagaactagagtaatcgtccatgttgttgatgctgctgctgatgaccctgtggatgattataagattgttagagaagtaagaagttccttcattcataatagctcttttgttttttttttttttgaacagtcgtgcacactatgccagagaagtttgatagtcctttatattagttgggtagaatcttatcagccatttgtatatgggtagttagtcagtataattgaatatttgtctatgttttgtttctcaagtcaagatgtgtgttgaatggtgaatgtctatttacaggaactcaggatgtataacccccaatatctggagagaccttacgttgtggttctgaataagattgatcttcctaaggtattgtaccttaagcctgtggttttctatttctactataatcccttgatgaaaattttgcctcttggcatgctcggttttcatactgtttacgctttgctttttatcccacttgtaggcccaagacaggctatcttcactggcttttgagatatcctcaataggctgtgaagaatgtgatggtaacaatacaagcgaagacagtttaaacggaaatacaggcgaacataatacctcatcagagactaaagttgaaggtggtgaaaaggaacttcgggactatccaagacctcaagctgttgttggtgcaagtgtactgtatgtctcttcagttgaccaaactacatgcatgttctttttactcgaaaaccgttttacatccctcacatgatcttactatcattccctttgaactcacggtcgtggttctgcaggaagcacatcggaatcgatgagatgctaaaggagattagggcagccctgagaaaatgttttgatcacaggttacctgagccatgaatggaagtcagccagcataccagaggctagtacgaagaccatagacaagttctcaagtagcagagacagatcgagctcggctcttgcaaggacaacagggttcccttggtttgcagcaatttcgacggttgatgaagcatgaaaatgaccatcagaaagtgtgatgatatgggagtttatcagtatgagaagatgctattcgttaaaaaaaattattcgttcaaaaatgtatgagaagatggtacgaaatgccagtcagcagacgcgtgtgaataggaaaggatagttctgtgtgttgttagacccttttgtgtacgatccaattggcacgtaatgaagcaagcagctttgatgcatatactccatcgccttttctctgcttgaatctgcttcatactctctgttctctcatgtctgaagtctgaacttactgctgcctacggagaattccgttatctgtttgttggcttataagccgaaaccgagcttcgcccccacgccccgcgctggtgaacaactgaacatgagattggttgagaaggtggggagaatgagggggagggaggaagaagacaggggcaatttggtcctataatattaagagaatacaatgaaggggtatgtagtggcatatcttcaatatttgtgaaattataatggcataattacaaataagtgaatagtaatattatattttaaaaccataaaatttataattgcatggattcaattaacccaatacaatacgacttcgtttccgactaacacgaacggccacgttattcatagcgatcgatcgattgatcgaggagtttgaggggggaataacggggaggagcatcgatctcgatcgccggcgaccatggcggcggcgcttgttcgctctttggcgagcaggagtaggatcggcacccggcgctctcacccagctacagcctaagccggcggccaccgtcatctcgccaaggttgcttagccatggcgggctcctccgccgggaagccctgccgccgccgctctcgccgtatcgcttcttctcttccggcggtttcgagtcacctcgcacggtatgccttcttctcgttgatatatctcccaattgatcgagataagtcgatgctttatacgtttggattattttctgttcctccaaaaaaatataatgtgtctaccaatctgcgattctgagcttcttcccccaaaatcagattccttgctaatcataaataaaactatgaacttttcttaactaatatgtgtggttgaatatgttcaagtcttcttctctacgacatacaattcattatagtgcccgtgcataagacattcacattgttatcagaagtaggctattttggtaaaacaagatatgttaaagattggccttttatagggtatttgatatttccgttatgttactatggtgcgtgcgttcgttcgttttttgttgcatgacctcgacatgaacttaaattccccacgaccacacacacacacacattaaataatgctttttttttcgaaaatacgcaaaaagattgtgcacctttgtattaagagaaataaaacttacagagagcaaaacaatggaaagaacaaaccgaaagccagaacataaggtgggaaataaaaaagaaaaacatggaaagcttaagcctattctcgtgaaaacagaaggaatgacctagcaacctagagaactaagctagcagcgcctgcgaccaaggtcgggcaaacttccagaggacagtttcctgcgccattgccgcaaccactttgggccacgttcgattgcattgattgaacacctgattgttcatctccttctaaatgtacaaagccccaagggtcacaatcgtgtcgaagccacggcgctgttccttttggactttgaagtggctagagcattattttgatggcatattatctgtccaacccagttcaaatgaagtcttgtcacagcaatctaccaggaaatagtttttttttaaaaaaaatcagccaagaaatgagaatacccagaagtgtagccttgttctttgttcaagggaaactgcttgttcataacccataattcaagtgattcttcttgtatgttcagggtccctcgccttctagtacagaacctggtacggacacagagtcttgtaccaataagcaagggccagtggctgctgaagagaataataaaaaatgttgtccaagaaagcaagcttcaatggcacttgggacggaaattgaagagaggaagaaggagcttctcaagctaatgttgcagatgaagaatattccacattgtgatgagtgttttccgaataaggaggagcagtggattcgttttcttcaaggatcgcaagctagcgagcaacaacggcagccagcgtaagtgggcagtacatttcgaacatagtaaatttgttccatgccatcacatagtagtaacgcaagcagagtgcagttcgaaaagtgctccctccattttaaaatgtatgacgccgttgacttttcgtacacgtttgatcattcatcaataaaatataattttaacttatatttttacatattcatactaaatttttgaataaaacgaatgatcaaacgttgtgggaaaaatcaacggcgtcatacattttgaaatgaggtagtatcattgattgtttatcttcctggtggcattttgcaacttcttgacagttgcggtaaccattagaaaatagtgttagtttgtattacttgctgatctaacatactaatccatcatttttataatttctgacatgtaggtttggaaaatctgtggatgtcttggtgatcgtattatatgtcttgaatatcggattcatgctcagggactaagattcttttgaggcaatattgcagcaagtgtaatagttaagcgttttatattcccctcatttgaacaccggtcctgtggttattttccagtcatcactctcaacaaatgtaaattctttcatgcatgaattctcctctcttgaagggtctcttgctggaacaagaacccctctctctcttttttatgtgtcctgatctggacatacatacatacatatatacatacatacatacatatatatatatatacatatatatacatatatatatacatatatatacatatatacacacatatatatatacatatatatacacacatatatatgtatatatacatatatatatacatatatatacacacatatatatgtatatatatatatatacacacatatatatatacatatatacacacatatatatgtacatatacacacacatatacatatatacatatacatacatacatacacatatatacatatacatacatacacacacatatatacatatatatacatatacacacacacacacacacacatatatatatatatatatatatatatatatatatatatatatatatatatatatatatatatatatatatatatgcttatttcagcaaccgtctcacatgaagaaaaatatattttcatttggtgtataagaaagctgtcagccatgggggtgttacatttttggattgtgtgaattctggcatgacatcacttcactgggaatatgttgtgcctcaggaaaagtatcatgtgatatactagttgctttggtatatcggttctgtatatattagatgaagtgtataaggtaagcatttcctcttgttataaatactagcaacatgcgtgcaacgggttatatattactagattgctgcgaggaatcagtataaaacttatgtttgcaaatttgatgataagagatttaaaaggcactgggtacatataaaaatgctagctataacttaagtcaaaatagaaatacatgtgcattgcacaatgctctaataatattagatgagaaaattaaattgcaatactttgcaaggagggggatgcatgtcccaatgccattgacttcaatactcgtgttgtgttcctgagggagggcagcttgattaggagaaaacatccatggtactttttcaaagaataactgatggaaactcatccggcaatatcaaaacccaaaatcagggtaaattgtattttttatatgaaatcaaaattaaattgttggaataaagagaaacggtgaggcgcctgtaatgacttcgtcaaactcaaggatttgtcggcccagtcttcgaagatcactgctacaaacagcattatcccgtgcggtcaaaataaatttcctgtgcggaagatttgtccgtctataccaaaacatctggaaaaatcaatatttttgtgtgcgggcagcccaaccgcacgggataatcattttcctgtgcggtcgggttaattgggctgcacgggataatcgattatcccgtgcggtcaaattatattgcccgcacggaactaaaaaaaacccaaaaataaaaaaagcgaaaatcgccacgggcgccgccgctgcgaccagccacggccgcccggtcgcctcgaccagccactgccggccagcacgcatgcacgcggagccggcggcgccgtctcgtcgtcgtcgtcgtggcgcccgccgccgtccgagcggccaagtcattttggtcgtagaaatcaaaacaagtaacaactgcagtagtactagttatagccatagaaacaatctctaggaaaatcagccgagtgagatcaaagcaagaagagagcaagaactcaagcactggctatatcgacatggagaaattagtaccgcaacaacctcaactaccagaacattagcaatagcagccaccaccagcggtttggctggggattcaactcaagcttgagagaaatcgtcaagagactggaagccagtaattcaacatcacaaccacaccactttgctgtcgtagcagctatggagaaaaaagagagtaggagatgcttgagatccagcgcgtgcacgcggagtcggcggcgccgcctcgtcgtcgtcgtcgcgccgcctgccgagagccgcgtggggccccgccgccatccgcgcccgccgcgcgtgcacgcggagccggcggcgccgcctcctcctcgttgtcgtcgtcatcgcgcccttgatgggaaaaaaattctgtgcagacaggctgcaaaccccgcaccgtgcatacccgattcagattggcgacgcgtggacgagcgagtaatccgacggcgcgcccgcacggctccatccgcaccaggagaaggcccagctcggctcgctcgcgtcgactcccacaaccagaactagaagcgcatggactggctctgcggctcactcgcgtcattttctttccgctgcggcgatccccgcttccctttccgccgccgccgcgatctccttccccatctcgcctccatctgtcgggattgcctctccttggcgccattggcttagcccataatcccctccgttcaacaactgatgcggccacttctctcgcctgctaccgccgtcgcggcctccctcctgggccctggccacgagcgccgtcggtgacggcggcgacggctgggttggctaaggcgagcacgagccgtgttcccctcctcgttcctcctgaccacgggcatcggacgcctttggtgtaggccgcagcggctggattggcgagagcgagcagaagccaaaaggcagtggaagaactaggatctgcaacgcgccgccggaagtcaatgcaagtggagcaccattcaagcaatgaagaaaaaacctggaagtgacatgtattttgtaattttttagttgttacgtctgatcctttgcccgtgtctttctgtctttcatcaaaatgctagggtgctggttggtttttctatagtttaaccagattagttcattagcctttgctaaaagtgatgcgatttatcgctcacactgagtaggctgttggtaagaatattacaaactgagtcacaggcttccatagcagcagtgctaaattagggatattcagatggtttactgcattctgacaaaaattattatgcaaagcatctgctgctcatgcagctggttccaggtctagacccccagcaaaggcttacgactgggtataccaaaatctagaatgtgatggatcaatgtgtaaacaagattgtggtttgtctgtctggttcctttcaaaaatgaaaactggaaaattgtgtaatctgaatcttgaatgtcaaatctggaggccaatcgttctcaaacaacatatagctgatcataagtgtaacacactgcaaatggaagtaaaacatagtactgtaacatagtaaaagagtatagttgagtaacatagtaaatggaataaaatcgaaatccattccaacttgaggaatgatcaaagcttgtttagctttatcattgacctgttgtgcaacttcatcatgcatgatcatagtcatcccctcgaagttctgtgcaatctataacatatatatggtcacagatcaaccaatatgaagaaatatgactatcaaataactaggcgagcatacatgtgttttctgcttctcatcggctccacaatccccggcgactacgtcgtccgcatgcacaggtgagagaaacggctgtctggccatgtcgttcactaaggcgggtgaagaaagcaccggaatcctggcggctgcggtgcgcatggcggcgatccgatctggcgaaggaagacgaagccagaaaaagatttcgcttttgctggagccgagtccgcgtacggcatccctgccgcctcgaagcgaagccggctgatcgttcgagcaggagccgactcgagcgagccgagatgggccttttcctggtgcggatggagccgtgcagacgcgccgtcagatcagtctctcgtccacgcgtcaccaatctggatcgggtatgcacggtgcggggtttgcagccggtctgcacatctaccaggtaccaccaataaaagcctaaagattgagaaattagtagctattttgcaagatcctcccatggcctgacagcttgttgtttgttttttgaaaaaacccttgttttttcttcgaaatataatgcaaaggatgaaaattccctttataaggatactattgtaaaagtaaagtacatgggtgtttctaaaatactctcttcgtcccatagaaaaccaatctataataggatgcgacgtttactagaacaatggatttgggcagagacatgtttagattcattgtacaagaaaacgtcgcatcctatcctattgatttttattgggacggagggaatatcttgcactcaccccatagccatcaatcccctcaccctgactcacaccgtggcggtgcctctcggttatgttaccttgatactttatgacattttctaagaaacatgaatatagaaaattaaataagtgcaaaaatagtgggtctaatgcattaccactcaagcatccatcaatcaaaatacatcgcatctaacaagatatggcacttgtagtcttgtaccaagaaaattacaaaggggaacaacttttagataagcctggattggaaggagagtagagcagaagaacaaaaaaagtactaggcagtaggtacaatagcagactataagccagctataaacacatttctaggagataaaataggagagagatgagcaacgggctacaaatttatagccagctgtagcacggactccaaaatacatgtgtgtataacaggtgagaccatatacatgtgtatataacaggtgagaccatatattaattatgtagtatatatatttataggtaactattatataaattagctattaagttgactataaataatttgaagccaacaattgactatactattaaacttgctcttagtcccatctctataacattagatgaaagtccaacggtcaatatcagtttctacagtgaaatgtgctaccgtacaccatacgacctgtcgtacataaggttactgtttctaccgcaaaataactatcgctaaagactcaagacactgttgtaacagtgcctttctgctgttacagcagaggacctggttgccgaggataccgtcccccgtgcggcgtgcgcgaccaagccgccatggccgagctctgacactcggcgcgtcgaggcgataggcgtacggtttgacaattcagggcctgagcttgcatagttgcattgcatcctctgctccgatggaagaagctacaaatgccggcccgagaatatccctacgattaattccgtcgcgctctccgcccgcacgcgcggcgtggcgcggcgcggcgcggcggcgtctcctacaaatggcgagcgcccgacggagaagagagctgaggcttatcgagtccgaggcttctgagcctgcttgttgccgccgctactggctgccgatctgctgcagttgggggggtctcccatggcggcggaggtcgggattggaagggcgacctgcgcggcgtgggcgcggcggcggggcgggggcggcccggcacgcctcctcgtcgtgtacggccgcgcctccacggcatcgtccccgccgcgcatcgacctccacgcgttcgacgccggcgcctccgccgtcgccgccgaccccctggtgagcgctccccgtccgtcctcccgcacgcgcgcgctccggcggcgttgtctgctcttcgcgtacgttcggtctgagcttgagtcgcggcgttgcgtttgtgctcgcgggttttcgcaggtgagcttcgtgatgggacacgaggaagacgacgccccgcgcgcgatcgccgtgcacccgagcggcgacgagttcgtctgcgccaccgcgaaagggtgcaggtgagttctgaatcgctcccgctaactcagacactcattctgatcagcttgatttgcactaacttttgtcagagtttatacttgctgttgctgataaaaagctcatgtttcatactcccaaatcacttgaaattcagatatacctgtcagcgttgttagatcatcagccaactactgttgtaggttattcaagctggtgactgaagaatccagtgttcaccttatttcaaaggatgctccaactctgcaatcaattggacctcagaaatgtctgtcattcagtacagatggtgcgaagtttgctgttggtggtgaggtaccgtgttatccaatctgtttattatgcacttcgctctttgtcagtagaatcataacttcagattctgcagtcacaagtttggcttcttaattcttatacaaggtttcctgataccattttttctggcaactacaggatgggcatcttagaatatttcattggccagatctgaatttgcttctgggtgaaccaaaagctcataaatctttcagagacatggacattaggtgagaaaaagcagaagcattgcctattcttttgacaaacataagcataaatcgacagaatcctccttgacattgtccataaactgaattagtcatatcaatatcattcaatatgttgcattgcacaagtaacaaggtagttttaaatataggctctgcctaagagttactttcttgggtgtaaggataattactgcccaacgtttttaacataactttatttcacaaaataaagtcattttggcagatttggatctttatattgttcctccttcttgcagcttagactccgagttgttagtctcaacatccactgatggttctgcaagaatatggaatatagatgagggagcgccgcttgtcaatttgagtagatcttcggtatcgtatgataaattactgcacttttctattttggtagttgaaactgagtcatttatttgactctcttgtttatatttgttcccccctttacaggatgagaagattgagtgctgctgcttttctagggatggaaataaacctttcctgttctgcacacttgtgaaaggtaatatattccataactctcaataggatgttaatatgtgcaccaccagccactttaatcaaatccttattgcttgaataggtcataacgttgtgactgtggttttggacataagtaattggaagaggatcgggtacaagaggcttttggaaaagcatatctccacactttcagtaagcttggatggaaagtatctcgcattgtaagttcattgtttctgcctcttactgtcacatgccatacactcatcctgactatagcaatactgttatgtagcatttgagagcctttttatggtgttatggactggtcataatagggtagtttccatttctcgcatttctcaccactcaatcactcatccatattgatgtatacttctttagctgacttctccttttgacaaatttatgcatgttcttagagagaatttacagaatacttgcacatcattatatttatgcatgttctgacaaagctgtggctgatgacatttgtttagtctcatatttctggaaaattacaaaaaaaatgtatatagtagtggggagggtaccagaagtgtgttcaattgactgaagaacttgttagctggccacctcataattaatcattatatgttattgttactctcttggggagttagatattgaaagaaacctagatacctgttttgttttgataaaaataaaaggaacatatacacttgctattctacttcaccttcaaatttgacacgtgtctgaaatcctaaatctgttgctgtatgtgcattagttcataatcttcttttcgtacatattttatatttttggatgtattttcaccctttgttattagaggaagccatgatagtgatttctgcgttgtggatgttaaaaagatggaagttttgcacttgagcaagaaggttcatcttggctctccaatttcatcaattgaattttgtcctacagaaaggtaattataaccattggtctttgttggaagaagtagtgagacaaaccgaaaatctctagcagtaaaatagttggcttcactaagcatccaagcacttagtaatggtctctggttgtaccaatgttgaaatttttagcagtaaattgtcttcactagtaatttgttcagtgctagaattcttgaagatactctgaagatccagcattaaggtattagattgcccacatgccttctcaacatgttaaaaaatggatcacacaacacgatggtaggtagataagcgagctatggtatcagcattatgcatggctaatttgcatatacatgggggcaggatggagcaagatttgtcctccaccagttcaccttgcccctgaaatttaaaaggaaattgtggattggttttactctgcatttctgcagtctgcactgcaattgcagatccatatgtgaatgaagatttgtcacatcaactctgttcataagcaaacatacggatgcttaatgttgttttctgaaattactgtacattttggatggcaatgctgcagatttttgaagtactgctggatagttacagtagcaattgtctgcttgtattgcagggttgtaatctccacttctcataaatggggagcagaggtaacgaaacttgatgttcctactgattggaaaggtacacgtttctgtcaatggattgagttttgtcctctgtaagtatttaccaatatgtttttttttcccctgcagtgtggcaaatgtggttagtactctcgtgtctgtttgtcacgtcggccatcctattctatgcgttcttcaaacacgtggtccatttggaaccctaaagaacagaatctggaggagaaaaatcataagtttctgacgatcagaaattcagaatccattgtaacaccagcatggctaacagcgatagctccattgtcatgatgagcgcttgctctatttgccactattcatttctgatgactatttgccattattcctttctaatgactgttcacctgttccaatttccaacccttaatccctgaaaatattgtcatcagagctttgtgcctgaatttatttcacaattttttatcgctcgataagtcaatacataacagaactgtctctttcatgacgatgaatgactgaatgtatctccgaccacaataaatcaaaggcgtttggtctttatcactgtgtccatttcgactgatactgacaacaactatgactcctgtactggatctgataagctgttaacgttccaaaatttgttgtcctctttatttccaagacccaacaaatttgtttatgtggactctagagcatgctttgcaatctgattctgggatatctgacgttgtcggcacatcatttacaggtcatctgacactgtgaggtgtgaacaattttctgcagtcccgcagccagggagagcccatgtttggtcacaacattgtcacacagggataagaatgaaacagagatctgcttttgactggtaaactctgcttctgtgattggttagactaaacctatcctgtactaacagtttcttctttcttcgtgtggacagtgccgacgagcatctgcacgcgtgcgtggactagcagtccagactcaggagacttgttgcagctgtgccgcatgcttccatttcctactgttcaacttgtgagctgtgagacttttggggcctgttccattgctctcaaggtatctttcatctcctgaatagcattcttgaatcgcatgcggctgaatgctgatgctgatgctccatgggattcacaaaatgcacaatagtggagttgacatgagatcctactgccattactgtagtttactgcattttctgctcatgagtgaatgacaggcatcacatccttttcccttttagggggtgtttagatatgtaaagttttggtgtcacatcgggtattatatagggtgtcgcatgggtgttcgagcactaataaaaaaactaattacagaatccgtcagtaaaccgcgagacgaatttattaagcctaattaatccgtcattagcaaatgtttactgtagcaccacattgtcaaatcatggagcaattaggcttaaatgattctcataaattagtcgcaatctgtacaattagttattttttagcctatatttaatatttcatgcaagtgttcaaacgttcgatgtgacaaggtgaaaaattttagggtggaatctaaacaaagcctaatgctactacttcatggattgtgtccacccttcatcaattactgtactccaagtaatccaagtacagaaacaggagctgcacagcacttccaaaatgtgtgacttgctaaaagcctaaattgccactgcaagctagagacagatgctagatgacaatctagaagagagataagtgcaagagcctgtcattttcagttgaggtgtctccgtgtctgatgtgagggcaagtacaaaggcagagaccggtatggtctctacgttaattagaggctatcatgttacaatagttaagacaatatggtctctaaccattaatgtattaaaatactttcttactagtcatctttcttttattagactcaatgcaacaaaaaattttctaataaatgctaagagtcgattctatgccattgtcatgcgtagcaaccatctttctctttccttctttctctctcttccacgtcacaaaatatgtttgtatgacaataaagagagaccgctaataaaaaccattgtacatgtcctgatctgttaggttttgcaattggtcaagtttatagcatatttatcagtcctagattttatagataatgacgatatcagagtggaaggtgaaaagggaaaacgcagtggaaaagttccatacttctggtagcactttccacatacaaaaaggagaggattcctctcttctttcgttccctcgtgctgctgctatgcctatatctcttctcatgtacccttcatattatcttccatttgcattaagttattatcttcaaatgattacttcacaactttctttgcaagcgtgaagatttgcatcaaactgatctcctacatctatattgcactgatttgatctaccactgacagaaaagttgtttttgtgcctttatggttgtgtacattcgttttgttcacttgtcagatagcactcagatattaaatgtgaagtaaagacgccaacaacttacatacacaattatacattggataatgtaagagttattagaagaccatagcatgtgttgcatgtgcttaagccgctatgattagcaaagtttggcaaggttttatttgctattgcaaaaaaaatgaaaaaggtagtagatttgtggggctgtgaaagctatatccaatatgcatgtaccagtacgactccacgttttcatgaaactgatatgcatctttttgtttttttttcttcgatggaaactgacatgcatcatgtcgatcgatttcaagaagggaaaaggaactaatctaaacagtttttaaacacgccgaattcgacgcttctggctttggtggcagtcgttttctccattatgatgaacatctaaatagctgtactttatgtgcacattttcaatcttatttcagttatagccattgcatatgattgctctcaagtgcaaatttgtagatacatatggaataatggatagttagagatattaattaaggagaagtccattcattcgccgtgggcgtgtcaatgtgtccttgtcatttccgatcatgcatgtttcgagatctgactttgcaagttgaggctggtcgtgatcacctaacgtcggggtgccaaggaaataaattacaggtaactgcctatacatcatgtgatagattttttaacctcctatcacgcagatttcttacactttagatgaacatctaacggatgacattaatatacacaaacaaaatacaaaacaccaaacaaacgggccatgtggataatctgaagctcacgtgggctcaaatgggctcaagtagatttcagacttacatcgtaaatatactaacattgagtttgaggagaaagagattgagaagatacgcaaaacaaggtaagccattagcgtatgattaattgagtgttaactattttaaatttaaaaaattgattaatatgatttttttaaagcaacttttctataaaaatttttttacaaaaaacacaccgtttagtagtttgggaaacgtgtgagcggaaaatgaaacaaactcactctctttctccagctgccgaacgcagccaaaattacatatgtaattatagtgtaattacgatgtaattagtacgtgtgggattataaacaaattagcattggaaaacacggctcaaatcaataatgatggagtcggcaagaatgctacacgaatcttgacactatccaacgtacataaatctgcaagatatgggactcaaaaatctgtcgccagacagatagcaattccgaaaaagatatacgactttctagtttattgcatagaaaaaaaatcaattatgctcattctaactgaaatgtcatgcatatctcccccatgatttttttgggcaaatcaatattgtgccacccttttgaagataattgttgtctaacaaaaaatatatgtattgctatatatattgataaagatctttgaagatcagcatgtgtattccagattcctatctagaagccatttttcaaacttgtaaacatagaagaatgacttgtactcgaaaaggttattcgtttatttctccaactatctgtatatacacacaaatacgtatcactttccagcactttagactttttttccctagcatatgagcccgatcgatcatgaaatatctgttggcattgtggcattgatgtgcaccgcatttagggatacacgtaattactatccgtcaacaatatagttaatgatggatcagtcgagcctatgcaacgaacagcttaactagctaaagctagcacagtaatcttttttttaaaagcagatcaagtaattgacccggctttttaaagaaagaccagaggtaaatatagcacaatgatctttcatagaagaatccggttccctagtgtgattgtaacttaagcaataagcactctagaataaaaaaaaccagaagggtaaggatgaaaacgatgatggaaagcgccatcattttggtactatagaattagtttcttaaattttaagtgaattacactttaggctagttattttttcctaagttacatggtggaccaattattgtcttatgttttcacttttgactgaattccttaccatttgttgcacattggatcatattggacattgttggtatctctttgccaccatggctagccggtgagggatcaccagtccacagcaaaggacttgagcgtgttcactgcctcatcaactcttagcctaagattcacgacaccacttctttctagtgctactactttctccgtcccataatataaggattttgtagtattacgatgcatgacaggactcaggagcttgccaatatgagggcatggatgatatagtcagcacaatgtgagaagaggatcgccaatccagagagacgagagaagctttgtgtgccatgtggggaagactagttttggatgaatcaggttaagtaaaaaggctattataggcactaacacgtggggttactagtctaaagtgcaaagtatttcttataaaataagtctactccattcatcctaaaataattggggcaattttatttctgcccctactttagtgtccaatattgattctaccatactttttagggttttcgtttttgtccctacttttttgaaccgaacaatatttttgcctctgttttgcatggagaagttaacggtgttaaattcttggcaaaaggacatttataccctctcatatctctattcattaattgtgtttttgcccccattttatgcatggctttggaaatttaaattcttggcaaaaggatatttaaatgacccacattgactaacataacaacttgcacagattctgaatttgatggaatttctacaaaatttcagcatcattttgacaaattgaacaaaactttgacaaaatttcaacgacatctcagcaaccttgccctctcggccttcacatccaagccacctgtaggtcgccgcctggccgacgcccaacgcctcctggccggcgcccgctgccgcctagccccctcctcgccgccgcctgtcactctccctgccgccacataccgcgcgcctcctgctcgccggcgggaggggctacggcattgcgcctggccgccgctcgctcggcgtcgacgcccgctcgccaccacctacccctctcctgccaccgagccctctccccatcgcctagaactatccccgtcgccgcctatcgcgcagcctcctactcgccggtgggaggggttgcggcgttgcgcctggccgatgacccgctcgccgccgcctgcaccgctcggatggccggatgggtttcagccgttgttatattcgagaggagagaagaatatgtgggttagatattttccaggggtaaaaaggtaaatcacaaaatcaaaaactattttttcttttatttctctatttctttactgctataaacccggtcccacaaacttccatctaaaccaggggtaaacgcctctttcggttcaaaaaaaaagaagtgagggtaaaaacgaaaaccctagaaagtagggtagaatcaatattggacactaaagtgggggcagaaacgaaattgtcccaaaataattttatctatgatagaatatgatatattctagaacaacaaacaaattttatccaaattcgttgttctgaaataggtcgcattatattctagatttagctattttgggacggaaggagtagtctaaagtgaaaacatatgtcaatgtctagttcaatgtgcaacttgggtaattaatggcctcatcttttcgcttaagcttatacttatcagctaaagttttgaattttcaaccttaaatttggggttgattttagggttttttttaattgaagtttacttttcagcctttgcttttaaatcactaagaacatgtatataaaagttttattcgcaaattatttttcgtttgtaaatatgtcatttcgctgaataagcgaaacgatgggccgtaaatctagtctaaagtgcaatttattttaattttttagtggtgtattgcaatcttcaaatatagttaattccctactgaccgagaatctttttgataggtgctttcgtttcggtctgttttcagtcctacgaaataccaagatcctttctcgataccgtatcaaattactgtagcagggtgttttaggtggtactggtaggtggttggcctgacttgtatgtgcaagagttggctctgaatgctgtcgattgtgttactgtaaagactaactcaaattcataggacagaggtgagatgtggatgctcaaatgtgcaaagaagagcatgaataattctgatggaatctcacaagttttggaatctgcaatacgggtttaatctactcatgttttgaaaaaaaaaatgtgcacaacttcatgggtgctaataccaagcagggtttggcgtcgtttgaatcaaagaaatgcaaacatttcgctgtctccaactcgatctgtatgcgctgtccttagcacgcacgttgttgttcttccaatgtgcccggtcactaaaaaacacagagaatattgtagagtgtactgtgtagctgtgaagatccagtatgatcccgtgacatacatagtgcaattgtttaaaattattctgatgatactaactgataaacttgacctagtaggatacagagagatcatgcatagacttggttaatgatgctagtgagtagtgacatgataattaagccgagacatgtacacatgtatgctagtgtgatcgaagtgtgcactcaaggctaagtagaatactggaatcaactaacctattgctacctcctccgtaggatcgatgcaaacatgatattatatatgcaagttgccttagaagtcaatatgttagggcgccttcggataataatcatctgtgattgcagcttgattgataattagtagggtggcatcagagccatttgatgtaggcaatggacggcccagatcaagctagccagcaaaggagtcagtccagtcaaatagtcaatccaagctgaggtgtaggctagcaagcatggttgaatgcgacgagctaggtcaatcaccgttgcttcaaacaatcacagggcacccggaatccgttgactcgctcacagtggcagtcaacacaggagagagaacgattcagtgtttgctagtgccttggcaacgcagatgattcggacacaaatttaatctgagatataaatccgaattgtgattttgtgcacttgtgcttctaatgtatatttttttttcatatagaagttatcatattatcatataaaagttctcaagtaaaagttttgttaaaaacgagaatattaggtaataacctaatatcaaataattagaaggggtgagacttcgaatccatatcgtatagcccaccatcttgtaaagctagccgaaaaacccttggatgtttcttggtgaaagcttaatgtacataaacaacaatccatacttcggtcggtatagaattgaagtggcatttggaaaacacccatccatttgtgatcttcattagaagaaaagacagtattaaaaaagtccaactcaataatatattcccttcgtttcaaaatgtttgacaccgttgactttttagcacatgtttgaccgttcgtcttattcaaaaaaatttatgaaatatgtaaaactatacgtgtacatgaaagtatatttaacaatgaatcaaatgatatgaaaagaataaataattacttaaattttttgaataagacgaatggttaaacacgtactaaaaagttaacggtgtcaaacattttgaaacggagggaatatatttttatcactgcaacatgtatagtaacaacaaataaattggcacaaaggatactagtgtgaacgtagtagacaagtttttctaacaaaagttatttttgtttatttcaccaagccgccaacatgtatagccgttgtattgtacatgtgaaaatcttcactaagcaagcagtctaagatgcgatgaccaaagatgatcatttctatacaccttgtctacttgttacgccgtccttaacaacaccaaattgtcgcaaatcacggtagattttatttaaaatcattgtcttctactatttgttacgaaagtgcatggttggctccctccccggctactcggcctccaaggttgtaaattagaacatggaaagagacggccatggcagtttcataacgagaagagatacccttgtactttcttattgcttaattaattcacacccttcaccttaattaatcatgccacatggtcttaactataagactatccatatgatcacagtgcgcatctgtggtttattattatctctcccaaggtgtctcagttggaccttcctaatcacatgtatctttgtttattaagtacgtaccaatcacaactatctcaattaatgcttgcatagcactatcagaaagaagctattaattgtgtggcatcaaaacctgaaaatagttgacaactaaccaacatggcaacatgtaagtactgaagctgccgtctaattaattaatttccctcgagtgattgagcatcatcaactcatctatgtcatggtgctacatcacgttgactagctagctatccaagagattggcacttttaccacttatcaaactatcagaatctctttcttctatatctgatactccccccgtgccataatataaaaaattttaaggggatgtgcacatcctattattatgaatttgaactggggttcatcacatcttttcaaaatctcttatattatagaacgaaataagtactatcttgttctgatttttttttctatgacatattctgatttttattttgttctatccatggtaaaatatgggcattctgctattttttttaaagtatctcaccagctgtgagactgtttcacactgtcactgacaaaccggtcccaccgtctagaagagcagaagctccagcggcaaactgccagaactgtagagatcaacaacagcacgccatatatggtcagcagagatcgctttccatcgccattgtggatggtcgtcggtacactcccaagtcaaagtcgcaacaacaattaaagaattaatcacaccatcatctcgactgaaaaaaaaaagatggacactaatattctgcaacatacgcggcctctatgatgccgcatggagccaaccgtttactatacaaacaagcagtcccctttcatgaaaactatagcgattgcgatttgcagagagaccattttctcatctattttcaaacactcttgctttcaaaatttcgttttggaacttttgataccgtccaactcccattaggcgttgcgtttgtatctcatcatccttatctgagaaaaagtagtcaccgtgtcagagtgaaaaaaaaaagactaaataagccaaaaaaaaaactttcattttttttaacggatcttcacctcacgctaatacggttggttgctactgcatcaccatctacagatgtaaaccatcttcatagtgcatccaaaatatcgaatatagttgaaaggttatccatgtcagagtaaaaccaaacttgaggcaaacgagtcaaaaaagaatttaaaatttcgcgcacgtttggatctccacatagcgctagcaccgtttggatgcatatccagaatttccggaatgcatatccaacatagtgggaggtggctggagccacatttaagcagctcaagacaatatttccccctttttttcccgttgaaaaaagaaaaaaaaaacactttcccccctctttttttcccctcctccgtgttgccaacttgccatccacccgttgctcgccgcagccgcccgcgcgctctataaaaacgcgcgcgcgcgccgcgctctcgccaccggacaagccaagcgcgcggcgcgtccacacacatttgcatagccacagccaagaagcgacgcgatggtgacggcggagtcgggcgtcgccggcggcggccgtggcgcggcggcgctgctgcgggaggtggcgacggcgcggttcgcgcggcaggtggtgctggggcggtggttcatggtgttcgcgtgcctgctgatcctgtcggcgtcgggggcgacgtacatcttcgggatctactccaaggtgctcaagtcgtcgctgggctacgaccagcggacgctgaacacgctctccttcttcaaggacctcggcgccaacgtcggcgtcatctccggcctcatcaacgaggtgacgccgccgtgggtggtgctcgccatgggcgccgccatgaacctcgcgggctacctcatgatctacctcgccatcgacggccgcacggcgcggccccccgtgtggctcatgtgcatctacatctgcgtcggcgccaactcgcagtcgttcgccaacaccggcgcgctcgtcacctgcgtcaagaacttcccggagagccggggcatcgtgctcggcttgctcaaggggttcgtcggcctcagcggcgccatcttcacgcagctctacgtcgccatctatggcgacgacgccaagtcgctggtgctgctcatcgcgtggctccccgccgccatctccatcctgttcgtccacaccgtccgcatcatgccgtacctccccagccgccgccgccgcgccgacggcgagctcgaggcctccgccgccaccagcaacgacgccttcttctgcttcctctacatctccatcgcgctcgccacctacctgctcaccatgatcgtggtgcagaaccagaccaacttctcgcacaccgcctacgtcgtgtcggccaccgcgctcctcctcgtcctcttcctcccgctcgtcgtcgtcatcaagcaggagtaccagatcaagaaggagctcgacgactccctccgtgagccccccacggtgaccatcgaaaagccagccgccgccgccatgcaaatgtcagcgatcaccaccaagcccaaaaccgagacaccgtcgtcgtcgtctccggcgccggcgccgccgtcttgctgcctcggttcttgcctgaagcacatgttcaacccgccagcgcagggggaggactacaccatcctgcaggcgctggtgagcgtggacatgctggtgctgttcctcgccaccatttgcggcgtcggcggcacgctgacggcgatcgacaacatggggcagatcgggcagtcgctggggtacccggcgaagagcatcaagacgttcatctcgctcatcagcatctggaactacgcgggccgcgtcacctcgggcttcgcgtcggagatgttcctcgcccgctacaggttcccgcgaccgctgatgctcacggcggtgctcctcctcgcctgcgtcggccacctcctcatcgcgttcggcgtcgcgcagtctctctacgccgcctccgtcatcatcggcttctgcttcggggcgcagtggccgctcctcttcgccatcatctccgaggtgttcggcctcaagtactactccacgctctacaacttcggctccgtggcgagccccgtcggcgcctacgtcctcaacgtccgcgtcgccggctacctctacgacgtcgaggcggccaggcagcacggcggctcgctcgccggcggcgacaagacctgcctcggcgtgcagtgcttcaggaaggccttcctcatcatcaccgccgccaccgtcgccggcgcgctcatctccctcgtgctcgtctggaggacaaggaacttctacaagggggacatctacgccaagttccgcgagaacaccgccaccgacgaagctaccaccaacggtaactccgccgatacagcggcggaaaaaaggtcaaccttagtcaatgacgaggacagtaaaaaggggtagtaatgtagtttactgatataaagattactacaccaaaagacaagagcttgttacttcttattagcagaaaagtcaaaaaatggtaggcttgctgctaatataagtttccagatatctgtaaaaaattttggggctaaaaagaaagaatctactactagtggagtaaacaagattaggcagcagctctgtgcttgtacccattacaagcaacagtaagctgcaagctagagtaaaatactgtcactgtaagaagttgggtgattaaggccctgtttagatgggactaaaagttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcatgaattagcttttatttatgtaattagttttgtaagtagtctatatttaatactctaaattagtgtctaaagacagggactaaagttaagtcactggatctaaacaccacctaactgatgaaacattggcttctgcctctgctcaagatgggcttaattatgctgtaattaattaccttggcaaaggccggtttgaccattaaaatggatgagacggatgaagcgatggatgaatgccggccacagcctgggctagtgacggtgatgtctaaacatgaggtggagctttttttggctgctgctgaatcactccatcatatgcaaacgtttgtttctttgcatcatgcataagctttgaattttgatgagaaccaggagagatgctcacggcatattagcatcacttgttgtttctttgcgtttcaattcttggcttgatccccatatctacggcgcatatgacgtgcagttcttaccatctgaaaactgaaagctatgttaacttaaccccattggatcccgagaaaattgcaatttgggactgcaaacatagggacactccgagtggatgataattgggcccatctgtgtttatgaaatgtgggtccagtgtcattatagcaaaagttaatgtttgcagtgttataattgcaaatcccccgaatcggatccagaggggaaatattgcagttcagaagagtacagaatgacaacattgactgattgacactagaaatacatagatttggtcatttaggagttcacaagagtacagaaaacggtcatatatatgcttcaaattttataaacctcctggctcctgattctcataccatatgctaaacttcatataatgctgtctctcgtccaaatttgattttgcaaactatagggtagatgattgcagaaaaccactccatcaaggttcagttacttcaaatttactagccctattagctaaagaaaacctgaaacaaaaacatactactccaatttaagcatgttggagaagcccaagaataagcctattttgcctccgtctcctcttgtccctggacgaatcacatcactcaagccctcaaccacaacttcaataacaggtgaatttgacttcttcagtggttttggaagcggtttctgttgacgtggtaagttaacttggttaaaatgtgctgacgtggtagactggtcatcaaagtaattaaaaatagaagtgggtcccacatgtaagtgataaggataaaaataaaaataaggtgtgagccacttgtcaaccccacttctctctctcggcgaaatgcagcacccaaaattacggcccatatagatgggtcggtttgtgtcttcccaaataagcccacatacaggccctgtatacctggatgggcctacattgaagcccatctaaacgaggcatcgggccggaatcttaccggttttgggcccttatgaatattggcgtgtcgcgacgccccacgactcatcggcggcttccctcccatcgccgacatgcctaggaaggagcgcgacagcgagagcagccgccgccggcggcggcggcggcagcgcagccggtcgccgtccgactcggaggaagcctccgactccagcggctcgccgcggcggagccggagccggaaccgccgcaagagccgccggagggacaccccttcgtccagcgacgcgagcgattcccaggcgtcggactccgggtcggactccggcggccgggtccggaggaggagcggaagccggaagaagggggaggtcaccgaagagcagatcgtggagtacatggctaagaaggcgcagaagaaggtattggggcggtggaggttcgggttttccgtttggttggctccattgttgcggctagggttttgatttctaactaacttgttgatggtggtggtggctgtgcaggcagagaaggtagcgaagaagatgaaggcgaatgctgtgtcggggtactccaatgactcgaacccctttggcgatcccaacctgaccgagaagtacgcgaattcgtccccctctcctgccacattattcgttccattagtggtgttgcttagctaagtagaaatttgggctgaaatttgtttgaactgtgtcacggatgacataaacaggaggccaaaagttacacttcccttgtttgtttgatgccctaaaattgtgtgcagattgatgattactgtcatttatttacattagtaaggcttgagcttacttattgatcacttcattttgacacctacagccaccaaggatacatatatcttgtatagaaaaaaaaaagaaaatgctcttggttacttgtgtggcccaataaaaaaaaactctaaatgtggtttgtctaagccaactggtaattgtatttggggaagacgtcaagttggttcgttagatataggtagtatttatcagttgcaacattaacacagctaacaacttacaagtaaaatcgaggctataatgtttgtctaactaggtagtgtactggacaaatgtatgaaggattgaattgatagcttagtgaactactgattgagatcatctgactacggtagatgtcttctgacttgtttattcatttgttgcactctctagaatgagttatgaacatttatgagaaatctttctctcaactgtgagaaatctcgtagagcattattttgcatactgttatcagtagacagttttgcagtcaagatttctaatgtttaacaatgttatcatgtgatatgaccatatggaaatgttgttggctgcacttcagatcctaattttatccctacttgttgcgtttgcactgattgcttactttgactgttcaaaagtaatactctcaaccttgtattggtgcagatttgtttggcgaaagaagattgagcgtgatgtatctcaagggcaaaaggtggacatttctgttaaaggtgaaaagaagaaacagagagaaagaatggtacttcttttttccttttattatcctgaacttcaaatcttatgataggagtaccactggcatgctttctgaacttggagatgactcttcattgaaattaacaaaaataaaggactcaaaggacatttactcaatactacttgctttcattttaggataataaaacaatattatctcgtgttaccttgccagattataattatattgttatcatcttatgcaagtgtccaaatacataataacacgttggggtgagaatacctatagtttcacccaaaacaatagtgagaaacaacagattatgtactaaacatttgcatcagtgcccaatgccttgccccaaagaactacagcctaaaatgtggatgcatgtaaatttacacatgagtagagattatatggatctgtttcttgcaagaatgccattggctggttctttgcagaagcagttttatatttgatgttatctttcaagatagagtaatatgtcactagcctgcaactttactattttattcttaatataggctgaaatagagaaggttaagaaaagaagggaggaaagagcgatcgaaaaggcacagcatgaggaggaaatggtctgtatatatctctctggttaccattaatcttctctttgtttcaagtaacacttttttgtggaactaaatgtctataattgtatttcttaggcattgttagccagagaaagagcacgcgctgagtttcaggattgggagaagaaagaggaagaggttcatattttacaacatggcaaatatcatttggtctcatgctgaattaagccggacttcttttatgtaacaatttttgtcttctattgcagtttcattttgatcaaagcaaagttagatctgagatcaggttacgcgaggggcgcacaaaacctattgatgttctcctgaagaatctcaatttctcagaagaatttgatgttgagttaaacgagccctacttggtattcaaggtaaattgaacttctcttacccacttgattatagttaaccaaagagccgctatatggatgcacctatcgagaagttactttgtatgtatctggttctcacatatgatgttcactcaatcattagctgatgttggtgccaggctttctttcatactatcaaacaaatgcaataaatttcagatatacatcattaacattctggattctcttctgaaagaatggctccctataaccaactgtttatccttctataatctccagcttcatccgccttaagcgttacccttttagaacgtgcaggaatactgtgtccttgtattcaaagtaaaaggttcaatgtttcaatatatcctaagataccttacatcttagaaatagccttaaacattctaacgattcatcattaactacattctaattagagaggtggaaacatgtatctctcaatgggtttgaaatttaatcactccatctgttcttactttacaactagcccagatctgaaagagttcccttttccttttaacacttaaacatatgtgatgtgctaaatgcagggattaacggtgaaggaaatggaagagctgcgcgatgacattaagatgcatcttgatctggacagggaaagccaaataaatgtcaaatactgggaggtgtgtctttgtctcaacattcattataatattaccctttacttgaataatcatatgaattcatatgactgatgtgtatgttgcataatgtatattcctgttgattgaggttagtaccaaatggcatatagtccaaaacagtaatgctaaatttttgagattttgataattatgttttgttggatcgatctttggcaaaaatattgtgccgtagtatgtcagaacatattttttagcttgttgtatatatggtttgcctataggccgtaggttttcacaaaaaaaaaactaaatcaagttattcctaatatgacagtaggaactaataatttctgtgatttcatgttgctctcttgatctaattagcaaggatgctcagggctgttgaccaattgtccactctttatttcaaattcatcaggcactcatggtggtatgtgactgggagctaggtgaggctcggaaaagagatgccttggatcgggctagggtgcgtggtgaggaaccacctcctgatgttcttgcggaagagaggggcttacatgcaagtattgagggtgatgtaaaggatcttttggagggtaagacttccacagaactagaagagatgcaaagtcaaattgagtcccaaatgcgctctggaacagcaaaagttgttgaatactgggaggccattctgaaacgccttcatatttacaaagcaaaggtatgccatgcttgcagacactaaaagacactcttcttttcttcttgtagcaaatgtgattccatccatatcacactatcttggttgtttcatttgcattacacaaataaaatgtgttctggtatcttgatttgaccttagttcttgcatcataatcagatcctggtttggattcttatatgaacttgtgaaactgctttgcctaactttctgaatttgcagtttatatggttgcccggtttaaatagtgtataataggtgaaagcttacctttttctgcattgcaggcttgcctgagggaaatccatgcttcgatcttacggaagcatctacatcgtctggagcatcctgattccattgagcaggataaggaatctgaggatgaaatcgatgctaaagagaaggatgcaacacatattgacgatgatgatgatgatgatgatgaaggtttagttttatttctgtatttccagtcactcaaatactcccttccatgctgtaactctagcgactatgagttcttatacctactttatgtgtagatgataagcgatattcgcctgaacctatagcggagcaaacagagagtcatttggatgaagaagacggatccttttctcctgagctaatgcatggcaatgaagatgaagatgcaattgatcctgaggaggacaaggcagaactggtagtgtcctcactcctgctacacttagcttttaatactgcctccgtttcaggttataagactttctagtattgtccacattcatatagatgttaatgaatctgggcacacatatatgtctagattcatcaatatatatatataaatgtgggcaatgctagaaagtcttataatatgaaacggaggaagtaaatgctaagaaaatagtggtagtttttatgtagtgaagtgaactgcaattgttttacaaattggcagacttactatttattagacactatattgtgcaaaaagatgaacaagccagtacaattgtttaggtatcatatagatcttttcttaaggcaccaactggattcccattgacccattcatgtttaccctgagaaaggccttttagtttcatcgtgtaccatagtacacttacggtcatttgtcagtgtaaggtgttattattggcttatatattggagtttacatacatgaaatttttatctcaattcaggattacatcattaggtacattcgtgagttgattgcagattttaaatgttggcaattcatagaatattcctatgcactttgaattaatgtccaggatcgaaaacgtgaagctgtagttatggagcatcaaaagaaagttcagcaggccatcgcagtgaagacaagagtacccgatgagatggagatgaaagcaatgaaagcaatgggagctatggaggaaggagatgctgtgttt

SEQ ID NO: 59450 - DNA, 2195 bp, Oryza sativa
ctagctaattagatcgtgctatatactaattggtgttagactttgctctaggatcacctaggttagatctagtcgggtggttctatttgggtttgatgaacgacattgtagatgaaagggagagggtttagataccgaccggttgaggagttcgtggaggaagaggcgccagacatcgtcgttgtcgtcgcggcttgacgtggatgcggcgccggtgaggtcgacggtgatgacggctgcggcagtggtggtcgtagacgtcccggcgatgaggcgtggcgcggcggtggcgtttcccgtcactggctgcgccccctctcgatcggattagggttttgtggggtggagttggcggcggcggtgaatctcgtacgatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacaattgggaccccagcagctgaggtacatgaccgtcctcagcccctcctcggccttctccgctctcctcctctccgccaccgccgccgcagaagcaggcagcttcttgccctgagagacgccggcggcgttggccttggctgctttgtggatggaccgcagcgcgtagttccagcggcagagtccgccctggtccttgagcgcctccacggcgcccacgctcatcgccaccatccacgacgccttcgctgcacccgccattgatcgagctctcttctttcttgctaagatcgaccggattgtcctgtggtttcttgctcctgatttggtttgcagtagagttgttgcaatgctgagtagttgatgctgtgctggtgagaaagagggaactcgggttatatagaggagggtgtggagaggagaacgacgggttgggcgaaacaaggaggcgccgcgcgttggtttcccaggataccgggtgctttgctctgcttgattacgccggaattcgctttcgtccaggctcggtggcccgcatccacctcatctcgaggcgtctctgttggcggtatggaagctggttgtccgttgcgagggtccacatgagcagtgtaaccgatgaggacgcgtgtcacttgagatgccacgaagggctagtgtctgcatgggcctgagttttgtgtttagctcagcactgtaaaccattcttcctccttcagcaatagttattcaatcatctattctattattattatatactaaaagtccatgaaactttctataaacgctctcaagccgccacgtggcgctctaataaaatagagaaaatcctagaaattctaagaaaaaagcaaaacatctatcccttaatttttacttaaattggtaggtccaatattatacaccgttagataaaattgatcttaaaacaaactaaataccatggtcccacctatcctcttcccacacattggcaggtgtagtatatacgtacgtacatacgtacgcctccttcccccccctttttttttcctttttttcttttttttcttattttttccatttatatatataatggatatatttttaaataattaatcataattttacaaacaaataatctaccatcatataacttaaaccggtgtacttttttactttgtactactattttcaaataatgcactattttaaaataaattttacacaattatatcatgtatactaaaagtccatgaaactttctataaacgctctcaagccgccacgtggcgctctaataaaatagagaaaatcctagaaattctaagaaaaaagcaaaacatctatcccttaatttttacttaaattggtgggtccaatattatacaccgttagataaaattgatcttaaaacaaactaaataccatggtcccacctatcctcttcccacacattggcaggtgtagtatatacgtacgtacatacgtacgcctcctttccccccttttttttcctttttttcttttttttcttaattttcccatttatatatataatggatatatttttaaataattaatcataattttacaaacaaataatctaccatcatataacttaaacccggggacctttttactttggactactatatttaaataatgcactttttttaaaataaaatttaccacaattat

SEQ ID NO: 59451 - DNA, 4151 bp, Oryza sativa
tcaattaacgccaatattggcatatattggcacagactggtgcgatgtttttgaccggaatgaaaaagttcaacaaacgccaaaacatgattttcggacatattggagtgtattgggtgggttagtggcgaaaactcactttgtgattcgcgcggcgaacttttgtcaattaatgccaatattggcatatattggcccacgtgggtgcgatgtttttgaacggaatgaaaaagttcaaaaagcaccaaaacatgatttttggacgtattggagtttattgggtgcgttcgtggcaaaaacttacttcgtgattcacgcggcaaacttttgtcaattaatgctaatattggcatatattggcccacgtgggtgcgatgtttttgaccgaaaggaaaaagttcaaaaagcaccaaaatatgatttttggacatattggagtgtattgggtgtttgatgaaccctgagctccactcgagacactcaaggctgttgttggcccgatctttcggggagctgtagataactacgatttaggagaaacgttaacgacccgactacaaccgtactagatgttgttgtgttgcgccttagctatcgatacacctctccgtgggttgttgatcttgccggtgcagatcaaccttattcctgcaagcaaatcgaagaaacaagcaagaacaagattaaagcaatctgaattgcagataggaattgaacataaatgataagtttggggttccgtaacgagcaaacccggcgatctaaccgatcacggcattacccggcaaagtagcaaagctaaactttaatctaaacaaaacccgagaaaccctgaaggggtacctaactatttaaggaggtggttggacgacctaggggtccctagggtcgtgctccagctggttggggcgcaccccacatgggccccacttgggcctgggtcccaaacaaagttacaagcccataggcctattacaggtgacgcagcacattgtttcatcaattgcgcatgactgtgaaggaatttggcgatgaggctggatctgtttgaaagaggactccgagagatttccatcaggtactcatgtttcaaaaacggatgtcgtatgaatatttggcggccgtttgaagtcagcagtgtagcaaatggccgaatcggattccaacacttggaggacttgatcttgctagcatcttgttcatccatgatgtgagcaactgttgtatccatagtagccatggtcacatcatcctccccttcttcacggaaaaccgtcctcggtttttccatatggtgctcgtcgcatggtccatttagaacatgtttcttccaatcaaaacaagacaaactcgagataatatgattagcaataataggtctctctaacttgtatgttttatctacatcaacaggaggttctaaatccaaacatatataaattctatgcaccaaatatatgtctatcattatattcgccagatatgaaaaataacattagttggacatggcaaattagatttatcaaataatttctccttcaaactatcgagctcaaaaaaatcatcacactgaacatagcccaaagtatttaaagatgatgtcaattcacgttcctctacttcattagcaatgtgaagaacatgcttaaaatcagcacacaaagaaacactagagacaacatgttcattcacttgttgtggcatggatataagtgaagcattatcacacaactcttctttatcacaaggaataacaagtaaatcaacttatgacaaaggcatctcagcaattggatccactaacggttgctctactatagcatgaaaagtggacatgtctagctcaccttgagtatgctcaccttcaattatctcagcctcattgaatttaccttgcaaactttcttcagattttacaggtgcttcatgcttctcctcttttttcacaaattcatcgttctcctccttttgtttaatgttctgaacttcctgcaaaatgttagtaataggaggcacaagacattgctcctccaatgtttgcatatcatcattgcacaaagatataggagattcaaaaacatgagataaatcacattgttcatgctttctcacatttgatatgatttcactctcaatgctacgagcaagcatgaataggtgtccaatatgattatatgtcacattagcaagcacaatctgaatataaaaattaagccccttgaaaaatttgcgcattgtgttttcattgcactcttttagatcactgcagatgacacaaactttaaattcatggatgtactccctaacagttctgtcaccttgattcagatgttcgaatttctcacgagtagtagatttgtaataagaactcacaaaatgctttctcatcatgtttttgtattcatcccaagtttcaggtttgttactaacataagtccaccaaaataatgtagaagaggtaaacttattactagtagccttaatcatttgagcatcagaaaaatcataattgtcaaattcattgtctactgctagttcccaatcaatatatgcaacagaatcatgcttaccatcatagaatggtaacttagattcaactcgcacaaaattatagtcatgtacctcgtatgcatcacgtggagaagttgtcatatcttgtagacggtgaagaagccgatgttctcgtattcccttgcgcaatcctgccatggttagtagcaaacaagaaacacacacaagaatatgcacgctcctatcaactactaggtagtggcagctcaaatatcacacacactcaatcctttaaccaagctcttacaagttcttaccaaagcaagtggaatggtgacatacactgactcaaccaagcaccccaatagaggttggatgtatcgatgcctcggcaaacacttgctatacggctgcaatcaaatctgtggagctctgggtaggcttaattatgtagcaaaggaatagaaaatgctcaaatcagagaatgcaaagttgaataattgttcaaagtcaagtaccgtgctagtcctaggctagaacgtactagagacacgagcctagacacaaatgatatcacaagatagcactaggaacaactcatgcacaactctgatatatgaagttcagctcaaacataacaatattttctcttttctttctttcttctttcttttttttctttcctttcgttttcttttctttttttagggtgtggcttttcttttcttctttttattttttttttacaaaaacagattcaaggacctcaatgtaaggttacagggactcaaatgtaaatataaaatttacaaggactaaaatgtaaaagtccaaactcaaaattaaaattatataaaaatggaatgctgaatttatacgggttccctttttgcaaacggatctccaatccgacactccaaaatttttcaccaagatgttttgcaacccacggtgtggattgaaaccgggagggaggaagccggactcggctaagtgggtgacggcaggagatgagcgcgacaaccggccttgacgcatgggaaaggaaacagacttggcccaagtagaaagttttctttagacgaaacaaaccaaccggactgatctaatctgcaaaatatcctccaacaaccgattatcctctcttcttcctcgcgcgacagaaacaagagcacggtgcactagacaactgaaatccaagatgcaactccaccgctccaaaactaaccgatagaaacttctgaaaactacaaaaatagaaccgtggcagtgagccgattccgcttttgtagatcccgacaacaactaacacacggcggtggcgatgacagtggtactaaacgtgaccagaactcgaaactctaaacggactaaacgctaagaccagcaacacgactcgacgatgcaacacaaattcaacagagcaaaaactgaaaagaacaatgcaatagcacaaatatggctaggtgatggatgcaacttttttttagctttttctagttataggtagacaaaaactcaccgagtaacgaaagctctgataccacctgatgaaccctgagctccactcgagacactcaaggctgttgttggcccgatctttcggtgaattgtagataactacgatttgggagaaacgt

SEQ ID NO: 59452 - DNA, 1636 bp, Oryza sativa
aatgaggcttgatgcattggaaagaggactccgagagctttccatcaagtactcacgggctgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcacatcaactggagttaagcagatctcccaggcctcgtgtttttacatcaataggaggacacgatcttgatatctccttgttcatccatggtgtgagcaatggttgtatccgtagtagccatggtcacatcaagttcgccgcacgaatcatgttgtgatattttgccacgaacacacccaatacactccaatatgtccaaaaatcatgttttggtgctttttgaactttttcatgccggtcaaaaacatcgcacccacgtgtgccaataatgtcatttattcacaaaagttcgccgggcgaatcacggagtgatttttttgccacgaacacacccaatacattccaatatgtccaaaaatcatgttttggtgctttttgaactttttcattctggtcaaaaacatcgcacctaggtgtgccaatactggcattaattgaataatgttccccacgcgaattacgaagtgattttttttgccactaatgcacccaatatactccaacatgtccaaaaatcatgttttggtgctttttaaactttttcatgccggtcaaaatcatcgcacccacgtatgccaataatggcattaattgacaaaagttcgccgtgcgaatcacggagtgattttttgccacgaacacacctaatacactccaatatgtccaaaaatcatgttttggtgctttttaaattttttcatggcggtcaaaaacatcgcacccacgtgtgctaataatggcatttattgacaaaagttcaccaaaaacatcgcaccaatagtgggttgggtgtgtatagggatagatgcttaatctcagatattccacaagtgttggtttgtatttgtatgcaggtgataaaccctaaagttgggaggaaatctagactaaagtggggagaaatatgtatccatacaaggatgggatctaaacttcatcaaaattcccgagaatcatcccaaaatcctgaggaatagatagaggtggaccaggggagaagatgggtcaagagccaggcctgggggcccagcccaggttttgccgaaccccctggttcggccgaaccaccatctccaccgttggatgtggggtttggcgtggacgtcccagatgcatccctgatgacggttggagggcacttcagacatttccccttcgctaactgtcatacctacccctatataaagacatcactccctcacttcacatacacactttcaagcttgagctgaattataagaggctctattgtactatattgtatactagaataggaagagagtagagtagaagaagtcggaagaatttcggagttgtcggtaatcttctctcatttcttttattatgtttattactctgaattcaatataatattatttctgagtaatttagatttatcttgtgagaattatctcttcgtta

SEQ ID NO: 59453 - DNA, 2467 bp, Oryza sativa
cggtgtgaaaggaaagatcttgaagcaatcatccaagctaaccgggcttccatcaatgaagaaaaagcaaaacttgatgaattggaggctggtccaagctccacacaagccaacatagatcggctgaatgctcggaagatagaactcctagccgagttggagcaatgcgatgctcaaattgcaattgaagaacagaatcttgccgatctgcccaaagctactgaagatcagagatcaaggctaaaatcctctatcaaacacttagccgaactgacgaaatctctgaaagtaatccctgaaccgatgcagctgatgccccagatcattgacaaagtagaacaaattaggcaaagagctatatcggtatccaaaaatatgtatctggatgaactgaatatgtaacttttgagttgacaaacttttgggctgtaatgaacttcaaggttttgaaatcttaattccacatttttgcccttactctatttgcttctgaagtccacatttttgcttttgaagttcacatttcacatttatcatatatatttgcccccttaattttgcaatgctgaaaacattgattaaattataattgtactaagggcgatatgatacatatcggccatcatacatcggtaagcacaaccgattatgatcacaataaaatgctaagggcgatataacctatatcggccatcatacatcggtagagcacaaccgattatgataaaaataaaaacactaaggacgatacaacttatattggccatctaaaggcgatgtcaacacattggctaacatatatcggcaaaagtcagccgatcatgaattaatccaaacacttggataatatttcttcaagtacttctcgtttagtgctcgtccaaaaacttcaccataaagccattccaacatctaagctcctttggatacaattttgtatatttgaaatggttcttcccaatttggcgacctcttgccgaatttattatcatgagttcctatcggcaaaatcaacttccaaaccaactttccctctgaaaaggatttaggtacaaccttcttgctataatgaccagcaactcgttccttatctcttgtcaccttttccaaagcacgtaatctggactgaattaaatcttctgtttcatccaccagaagagtttaatactcatcgactgtcaatttatcctgtaaatctattctccttgagccgatggcattttcccatggtagaactgcttcatgtccatatacatgcttgtaaggaggaacctgaatcgacccatgacactccatctgataataccacaatgcttcggctaatcttatatgccattgccgaggaaatcacatatttttttattaaccaactgtataaaactcttgttatatgcctaagcctgtccattaacttgcgcagtaagtatggcagataatctaacaacttgatgcccatgctggcagtaaactgaacacactcatccaacacaaagattgaaacctgatcgggggcgatggtttgaggaacaccaattcggtccaccatctattctataacaaactggatagcatctctagaatcaaccttctacacaggaaccgcttgcgcccattcggggaaataatcggtgctactaatgtaaacttatgtcccttgcttgaatgtggattattctgaccgatcatataatgccccatcctacgaacggccatggcttaataatcggattcataggtgatgctcctgctcgctgagtcgctccaaatgtgtggcgatcttgacaaccttgagcctatcataagcaatcctctaacatcgtcggccaaaaatacccagtacacctcattttataagccgattgatgagtgccacagataccttcatgcacttctccatcacaaccttggcttgatcggtactcaaacatcgaagcaataccccatcaatcgtccgataatataactcaccatctaacaaggcatatttcaaagctttatacctcaatttccgtgaagccgattgagaaggatcatttaaatactggaacacatcgtatctccaatcatcggctgtaattgcagcaacttcaacttcaatgtcttgtaccatcggcttgtatcctgatgccccctgagccaaatcattagcttcaacgttctgctcccgagagacatgcttcaaatttaccaaccgaaaactattcatcagttcttggcacttctcattgtacatcagtagcacatcatttttgaattcatattcccctgccaactgattgatcaccaacaatgaatcacccattatctcaatagcatcggcttcaacttccttcaataattgcaaccccttgagaactgcttcatattcagcctaattattggtcgcgtagggtttaatagtataagcaaactcaaaacttgcccctcgaggagaaattataactaagatgatgccgcagccatgagt

SEQ ID NO: 59454 - DNA, 1268 bp, Oryza sativa
tttttcttttatttttcctcatacaccatttccactatataccacacacattatgcacgatcttgatcttgagtatgtttagttatctgcattagtctaagttttttacttagtaacaaatgtgaatgcaactatgccatgtttgatccctaccgagctccacatataaaccttagagtaggaatcaacaaggcaacatttggtgaagaattcatgttgatacacttagagagactgagtgaatcacttgaggaacttggttttcttttccaaaatcatttgaaaacttccagaacaagagttgaataaagattgggtgaattggtactctaattgctattctgtctttcaactgcccaagacaaggagaagcagtgtctcgtgggaaccaggggtaagggtaagccaccgtgccaaagattatttaatccgagagagagtacatataccttgcacctgtatctttgagatatgcagcatagtagcaactcctgatcaacaaccaagtctttgtttcctttcgtccttcattcgggacgagcaaaggttcaagcttggggggttttgttgatggtcgttatcgatcagtttcgaccgtcaatattaccaaaatagaggagaactagtgatgcttgcaatgcataaatatgttagaataattatattccactaatattggctctactaaccttttgcacagaatgacaataaaatgaaggagaatcgacatcaacttaaacgataaatcaatcagatgatgtcgaagaccagacttatgtatgaatgggccaagaactcagaattgacacgacgaatcaggccaaaattcacaagtctacgaagtgaagcagcagaggaggccaccagccaaaatgtgggctggttgggccggccctaggtttggccgatggatgcagggttttgagggaacggtggagattcacaaccaatggcggttggagggtattaccgacctttccaaccgccataaccgtcattacctgcctatttaagaagctcactctcttcacttcaacacgcacctcaagcaagagctctctcattcctctcaagtttagtttagtattatctagctggtggaatagaattagaataggaatcaggagtccggaagccttcagaagagttcgggtttggctctagtagctttcctttctcttttgtaagctttgtacttttattacaatactcttctaatacattaatggtatggaatacttttcgagtatatagtacctacttacatt

SEQ ID NO: 59455 - DNA, 5066 bp, Oryza sativa
tatgaggatgagtagtaatgcttatgtgtcaaactacccttggattatcttaacccctgcttagaatacgattatcacaagtaatatgtatgttattagttgagttctctctacatgatctttccacgggataaaataaatacgataccctttgaatactctcgtgtgaaataatacaatggtatatccgtgctcttgtggatgaactctgtaaccataatataccagaagtattgatgcgtcattgctgtgaattatatttctagtaatgtccttacgaaataccaacagtaataattttaatattatcgatataataaagatgtgtctttttatcatgtttgtgtggtgtaccccggcttatcctgtgacggggattaatacactagtgttctggaaaagctatttttccggatgcgacaaagagaaagccaagttagatatgctctctgccgggccaattcagccgaacatagatcggcttgaagcccgcaagattgatctcatagctcaacttgaagaatgtaatgccgaactagatctggacaagcaaaagttagccaatcttccaaatgctgtcgaagaacagaaatccagactgaaattggctatcaagaatgtagctgatatgatcaagtacctcaaggtcatttctggaaccgatgctcaagatatccaagctatcgaagaagtagatcaaatcaggcaacgggctgtgtcggctatccaacgctacttgtctggataattaccctgtgtaataggacttagcaaattttgtaatcggctcagaaaccttgatactccttttgtcactgaactgttgtgccgattaatataacttctcaagttgctcaaaaatttgcaacttttgtatatatgtgcccccctaattttgcaatgatgaaggcattgataaaattataatttggactaagggcgatataaccatatcggccattgtacatcggcaaaacacaaccgattacaacaagaaaacaactaagggctatataaccatatcggccattgtacatcggcaaaacacaaccgattacaacaagaaaataactaagggcgatataactatatcggccatctcaaggcgatgtaaacacatcggctatcatgtatcggcaacatccagccgatcgtgcattaacctaaacactggggtaatatttcttcaagtacttgccattgagcgctcgtccataaacttctccatcaagtccttgcaacatataagctcccttggacacaaccttatggatttggaacggtccttcccaatttggtgaccacttgccgaatttattatcacgagtccctatcggcaaaatcaatttccaaaaaagttcaccttcagaaaaagactagggcaccacttttttgttgtaacgtcgagcaacgcattccttatccttggtaacttttacaagagctctcaacgtagattgaactaagtcttccctttcatcggccatgagattataatattcatcggctgtcaactcattttgcaactctgttctccttgggtgtcacaccctgaaaaatcgctaaattataaatcattgtgaaaaagaaatttttagaaattacttaataattaaagcaagtgtgtgaataaaatctatgaaaattttgaacattaagttgatatagataaaattgtattaaatatttttaatgtccaagtattttaaggatttttcccagaattatttgagcattggaagtatttttaataaatgaaagatcattcagtgattaatttaattggaaaagtaattaataattctttctttttcctcctttggttgtgaatcattcccagttcactctccctgtctgcggtttgttgtatccgccgacctctttccgccacggtttcgttttgtatgacgagccgagtcctactctctttctggttccgtttcattttcctttcccaaaaaggcaccgcatctgtctcccccacctttcctttctaggcaacccctcctcccgtatcgttttcctccctccccatcttttttctgtttttttttcagccgcccctagcctcctcctcctcctgtttagccgcctcctccaacaccctagccgccgctgccgctagccgtcacccttcgccgtcgtcgtcttggtcgtcgctgtcatcttatccggtgagctttcctctctcccatgtcatttaccggtgtagtttatccctagggatttaatctaatctaatctaatctaatctgttgtttggccctagcgtcgtcatcgtatccgtgtgttgtcgccggatcgtcatcgtcgaccctccctctcctgtccctttggtttggtgagatttctattcgtgtcccctcgggttaggtttagatccctcggtcgtgtcaccgccgctgttgctctaaccctagcgcagctgttgccgtgtcgcttgccggctgtcctgtgcaccgccgctgtgctagctgccttgttgccgctgcgtcgctatttagtcgctgtacgtcgccgtcgcgctgctgctgtaggtgtgccaccgcaaccgctgttgtgccgctaccgtgtgtcaatccaagccatccgatcttggtcgactcggtcgagattaatctcagccgtccaaaagcgatataaatccgttctctcttttcaatggcatattattcctttttaatatatgtcatctaccaaatatgatctaatctatttccggttttaatcttttgtctcagctataagtcatttataaattgtttaatcaatttggaatagtcttttctttaataggtttaaatggaattaaatcctgtaaaattcatatctaattcatacgaactcggaatgaggtcgttcaagtctcataattcatctaaattcaagctctacctatttatgaactttaattgtactgtttatttgggtttttattagtgttttttcttgttttgcgttctaggtttagttttccgttatttcggaggatcgttcgttcgttggagaagttcctgaagacgaattgaagatgcttgtttgcaaggcaagtcacacagatcccaaacaagcctttgagcatgttgaacccgtttaaagctaatgttttatttcaacttatgcattattttagaatgtcatcgggtggtgagcctttcccaattaattcatggccgaagatgactttattttcctatgggttataatttgactagcatggaccttatatattggattggttcagctagatgttatttatagttgcttagccatgcttagaaacaatagctcattaatgggatgaatcatactacattattatttatggttatatttaatggtagctcacgatattcagtcatgttatgataattaattggtaattaaaatatgattaatggtgggttgtgagcacatggttttgaaggtcgcgctcatgacaattaagaaccggttcgcgagctattgttgtgagacattaaccgtaccaaccacaagccagcgtgggcaacggctttatcttttgtatagcatgattcattatggtgtgccagactgagaagtggcgagaagtccgtgggggtcgctggggagtccattgcctctggttttgagggggaggttatgatccaggaatggtgcactgtggtgagttgtgttgtgcgaagggtattgtcacgatttcccccttagcagtgccgtggtggtacttcggggcatggcaacatgtgtggaatcgtgtcttctgggtacaatggtacatctctggccagagtaaaactattcgaatagccgtgcccacggttatgggcgagtctaacaatgtttttcgtgattagtcccacactactcattaatgttaataatgtgatgattaatttgactcctggtttggaatggataattcctggtttggaggtttgatctgtacgatcggggttggttgttcaggtttggttgggcctgtgcagcatgggtgtgctgttcagtgttgattaatattgatgattaattgctctactgttttacaaattctcaactctctgctaaatgctgctttcgcaaatgagcctatgttatgccatcctctagtatccttgtgcacttgcatacttgctgtgtggcttgttgagtatgtcatatgctcattcttgcaataatcatcaaacctcagttgaggaaaaggatccagaaggagaagacctttggcttagaacccagttgagctgcctgtgggagtggagctgaagcttcgctagattttattttccgctgcagatttcttcatggtgaggactaagtgcctcttatgcaagtatttatcgttttagttattttgatgaatctgtatattaaattgtcagtttgtgttcctcggctgattcctggacgagggttttaatgcacaaattagttcagaaattacttgagaatttctgggcgtgacaagttggtatcagagccatctcgactgtaggtcaagccaaacggttaaacccataaggacgtgtatttgctaaaacaagaatctatttgcaaaagtctgttttcctccttatcccattgctccttgcaaaagcttttctcatcctcccttccccgtctttcaacttgctttagatgaatcccttcaaggagaggttggaaaagatgatggcacactttgatgaaatttggggtgatctgcagacaaagattgatcagattaatgagaggagagaagctctggaaagcaaggcattattctaaaggaagctgagaaatatgggaacgatggttttacaagtgagctttgtcgtatgacgtatgatcttggatatgaggttccaccaatgtacactaaagtatctacttatgttggagaccaattgcattgaaagacaaatggtactctcgtttctgacaaggaagatcttctccaactatcatttactagtgaggccgattgtttcttctatgctcgtgaaggagttgtttacgaagctttgtgtcgtctccggcatcatctcaaggatcgtctggggaatactatatatcactaccatctaaaacatggtgatgatttt

SEQ ID NO: 59456 - DNA, 4789 bp, Oryza sativa
tgggcgataaatacctaagatcaaactctgtcaaagcatatatccacttcccaactcttcctttcagaactggagccgatagttgaccacatcggctttgcacactatagtgcactcgttggacaacaaataatgacttaactttgtgcaagaaaaatataaacataaacacaacttctccattggataataccttgtttctgcatccaaaagtctgcgacttaaataaaaaatagctctttccttgccttctaactcctggattaaaactgagccgatcgacttcacatcggctgataagtacaaccttaaaggcactcctttctgtggaggaattagaactggaggggaacttagatactccttaatattatccaaagccttctactgctctgccccccaagtgaattcttgatcggccttcaatctgagcaaaggtgtaaaaggttctaatcatccggacaaattagatataaaccttctaacaaaattaatcttgccgatcaacgactgtagttgtttcttgtcctccggaggttgaatcttattgattgcattaatactcctctgagttacctcaattcccctctcatgaacaagaaagcctaagaactgttcagccgatacgccaaaagcacacattgttggattaatcttcaagccatatttccttattctttcaaaatttttcctcaaatcggctatatgatcatctacctactttgacttcacaactacatcatcaatatagacttcaatcaacaagccgatcagatcatggaatatataattcataactctctaatatgtagccccagcactctttaaaccaaaattcatcacaacccactcatacaagccgattgcaccaagacatctgaaagcagtcttatgaatgtcttcttctgccataaaaatctgattgtaaccagcattaccatccataaaacttataatgttatgccctgaagcagcatcaactaattgatcggcaatcggcattgggtacttgtaacatactcaaaaatcttgaatttttggagaaaatttttcgcgacgagttttacttttggttcttattgcatttgactaaattggagcatttcctatttttatccttttcaaatttatatctctaattaattaggttgtgtttctatttcaaaaattttcaaatccttttggtaacctaaaagctttattttaattttccttgtcaagttcaaaaagtcctcaaatttatcccctctttcatttcctttgaatcctatttcaaatctatccgcaaattgccaaaggctcctatttattttgggccaaagtcccttcattcggcccaattagcacaagtctatgttatctccctccccttctcttcctgtgggcatgtcgccgccgctgacatgccgaaaccagcgcgccgccgcccagccaatccgccgccgccaccttgccgcgccaatccgccgccgccaccttgccgcgccaatccgtcgccgccaccttgccttcgcccactatcctctccaccgccgtcccgcgagcgtcatctcgagcagttaccgacatcgagccgcccattcgctgtccaatcacaagctgacacccaacgccgccacctccatttcctctcgacgccgagccgtgccatcgtcgaccatctctccctcgaccgcctttgcctcctatataaaccggcgaacccctccatttccatcacaaaaatcggagctctctctctctctctctctctctctctctctctctctctccaatccaccgccaccggccgtcgctttcctttgctccccacacctggccgccaccctagccctgccggccgccaccagccgccgccgctgtcgccgttgtcgacgagcgccagccgctagagccgctcttcccccccacgtcctcctctgctcggctctctctccctttcatctgtgtcgcaaggagaaggggaagaaaagaaatagggaaggaagaaagagctgacaagcgggccccacctatacggtaactcttctacttttatttgatttatttcaaattccattctttagagatccatatctctccaaccattgatccaattccaaaaattctttaaccatctaatttcaaaccctttattagataccaaatttcctaatttttaaaattttatttaaatttctttatttaagtaccccttttccttatttatttactttctaattctaaattattttaattaacctataaaaattattttaaatttattttttttactttatatccctttaattttaaatttcttgttttattttaaaaacctttttaaaattaaattatcctttagtttctttaaatgcccttttctttattttaaaataccatttttaaattttatttctttaatatatttaaaaccccttcttgaattaaaattcccttgatttacttgaattccatttttatttccaacctatagaaaccgacaccgttttctttcaaaattcaaatatctttggaccttttgcctttgcctctcttcatgctccaattttgttattttcttttattttatcgtttatttgtagtactttttcttataggctttgtttgctatacgtacgttagacaatacagaagatctcgtcgacatcacaggagctgacatggatccagccgactacgcagaagcccatgaaagtttcaaggcgcaaggcaagacagaatttaagcatgaaataatcaacccccgtatttactttatgcataagttaatcatattatgctttactagcaacttatttaccatcttatggttgctccttcagcatctcatgggtatatgctatagtttagaataacattgcagtgggttaaaataatatttaatgcttttaatcattgttacatgagattatggaaagatacattagacatcattttatgtggtttattattcaaatatctttacaaacgtaggaatccggttaaaatgggcatttttatgttgtaattatgaatgttgatgaatgatgaagtttgtgatgttggtgtggggagtttggaaagttttgtgtggtttaaccagattataattacccccttataccatgggaaatgacatagtagtgtccatccacacgaccaagtaattggacttagcatagtacattgtcccactatatgaaagactgttgagtggctctatgaacggttttggggtgaacatgcgtaatgagttagggggcagtgtttcacaataatggatctcatgaaagtgtgacaatatagtaaccttgccctaggtgttggtatttcttataatcacagataaaatccgcaagcgcacggatataccgatgtagcacttcccctacggagtattctaagggtatcgaatccaagggaacgtgtgtgatcagatcttcctccagtttatccaaggacaccaagcaaatgataggccaggatagagaggattcactagtgagaaacagtgtctagggaaagcttaactttaatcataatgcaatactgcaggcactaacaacccgctgttcctagatggcgctctactacgtacccggacaggcaggacttaagtcatctcgagggctgtcacctcctctacacccacctctaacgtactgtgggatacacatcaattacaggataataattacctaaacaccatgtctaagcaattactatctactttagtgtttataactcaccaagcaatcactatattttagttgattatagtgaacaataatcctgtatgctacttaggaactaaccaagagttaattctcacaagataaatctaaattactcaagaagaatattgtattgaattcagagtaataaacagaataaaagaaataggagaagattaccgacaactccggaattcttccgactcctactctactctcttcctattctagtatacaatatagtacaatagagcctcttataatttgtcacgcccaaaaactcccgaatagaattccaagcaaaatgtgcattaaaacccccgtccaggaccggtcggggtacacaaacgacaaagttgacatacagatcgacgtcttacaaacattatcaaagtcttacatgaatgcagcggaaaattaaaagacaactggagctaagccttgacttggactgcagcgggaacaccactccacaggcatcctcgacggcacggacgaagcctactccttagaaaagccaccatctgacgcatactcaaactctggggtttggggaagatagagcaagactgagtactacccactgtactcagcaagtcataccggaataggggtatgatgcagggtataaccaaaggatagttagagcggttcatttgcataaagcgagcatttatcgacagcagttgaaagcggtaaaaccgttgtaataattaatcaatattaaccatccactgtccaacgctacaccacgatgcaacaggcccaaccatccacctgaactaatcaattccattagactaaactagggtgaggctaatcacggtgaatctggttgaccgcccataaccgcgggcatggctattcgaataattttactctgatcagaggtgtacaactgtacccacaagacacagccccacgacacgttttcgtgcgccgacatgccaccacgacattctagaaagaggccgtgacaggacccttcgcataacccgctctaaccaaacacaccacacctcaggtttcaaccccactcctcgcaaggcagcgggcagtcccctctcgtgcct

SEQ ID NO: 59457 - DNA, 1166 bp, Oryza sativa
tggtcttaactaaggttgaacgtgaaggtttgttctcatggaaaaggtcaccaccaagtagcacaaaatcaacctgcaattcagtatgatttccatcatattataattcataattcataaatagaaggttatcccccaacagaatgagcaggccaataaattttgcaacacaagcagaaaagaatggaaaaatgtgcagctcctacaaaccttattctgctctgctaatgagcatatctcttcaaacgcctcaaatgaatcaaacctacgaatctcgtccttttccatgtagccgagatggcaatcggttgccacaagtacacggagtgtgttgctttcgtctcccctgaaacacaagttgacagtgaatatataatgagtcaagcgtcatgtctgtcgcagtgtaagtatcaggtgacagttaataggatgctctgtgcaaccaaatagttcattctaagcaaagcccaaagcaattcgacataacaaccaatatcaatgtacttatctaataccatcgctccaccagccaccagatactaatggcttaaatataccatgaacatgataactcacattgccggtgttggttcagcttcagacttgagcccaagcactttcctgatcaaaccctcactgcatcgataacagtaaacaagcagcaaaatgtgatatcaaaacaccacgattggttccatacgtccatattctattagccgaatagcatcctctaatttcatactaatccactaatgaaatatctgaccaaagcaaaggaactcaccggaccaaaccaaaccaaaccaaaaccctgcgagcaccggcgaagcttaggcgacgacaacgcggtggcggcttcccctacttcgcgagcagttcggagaccgtcgtacgggcctctgctctggtcagcgtcggcgagctgctcggggacggcggggtggaggcggctagggggcggagcatcagtcgtcgccgggaggggcgccgcggcggcgagctgtggacgagcggcggcggcggagtgggctaggttgtgcgcgcccttctcgatgtagcaatagcaatgggccggcccatcaaggcccattaatatcaatacacgagcccactttccatatacacggcccgttttcctctagggttaggccaaggtctcttcccct

SEQ ID NO: 59458 - DNA, 13964 bp, Oryza sativa
ctagtagcagcaaagtcgcctcgcctgccgatgtgtgctgtgactaccgcgacttggggcgcggcgatgaggtgtttgatgaattgcttgactcggcattgggtgatgaaggcggggatgggatgagggtttacactgttgtcttcgtggacagtgacgatttgaagagaattgtcattgggaaacaccggcatgcttgggtggtcgggaaggttgatgaggctgaggttgtgtccatcattgggaaggtattcgtcaagtatttcatgaatggtggtgtcgaggagggcgaagcaagcactgtgaaaagagagttcatgccagttggatcagatggcaatatagttctttcatttagcctgctgaatgctgatccaagtgattgggtgtatgattggtaagaacaagacatgtcttatgtttgtcttattgttgcttctctgttatatagaaatccactttatcagcatcgttaacaattgtcaaatgatatccctgtctcgttctatggtagtctgtttaaatcaaagaaaatatactggattgcatctacatttcttaggcaatgtgtaaaatgtcaaggcagtaaggctgtggaatcgcgcttattcgatgcaatcgatgaatatattgtgtatttggcatcttgcaaagatgaaaattattgtcaaattattcctgcttcttcattgttgtttcttttacatttagatgtcctgcatgcagggagtttgaaaatattggtcaaaggatgttgactcctgttattgaggcgttacgaccgattgcgaacattaatatagagagtcaggtgcaaaattgcctattttgctcaatgcttgtttcttccatcgtgtgaagctgtcaatgttgataagtactgactagtccttttgttttcaggttttgtaccacacaccaaaatcatcctattcttattctgatgataaacttggtggcaatgtccttagcgtgggagacattcctttctttgtatgtttctgaattcctctgtagaagtcatgtagccatgatggttgctgcatactacagttagctgctgttagtgtttatgacatttaactgttatagatgcactaattcaatatgcaatgaaattgataggttaattcaaatgagtggcacttggatacatccatttcagctacaggacgatcaaaagttcttcaatttgtggtgtatgttctttagaccagattggcatctttgtatttaatcttacagttcactcatcctgaacagataatggaaaaaaaagcagaataacctttcttttctatgactgcgccctgccactccattttatctgtgttctatgttcaactatatttcctgtgtcaatctcctgatggatattaaagtgattcaatgatttggtctttcttttactccttactgtgaatctaaatatcgcagactacctcatttgttaattgagatttatgatttacaaagtgtacaacagtcagaaagtattactgtgatgttctaattaccatatttcatattagttatatgatcagttgtggatgcccatatactcatttgaattgtctgtgcaataaccaccagatatattccatcagcaagggaatgccctttgtacctgcaacttccagatggggagctttccaaaactaatgcatttatatccccagtaagtgctgttttacctatcttccttttgttacccattttatcattttcttaacagtgtgtattatgttgtgcagatgtggggaggtgttgttatttggaacccacctggctgttcatttggttctaagccacatggggccctggacaaaatgtcatctgaggtgtctgtaatcaatttattgccctttttatatgatagaatgtacatattgaaatgtcacagtagttagtctgatataccttcttgcactcattatctgctgagtgctgacacatctatatggaacaggaactcatggagactattgaaatcttcataggacagctaaggcagttatttggtctaaaatcaagttatcacacacagagtatggatggtgtaactaagttcataactagtccaaaagggtttgcccaatggtgagactccctctatttccttactaaaattatctcagtaccaactcccgcttaactacgcacattagctggatgctgacacatgctacatgctctcaatttgaaaagcaaccatgaactattgattctttaatctgagattacattagttatctgcatctgacatgatgatcaataaagctatgggaattttatcacaagccacatgcatagaggatcccgtagaaatattgacaaaatacacatgtatggacaaatgtatccacataggatccaaccaacccaatttttgaggaagtctgagacaaccactagtctacaatcatcaccatctcctattgtagaaatgaaaatatgttgtgtcattggattggatcattggacaacatttttcttcatgaagatgttctcaaaattgtagtgtttatattctcaactcatcaatactgtagtctgcagtatgcaataatatgcatcaatcagggtggacttttatcaaagttagaagatcccaactacatgtcaacagctgaaattctaaatgtcccagataagattttggatgctatatgcttgatttccatatgtctcatagtaggtttttaaaacttacaagtttagtgtagttgcgactttagaagtccatctatcacatgtaacctcttaaggcgctaagccactaactgttactatcttgaccctttttttcctcagggaattggatttattataccggcaccatgcatgttccaatcttttgtcctgtctcaccaccttggaatccctttccagtttggtatgtaataaattcttgataatacataaaagactgttcttcatgctgtgcatgcactaatattattattattattatttttgtaggtccaatcactccccagaatgattgttatggatgaaattgggaggcaggtttgttcctattacattcttgccaaatggtagtagcacatagttctgcatagtagtcatttttttaaaaacaactttgcaccttctttactacaaggtctcgaagcagcatatcactcagatgataacttgggcatgtgtttcgtctgcctttttttttttaccattatgtgtactttgcaagcttgtacacagttatattctgtggatctagtgctttacaaaattaatttcgcactaagtttgtgtcatggtctaaaaaacatttaacagagcctaaatttgttatgacaagtgacatctctttgcaggttgagctttctcttgaagctgcaagtttagctcaaagaaacgcaagcctcggaataagtgactcttcagcaggcacgttaatcttttgtttgcactaaatgtaaaaaaatgataaattttatcaagaattgtgctgttctgcaattttattaagaattgtgttgttctgcagtatctgcaacaagagcgagggctttggctgaggatgcattttttcatccatctgttatgtctatcagttatgcttcaatagagcactattttgcgatttacatggtcagtatactcttctactttacacttattacagtccaatttgtgtttgacacttctgaattctttctttatcttgggcaatatagaaaactgaaaacaaaagagttaactattctccggttttaaatagtgaggattagagcttagtagcgtgcagagcaataatttcttgtccaatttgtttaatatcaacatgcaagttttacactaattgcaatcccttcaattctagaattttgctttattatttcttttgatcataaaagtaactactttagattaaaaaaaattacattgtagcacttcagagccaatactgatatgcttcgaattggcattttctgcagccattctttgcgccagtttccttgcatgtgctgttggcggtaatgaaagagctgaaacgatacatggtagagagaaggaaatattcagcatttcttgcttcccaggcgacatcttcctgatcttttggtgattatcagcagccctgtttcatgcctagtactatcatccacaccaagtctgatatagatggtagataatctgcaacggttcagccacagctgggggacgcgtcttcttaccatcaagcaactgctgggcagacaggtagaccaaatggtgtgtgcctgtgaactcgcagaccaggtgaagatgtgagggaacccagtttttgtcacaaatacggcgttcttccatgaaaccagcttggtgaggccttaactgatcgtcgggtatcattcacattttttggtgaggccttaactgatctctgaaactacagaccgctatctaaagccaatgcatctgtaaattgttgtataatttgagagcgcttgacaaactccccgcagaccaatgttggattagcagttaacacgaacttttacgggtttgatgtgtgtgttcacgattgtttttcatctgcaacgcatgcatgggattccccctctcgtcctacaacggcacacccggacgaaggaactacccgtgtggccgtaactgcatcctccggcctgagagagagagagagagagagagagagagagagagagagagcccgctagagtaacatgtgcgaaaagacctgcaccattcggttaatacaatttccaaatcatagaaataaaaagttaaatgattcggataggacatggacttcaatcattaagaatttattattttgtacaagagatcttaaaaattatatgaaatactccatccgtcctaaaatgaataaaactagtactacaaatttagaacggtactaggttttaggtcctttttaagttcccaaataaaaattttcactctgtcacaaaatgtttggacacatgcttggagtattaaatatagaaaaaaaactaaattgcgagaagaatcttttaagaccatttgctccatgatttgacaatgtgatgctataataaatatttgctaatgacggattaattaggcttaataaattcgtttcgcagtttacaggcagaatatataatttgtttttttattagtttatgtttaatacttcaaattaatctacgtttaatacttcaaatgtgtttccgtatatccaatgttacacactgaaaactttttacctctggaactaatcagggctttagtttatttaagtttgagatggggagggtaaggttataataggattacaatgtaagtttacaaggctacaatctttgaaatttgataggagctatttctccggaacgaacgaagcatatatggaaaaatcgtaatttttcaatactacgatatgtaatattttgaaaattcttttaaacctaatgagccccgtattgttaccgtggcagcctggcagggtgcaaggcaaccaccggcgtccagggcacaccgccgcttcgcgacgaccgccatcggcaaccgctcgctgtcgctgcagtagactagcgcggacgctccctccctccctccatcccaatccgtccccttcacttcactcccattcccatttcctctcgctcccaccaagaccaaccaaacccctgtttctccctcaaaacctccctctctttcccccccgaatgctcgagcgctgcgcggcggaatcccctactcccctccgatgaggccctcgccgcctcccgccgccccggcggaggaaccggtgcccccgtggctgagatcgctgtccgtcgcgcccgagttccgccccaccgccgccgagttcgccgatcccgtctcctacatcctcaagatcgagcccgccgcggcgccgtacggcatctgcaaggtcgtgccgccgttgcccccgccgccgaagaaaggccacctcttacaacctctcccgctacttcgacgcgctccaccggacgaccgctcgccgtccttccccacccgccacaaccaggtcggcctctgcccgcgccgcacgcgcccggggctcaagcccgtgtggcggtcctcccaccgctacacgctccggcagttcgagtccaaggccggcgccacccgcaagtcgctcctcgccggcctcaacttccttgcctccagcctgctccccccgctcgaccacgaggtgctcttttggcgcgcatcgcccgaccgccccttcgtggtcgagtatggcagcgacatgtcgggctcgggattctccccttgcgccgcgcagccgcagccgccgccgcagcagcaaccgacggcgcgggcggcggcgcaccttggggagacggcgtggaacatgcgcggcgtggctaggagccccggatcgctgctgcggttcatgccggaggatgtccccggggtcaccacgccgatgctctacgtcgggatgatgttcagttggttcgcgtggcacgttgaggaccacgacctgcacagcctcaactacatgcaccttggggccgccaagacgtggtacggtgtgccgcgcgacgccgcgctcgcgttcgaggacgtggtgcgcgaacatggctacggcggggaggtgaaccccctaggtgaggcgcttgaaactatcaattttcattaggaacacgctatgctctgttttcccaattctgaattggttttcctgaactgcgagttggtatgcagaaaccttcgctacattggggcagaaaacaacagtgatgtcccctgaagtgcttgtggagtcgggtatcccctgctgcaggtgttatttccttctgtttgttcagtaactagccaaatttcccgtgcaattttgcatggaactagcttaaagtttatttgatgtagaattgcttttggtatacgtcttctgcttctatttctataaatacaatctataccattataagttgaacccgacatgatcaaagcatacatatatctcttttctcagattattaatgttgtgatttctaggccctcagtgaatttggtggactcttttagccttctctttattaataatatattccataatagatagatatattttctatggtatgtgccatgtctaccagtggtttgattaattgattctctgtgtttgaacagattggtgcagaatgcaggggaatttgtggtcacttttccaggatcttatcactgcggtttcagtcatggtgagactgagcaatcacaatagctagcctcattttcctatgctacattttgtacacaattattcctgttctaatcatgcctatgacattttttttcatccctaactgcatgaaatatatgtcttacacagggtgcaatacccatagaatgccaaccttttattgagacatgcctataccaggaaaacttataactcttttttttttaaaaaaaaacatgtgtataccatgtgcagtgcaaaacaaataggtattctatctactgagttaatcagatgtgattgcaggatattgtgtaaaagatttgaagtgtttactaaaaatagtgaattaacctatatttgtgctaaacgtctgccctaccctagtacgttacaactattatgatgttaccatttcctgaattcgattgttcatcttgacacgggcactcttcatttcattccagcaacacaggtgtactgtgtgcaatatgcaattgcaaaatgtgtctctgttgtaaccactgcaatgcacttgatcactgcctctttcatataattaatctaatcaacctcatgactcatgagggcatcatctatttgggcaggattcaactgtggggaagcatcaaatatagctactcctgaatggttgagaatagcaaaagaggcagcaatccgaagagcttcaatcaatcgtcctcccatggtttcgcactatcaattactttacgatctcgcactgtctatgcgttttaggtatgtcataatttgcatgtttcatgatgtgcacttgttcttgatttcttgtgagagattctatcaacttctgccccccataaaatacttatctcacagcccagtttggcactttggctatggcgcatttcttctccctgtattaacttagagtacattagagtagattttggaaaaccctgtttcatgacgtgcacttattcttgatttcttgcgagagattttgtcaacttctgcctcccagaaaaatacttatctgacaacccattttggcactttggctatggcacgtttcttaatcactggataacttagattatgttagagtagattttagaaaaccccatgtttttgtgaaaccttagaccataatacctaggggttatatgacgtaagccataatacctaggtttttttttccaactttgatggcatgacctttttttccttaaaataaatcattatgctatcaataaaaatggtcagccagttagtgcagaatcaataatttccatgtattgacctgtgcacgactctgctcagtgatgcaagtatccccattcccacgtatgcaacatcaataaagtcttaaaatattccaccgtagtgtcttacggtagccaaggtttttatggtgatgcttcaatctgttagcggttagcgatgtatatgtgttatgagagctgctttctgacagaactcttttgatacttgctgatgctatatgaaaataagacaatcttttttatgcatttgcccccttcatttttttatggcaatcctttatcttgttttgaacttctacttcttcagggaaccatccaatggtgaaatggagacacggagctctcgaataaaggagaagaagaaatgcgaaggggaacaactggtcaagaagatgttcatccaaaatgttattgaagataatgaactgcttagtcatcttctaaatgacggatcatcttgtattattcttccagcaaatgcccatgatggtcctggtctttctactttgcgctcaacagatcaatcaaatatgaattccagaatatcacataacctatgcagtagggaagaagctccagaagcctcaggatgcttatcgccgaacaggaatggtgataccagaaattgtatttcatcagatacgcataacatggaaggtgataagggagatataatgagcgctactggattgttagatcagggtctattatcatgtgtcacttgtggaattttaagtttttcatgtgtggctgtactcaaaccaagagattctacagcacgatacttgatgtctgctgattctaattcaattaataaccagctttctatttctggagggagtattctggcagatgcgccaacaaatgaaaggaatggtgtcatttctcgtaagttttcatcttacaatctgtactgaagacattttatttcttacgctcttgttttcagcttatcttatgtacttccacattaaaagggtagtgagttactgatattttttttccttctaaggtagtaaaagaattgctattaggtgccatagattattgatctatcataactaaggaaaatttaccctgtacgaattggatgttttgaaacaaataaacctcctttataactccatatctaatgaaatgatctattggagtttcttatgtgtttttactatgggaatgaatggactgtggttctatatttgtttatctgcatttgtggtaggtataatcaggtgcttgtagggacatttaattttcagttaatttggtgagccgaatgctatttactattttgtccatgtgctttaacaatcattttcatctgatacagtatatgcatttgtaatcaacacacaggtccatattctgaacactgttgcaacgaaataatggccgatgatgcagaaatcgataagaattctgctcttgatctcttggcatttgctcatgggggtcaaccagatcctgaagaagatccactggagaaaatactgaagattgcacatggcattaacaaatcacaacctaatagttcaaataatgttggttgtgttggaacaaagctgtcctcaagtagcacagagcgccaagaaagaccatcttcccagaacgctcattgtaatggtagctcagttatttcaaatggaccgaaaggtgttcgcacgagaaataagtatcaacttaagatggtactttctgaaggttttcaggcaaaggatatctattctgcgaaggaaaagaaggttcaatcagaaccatcaagctcaaaaggggatgttaaggagacaattgatgttagtggcacagagaacgatgtcggatgtaaaagcactacaatctctgtcagtgaacacaggggttctacaaagaatatgtattcagtgaaggaaaagaaggttcaatcgaaaccatcaagcttaaaggggactgttaaagagacagttgatgtcagtggcacagagaacgatgctagatgtaaaagcattacaatctctgtcagtgaacacaggggttctacacctatgaccaatagtttagctgcatcaatcgtgaaacctgacaaggattcatcaagaatgcatgtattttgtcttgagcatgctattgaggttgagaagcaactgcatgctataggtggttctaatattatgcttatatgtcgtccaggttagtcatcaagctgtttgctcactgttatgaagtgcaattcattttcaaccatttttaagcatttttctgcatgccttttattgttttcattggtaattggttcatagtatgacttagcactttagcagtgacaccatatctgtacacatgccatcttacatgatgttcctattagctttgctgaaatcagaataagtaggttgaaccttttggtgcttctgatgttcataatactaaattttcaagactgctgcatatgttcttaaaacattaattaactttttttgttatgatttgtacagaatatcccaaaatagaagcggaagcaagattgttgggtgaagaaatgggactggtatatgactggaagggcattcatttcaaggaggccaacatggaggacaggcagaagatacaggaagttctgcgggatgaggaagcaatacctacaagcagtgattgggctgtaaaattgggtattaacctttattatagtgcaaatctggccaaatctcctttatataacaaacaaatgccatacaacagagtcatttatagggcatttggctgtgattctcctaatgactcgccagtaatgttcaatacttgcgaaaggaaacaaagccaccagaagaaaatagtggttgctggccggtggtgtgggaaagtatggatgtcaaaacaggtccatccatacttggctcacagagttgaaagccaggaagcggaagaagcagatagaatctgttcttatcattttgatgagaagcacaaagctgagccagttgggaattctagtagagtggaagcctccaaaagaaagagtagcagtttgacagacgtaacagaatcaagcaatagaaggggggaaatacctggtgaggaaacaaacaccaagaggcccaaacattctcaagagaacaatctcagagctttggaaaccgttgctgaagttgtggtgccctcaccagctggaacaggtctccgcgttagctccaggattgccaacagggcaaacaagctaaaatcaaagatggaaaaggaggatgtcccttctagccgtccaaagtctaacataaaggagaaaagcagtcatgctagcggtcagaaatcaaatgttcaagaggcgaatgctaattctgctagccatttgagagcaatgccaccaaaacagaaggctgaagcagaagcaaagaagcaaataagaactccaaaacctccaaagcaagcagtggagtactcgtgcgatattgagggttgttctatgagttttcgtacaaagcgggacttgtctctgcacaagagtgatatctgcccagtgaaaggctgcgggaagaagttcttctcgcacaagtatctgctgcagcatcgcaaggttcacacagatgaccgtccgctaacatgcccatggaagggctgcaacatggcattcaagtggccatgggcaaggactgaacatctcagggttcatacaggcgacaggccctatgtttgccatgagccaggttgcgcacagacattcaggtttgtctcagatttcagccgtcacaagcgcaagacaggtcattctgtcaagaagaagaagaaagcaaagagttgagctcgtattacagcaagctagttatggtagaaccggacgcagtaggaggtagtttgtacattctacttcactagtttagcactgatctctctatctgacggattctgttggcaccacaatcggtgtgctttgtgttagtttatattagttttcatgattactaattctcctagttagccttgcatcccatcatatgtttgatgtactgacaccagcacttgcttgcatggttaactagcaaattctaatgttatcttctctttgtatttactggttgacgtgtggatgataactagattctggtcacgtatgattttgcccttcttgcaggggaagaatctgactgctgtcgtagatctgtttgtgctgttgggctaccagttttgacgatgctgcttttttgttctttctttctttctttcttcttttttggtgatatcaggcctcagattgtagccatctcagaaaagaacaacggaatcataaaagcctttgtgatcttaggtgcgtcattctaggtatcaacaggagagcctctcctgctggattcctgaagggctgaaactgaaagtgattcagaagaaggctgcagccgcatcacagcctagtctgtttaacttgatcaatcctccatatcaagctaaactcaatatcattttttttcaaaaacaaaattagcaacgtccatagaactgcactaagttcgtctaattacgagcaccagaagaattcccgtgggtagcggtgcgtgaaattggagcagcctgaagccctgaaccgtgaaaaactgggctgtgagactcagagcgcgaaccaaatctgtcatggagaagatactccctccgtactcgtaaagaaaatcgtttagaacaatgtttaagtcaaaccttgagaatataaatcatgaataactatcaagttgttgagttttaaaatataaaaattatatgaatagatttgtcttgaaaaataacatacatatatcactttttaatgaatatttttataaaaataagaagttaaagttgtgttttagagaccgtgtcgctgtcctaaataacttactttacgagtatggagggagtaagagctagccgatcaaccgacgtatcaacaactcggtggtctctgcggctctgcctcatcgcaaccaattcctacacgccgcgcaggcgcagcccctcggcctccacgaccgccattaataccgtcctagccaagctacgatcaatcacagagcaaagcagccattcctcacgtcacgtagcccgaccacccagtgataaacttcccagcaacccagtactagcatccataaaattgcacacctaagctagctacactagattcaatcaagtcatgaacaaaaaccgatcgatccgtatttgaatctggccagaatcttcgacgccattggcaactcacgtagcccgccgctaacgtagcagccgtccatcccaactccctagctgaatctgacaccatcgcacgcatctttctgttacccccatttaaatccgtctcgtttcccgccgcaaatcccagctataaatacgtctcctcccttctccttcctcctcatcgccctcaccctccaattccaatccctcccaagaactagctgatcacgacgagcagctagtccactgctactgcgatcgatcggttgcaaagttaattaattagtggcgatcgatcgatcatggggagggttattagcagctggagggttcttgcggtggtggctgctttgatg

SEQ ID NO: 59459 - DNA, 6310 bp, Oryza sativa
catccaacttcaaatttgaattgataaacaaggaaacaattcaataaaatcttataaatagtatgatattcatataacctattgagatataaattttcaaaaaaaatttgatgtattccgtgtagttaccgaactttatactaggaaagaaaataatagcgaatgaaaaaaaaacgaaaacactttcaatttatctctttttatagttaccggttaaaatttcgatgatttcgctcagaatttcgccaaagccgaccggttttcgcgagcttatcagtaaacttagataattttctattcaaattttggtttatgttccatcaaagaaaagttccatccaataaacaattggtttatgaaatttgttcgaaatctatcggctttccatcagatttcgtgaaaaccgttattccgccagagcccgaaacagaaggccaactcaagtacccaacattcttttttaggagtaatgctcaatcataattatattgaatttggatgaaactcatcaaaatctcagacggcttctactttcgagcatcgtcgaaacctcgaaatttcacggaattcgaacgtttttcgtcggaattatgaaccctatatgttacccattattattgtttaggataaaacttcactggaaacagaaaaacaatatgagtacattcatctcgaaacaatagtagtatattcaactcgaaaaaataaaaccaatactgtatatgcatgtcaatgttattggtggacaacatcaacaaggaagaaaaaggaaatggaagttcaagtttagagagctgtttctcaaaaaaaaaaaagtttttcaaaaaaagtttagagatgtttggtgataggtaggtcggcgtgagggcttctccaaaattctagtccgtgtatattaatggttttatagcgagataaatatcagaccaaataatatagttcaaaacaaatcatagaatttaccgaattttaatcaattacatgatgtggattaacacatgagtataattatatgtaaataatttgaaatcaaaattgcatgcatggaagtctttttggtgcaattgtgttcttatccttgctctacagttcaattgtgattttacccctgatttttagggtttatgattttccctagttttttgaaatgaaacagccacatgtccttactctgttaactcatggtaacggtgttaaatgtgtagtgaatggacaaatatgcctctactattgagatcaacgacatggcggctgcggcagtacggcggcggcgcacgagcgagtagcaagcgcaagtggcacgccgattgggcgaggtgaggagcagaagacgcccgggctactctaggcgggccggtacaccgtgcatcaggcgtcgggcgcggcttcgcgaagcagcccagcacccggtgaagcttcagctccggcggcagcgcgcgagcaggtgggggcggagcccgtgaccccggcaggagcagttccaacggcagtgcgtgagctcgcggcgtcggcatccctggcagcagcacgcgagcaagcgagcatctcgtccatgggcagctagctagcaacttctcttggttcctcttttccttttccatatatgtttctctctttcttcttccccatctttgcaaggaattcatttggtgatcaaatattttcctggtgaatgtgatgaattccctgctcgctgctcgctggccgacggagccgctgatcctcttcgccgcgcgcgaggatgctgctcctctccgccgcagttggcccaccgccagccgcctcaatttggggaaatcgttcccaacaagtggttggccctttaagtaaaccaagggtaggatagtcattcacaaattataatattattttctttcttcatttaattaggaaattccgggcctaccaaactaccatcaaaaccaggggcaaacggttgtttcatttaaaaaagcaggggcaaaatcacaaaccctaaaaaataagggtaaaatcaactgtgaagtaagggcaaaaacacaattgccccaagtctttttcatgaaagtggcacggagttgaagctgatatcccgacgagatctcgatcagcaaaggctttagaatcccctcaatcatcgcaactgtttttcttttaaaatttagagaagctgattttgatttttttttatagaagctgaatttgaacttgaatatttgtgaagtgatatattgtattataatctacttattttttttaaaaaaaaagaactgtaactggttgacatgtccgtctatacaagtttgaacccgcggtggaagggaacggggaaccaagcggaatatgcgcttttctgcatctgcctgtcgctagcgtcaactcttccacggcgtctgacggcgatacatgcagccatgcaggttgcaggacgctccaaatacagcccccaagatgctgttgctgctgctcttcgtcgcaagctctgaattactcgcttggcttgatcacttctcctactatgtaccaagtatcaactgaactgaatggtcttctctgctgcttccatgaagctcatcaccaccgaaccatcgatcgaacagaaccaggtgcacaagcaatcaagcaaccactgccactcgatcagtcgatctgctgctctgcctcctcttgatcctttttgtctccactctgctgcctgcaactgcatgcaaacactgtgcagtacaaccgttgcaaactggaaaagaaagattaagaactgggagaatctgcttggctgcaggtgcaggcagagggaagttgattaagtgattaagccggttcgataaaactaatccctctaccagatcgacatcattaacgtggcggttccacagcagctgtgcatattctatccggcaagtacaggacctgatcacatcgatgattaaccaatctaacttgagcagcagcatccccaaccgaaaatactgttcgtctgtgcaagcaagcgtacggcgtaccctctcttctttgtcagcaacgagattagaatacggcatcggaggcccagcgcatgtgctgtatccgacgtagcaatcatcggaaaggaggagctgagatggatttgcttttgcgcagagaccaaatccaaatgcatctgatcctgtgttctaggtgcgtctcatgtcggctagattacaaatcagtaggggcattggcgctgggggatgatgatctgaatgtctcgctccatttcagcaccctcacatgccactgtcataagtacatacacaaatgcatttttttctacttatattcgatcgatgcagcttggtagaacgcgttgtttcttgctgaatcttttccaattatgataattcgattgggacaacgattagatatgaacagttgaagtaagaaactgataggtatattcttgcgttgccgtgccttgctgaacaggagacagataaaccaactgacaaccggtgagcggtgaggtgaggcaattcatgcaaaggcaaaggcggaaaaccgtgttgcggtgttgccacccacccatgtgggttccaaccgccgctcgcagctagcgctagctgcgtccgctcccgcgtattcaaccccatcccaaccggtctcaccttttcaacgctatcgccgtctcgggcgatgcctacaggtgtcgactctcaaggatcagaatcaagaggtttttttttttttgaatgactgaaaaaaatttttttgaatgactcgcacgagacggtgtgaagttctattgatagagcaggaaaaaattacaagattacaaccctgaagggtcgtaaccaggaaaaaggaaaagaataaaccaccacccacacaccgacaacgccaacacacaagaccaggagaaagctagcaccggaccggccgccgctaagcgtgaccgaccgccgctagtctaacaaaggaacacaaacgagatcgccccctagggaatgccaaaacaacgtcttcaagaagagaagcgacggaaaaaccgccgccgccgtccgtcgtggcccaaaggagccaggactgggcttacgcccggcaaccagccttgaggggtgagacagcacgacaacgcccttaggagggggaatgaaccatcattgtcggtccggccaaagccgggttaggttttcacccgccgctcaccacctgcgaatccacggctaacgccccgatgatccaccaccacacaagctctgccaacatgtgggacccctgcaccggcgcccctcgccagccagccttcatgcgccgaagaccgcgccacacccaccagcagctcctcctcgccccgaggtcgcctcatccaccgccggccgcgcctctcgcgccaagccggcctccatcttcaccgcccgcgcctttcgcgccgagccggcctccgctgccattggttgcgcctctctgcgccaaaccggtctccgacctctcctccaaacgatgccgcgccagccagatgcagtcgtctgccacgccctcgactagccgtccgaggccgtcatgcctccggtgactgcagtcacattcaccactgcagccgctgttgccgtcaccagccgccatcactaacctcctcccaccgtcgtctgccgatgccgtcgtcaccagccgccgtcggcagtgccgactctgctgctgtcagcccccactccacgcccatcgccgccgtccaaggcccggcatcgccccagccagatctggcccggggaggccggatcccgccgtgtgggggccgaatccgtggccgccctcgctggggcgcgccgccgctgcccgtgcctccatcgaccccgtcgccatcctcgccttgcatccaccgctctgccagctctagctgtagtgccggtctgctcccgcccccgccaggcgcacagcaggcaccatcaccgccactgacgccgacgccggctgcccacccgtcagatccagccggacccgtcgggtccgagcgcggaggctagccgcgccgccgtcgacaccgccgccagcagcaccggtgtcacaccctaaagttctttcccaagcctaaattgaatttataaatcacctagagaaaatatcggtgtaaaagcaagagagaaaccctaataaatttgtcggtgacatggggccgggggtatcgtgactaaaggcttgggtagccgtggtcacccacgtggcctgaccccctcggggggtcgggcccgagggtgacatggccacccctccctctgtctccctgaggggtcgggccgctcccgtttagacacagagggctggggcgccccgaccccctgtggttttggcgccacgtgtgtgggttaggtgagcacagcggcgctcacctaacggcatttatagcgggttggacaagcgcgccacgccgcatttaatgcggcgcagcgcacgcttatccgggccgtggcgggtcgcggtgtgtgaccggtcacagaccggtcagatcgcgggttaggtggcaacaggcggcctgtcacacgcctcgccccgtcccgtcagaatgatgagagcttcttggctctcgtccctagccgaagccggcgtgctaactcctggagttggtatgtcagtcccggtcagatccattccaggcttcagcgcaagtatggcaaggaagtcgctggccattaaatgaaggttgaaatgggcgtccaccggggaaagcggacgagcagggcagaaggcgtgtgctctgcttgtcagaggtcacttccggctgtagacgagccctcattgtaaaaagcatgtttcctttcttaggcagtgagaggcccatgtggtgacccctgaccagataaaaaggaggcccaggcctaggagaggagggggacggatgggttctagagcctaaactctctctcgctctcgagctctctgtattccatcacacacagatccaccagaacacaggagtagggtgttacgcttctcagcggcccgaacctgtctacgtcgcccgtatcttgtgcgtttcctctctcgctgacgttcctcagatcgagggcgaagaacctcacttagcgcccccggccgaaccggcaaaggggggcctacgcggtctcccggtgaggagccccacgctccgtcaaaattaatgcaaataataatcggaattggcatgtggaattttcttgagttctacgtgtcgaaatatgctaacaagatttttagtggaattttcagagctctagaaataattttaatcaattaaaaatgagcacaagcaatatttaatcccatgaaaattcttttccccctttttcttttcctttttcccctttttatttttcgaatgggccgccggcccattctcttc

SEQ ID NO: 59460 - DNA, 9730 bp, Oryza sativa
taggtatgacggttggcgaaggggaaatgtccgaagtgcgctccaaccgccatcagggagtgatctagagcgttcacgccaaaccctagcctgaatgtctgagattttggttcggccgaacctgggctgggcccatctggcctggtctttggcccatctcctcccctcattctcctttatccatttatcagtattttgggctgatttgctgacattttgatgaagttcacaacctattcttgtatggatacagaattctcctcactttagtctagatttcctcccaacatcagggtttatcacctgcatacaaatatacaccaacattgtggaatatgtaagatttaagcacctaccactatgttggatgttatattatctgaactctatgcagatgttggcggtacagaattggcatttaacagctgccaacaaaaccccccacacttagccctttgctcatccctgagtaaaggttagtgtagaattaatttcttcaagatataaatcaagcatataaatcattcacaaccatacctgcacctgtgaactttatcagtggctatcttatcatcttgtgtaattgacaaatggaatgatcttgattccagtccttcttgcttctctgccagactcatgggatttttatagattttcacaaatcagcatttctcctcctattgactttctctcatgtctctcaaggatgtatattttctttttggatccttaccaaggcaaaatttgccagaattcatccctattataaggctaatatgtggagcttggtagggataaattgtgacatacctgcatcatatatattgcaagtccaaaaatatggactcaagaagatcatcaatcatactcttagatcaagggtctttatttgtggtggaaaatggaaaagtaatatatttttgtggaatggtggaataaagaaatgattcttccttcttcctataccttctctccatttggttctcttagcatgatcatggaaggggcatggctatatattttttcaactttgctcaatattttgggagcaagatttctttctttctttctttctcccttttttttaatacataccatgccttgcctccccttttctcattttccttttttttaacaaagaacttttctaagagaagaaagcatagtctgaagcaggagtttatttgaatggaatttttgtggaaagccatcttccaatgtagaagcttagcttaattatatatgtggaaaaataggaatggaaatgataatgaccccttgattatgagagtatgaaagatgactagcacaagtcacataaattcatcaaagctcaatataatgttaggcagtcatatgcataagatggtttatcattgacatacttgcatatggcctcggtgggtataaaatgaagtcaattgaggattgagcctttaaaacaattttattttgaaaacaaattcccaagtgtcaaaacaggagttgcaagaattcttttcatctcgaatcatctctcatataacaattacttggatgcagaaggttccctaaacatggaaggttgttcacaagcacaagttcagttgagaataatgaatatacaagatcaattatatgaagaatttcattagctggaaattttatctttcaattatgcttgaaccaagtatattctgaatttccagctctagtactatacaatggtggagatatacagataatggatgtgctcacctgcttacctatgaaaattgagaggaattggggccagctttggttcgcccgaacctggtggttcggccgaaccactctggtgtccaatccctctgcaattttctgtagagttcagtgccttccaggtgttcagatattcagcatttttcagagtttatgcacgtcagaatctggaatatctcccccacacttattcaaaacctgaacattattaaacataaaacaaaaacaaactttggcaaacatgggagttaataccaatgagccacattattcatagcaagtgcttacatgattggaaaaataaaaaccaagcaccaactactattttattcatgggaaaggaaacatctaattagcataatacttattttcctttccatttctacgaatgcgcgctttatcttagcgcacaaaccgcgactaagggtatcgaaattatttctaatttcaacaagctctacccctagctccgcgttgcgatccctaagctctatgttctccttgcggagtttcttaacttgtacggcgagcttatgaatcgagggctccggcgacttcacttcgtcttcttggaattagccgggagccctcacaattggaggggacgtcaagtgacgcttcaccttcataggtggagggctacgggattccgctgccccctccttctccgatgccgtcaaaggccggagtaaacccttgccatacccacctccgggagttcgcactccctaaatgcggaatcgcttctccttttgagtggatggagtagcggtgggtgtgacatacttatggagcacctcatcccccgccttggtgaacagggtgtccacatagagctcggtgggaggcggagtggccttctcatcgtcttgaaaaaggcgtcgcgccttcaaaagaccgagctctcccgttgttggccgtcgagcaggcgaatccccccgaatttttatcttcatgacatcgcgaggggagagggatcgcactgccgaacggggggccgaacggggctgagaggggttcagccgaaccagggagctcgccgacgggctccagattcacaagggagcccggcaatgttgcgaggggctgtgcccacggtgcatttaccccttccatggtataatgttccactgggatcaattgatttgccggtgtcggctctctgtcgaggttgtatgtggaattggaggaggagccaataaatgggatcaatgattttccagccattggtgaattgagggtgatggagcaaaggaattgagatgatatggagaagggtttgcacaagtagacgagaggaggaagaacaagtgctttgagctttgatccgatcgatctacctctgaaagcgcatatcaacggactaagaacgagcgggggaaactgatatacaaaattggtgctggttgggcgccaccctggttcggccgtaccataaccctggtgggtccagctggctgccaatgtttccctaggcctataaaatcctaaactaagcataaaaataacaactttaagggttttaagcataccttagatgagatcatcatggttcataatcgattagttcaataacatccacttcttcatctaaagtttcatttggctcaaggaaaatctttaagcattgaccgtttaccttaaacatgttacctgagtcgtcgcggattgtgattgccccgtgcaaagaggtgtcgatgacattgaatggtccttcccatttgctgtgttgttttccatgaccaaaatgcttaaccctggagttgaacattagcactttgtctcctggcttgaatttcttgatttttattcttttgtcatgctagcgcttcgtcctttctttgtatatcctcacgttgtggtaagccctctctctccattcttcaagttctgcaatttgcatttttctcctttctcctgctccctcaaaatccatgttccaatttctgatggcccagtatgctctgtgctcgagttctacgggtagtcgacatgacttcccgtagactatctgatatggggacattccaatgggtgtcttgtatgctgtccgatatgcccacagtgcgtccggcaatctatcattccgtcatgttcccattttgttgaccatcttctgcagaatattcttgatttgtttgtttgatgtctctgcttgaccactggtctgtggctggtaaggagtggccacgttgtgtttggctcccatctatcgtaggaggtctcggaaggttttgtcaatgaagtgagaaccttcgtcacttatgacaatcctgggggtaccaaatcttgggaagatttctgtgaacatcttcttggcatgcctcgcatccgtggcgctgcacggcatagcctcaacccacttggagacatagtcgactgccaccagaatgtactcgcagttgcgagacttagggaaaggccccataaagtctataccccaaaaatcgaatatcttgacttacaaattgtatgtgaggggcattgcatcgcgagcagtgattcatccttgcctctggcagcttgtgcatcttctgacgaattcttttgagtcttcgtacattgtgggccagaagaggccacttttccaaatcttggcctgagtgtggaatgcaccgtaatggccatcatagggtgaggcatggcatttctctatgatcctaagtccttcatcaattggcacacatcttcgtagtaagccatcggagtagacccgatataggtatggctcatcccatatacgacggcgactttcatactttagttttcattgattttcccctagtggtatgtacttggataccatgtagtttactatgttggcataccacgggttggagtcgcgaactgtcatcaacatgtcgtctctcaagaaatcatttatcggctgttcctgcatgtcagtgatctgcagcctagacaagtgatctgttacggaattttctactccctttttatctttaatttctaagtcaaattcttggagcagcaaaatccatcttaagagacgtggtttagcatctttcttagtgagcaggtatttcaaagcagcattatcagtataaattatcaccttggctcccactaagtaagacctaaacttattgatagcaaaaacaaccacgagtagctctttttcggtagttgcataattcaactgagccccggttagagttttgctagcatagcagattgcttgatgctttttatccttggtttggctcaaaaccgcaccgacaacgaaatcgcttgcatcacacgtgatctcgaagggcagagtccaatccggaggttgaatcattagagcggagacaagtgcctttttgagaatttcaaaagattttaggcacgcgccatagaactcaaagggcgcatccttggccagcagattggtcagaggtcgggcgattgtagaaaagtcataaaaagctggcgtgtcctaaaaagctgcggatttctttgatgttcacaggaggaggaagctgatctataacgtcgattttagcacgatcaacttcgattcctctttcggacactcgatgcccaagatctatcccttcacggaccatgaaatggcatttttcccaattaagcaccacatccttttcttggcattgttgtaagactttgtctaaattctacagacaatgaccgaaagtctttcataaactgagaagtcatccatgaagacttccatgatgtcttcgatcatgtccgagaaaatagacatcatacatctttggaaggatgcaggagcgttgcatagtccgaaagacatcctacggtatgcataggtgccatacggacatatgaacgtagtcttactttggtcctccggatggataggaatttgatgatacccggaatacccatcaaggaaacagaaaaaggaatgatttgccagccgttccaacatttcatcaatgaagggtagcgggaaatgatcctttttgtagccttgttgagcttcctgtagtcgatgcacatcctccatccggttatggttcgttgcggattaagttcgtttcgagcatttgcaatgaccgtcattcctccctattttggcacaacctggactgggctaacccactcactatatggtacaggataaataatcccggcatgcaggactttcaagacctctttctttacaacctctcgcattgcattattgagctgtcgttgaagttccctggagggagtactctcgtggtcaatatgaatacgatgggtgcaaagcgcaggattaatccccctgaggtcttgaagcgagtagccaagaacagaacgatgcttttccaacacgatgagaagacgttgagtctcgtcttcagagagcttgtcattgattatgacaggggcctctttgtcattgtgtaggaaaacataacgtaggcctggaggtagaggttttagctcaagcggaggtcgaggtggtggttcctgatccgcttcctctttgatgaaatcggggacctcatcttccagaagggcctcaggagactcatgagggggaactgcagtaacctcttccgctgactcaatttctgggagagggtcggtcaaggcaatccttgcccgtgagaatggaattgaaaattcattctctcccagtgttattttgaggctatctaatcggggtgtgttgatgagaagttgctcaatgggcagcccaatgaagatgtcaaaatcttggatttcaaacacgtggaaattcaagatcgcctccctgtcttcaaagcagacaggcacatcttgtacaatcctgaatccttcaatgatatttccgttcggatgtttgaagaatttgtttgtcggggtcatgtcacaccctaaaaatcctaaatatataaattgttgtttaattggaattattagaattgattttaaaagcctagaagagaagatctaatttttaaataataaattccaatataaaattgggccagataaaattttattaaatactttacttgattctatagttcctagatttttctgggatttatttgagccaaggaagaatttttaataaatggaattgcatttcatgaataatttaaattgaaaaaggttttaaaagttctcttttggctttgggccgaaagtcggcccaaaacctctgtctctctccctcggcccagtcggcccagtcagctcgcagcctcccgtgcgcgcgccctcggccgctgacaggtgggtcccacctgtcggactcgtcgtccacttgcagccgccgcgccgaaaccctagccgccgccgccgcctttccaaattcgctcgcccctttctcgatccggtgaaatcaattgaggggaaatgtttcccgagatcttctctacctttttccttttggaatcgatcgctaaatcggtttggaaaccgtcggattcgagctcgaatcggattcgtttctttccctttaacactaacctttccttcgcgccgccggtcgcggtgggccttcgccgccgccccctagccgctttaaaaggacccccaggccctccgctacccgccgccaccctcgccttcgcctctcgtcgcctgtagagccctagcgccgtgccgcttagcgccgccgttcgtccagccgtacgccgccgtcgctctggttgtcgtcgccgcttgggaaggtcgccatcgtgatcgccaagccgtcgccgtcctcgtcctgtcctccgtttttgccgaagaccgccggagcaccgccgtcgtcgtcaagccgaaggtcgccgccgcttcttcctcgtcgccgtcgccgtccgttgatcttccgccgctgttttggtcaccggtgagttcgccgcgtcgccctctacgtgctggtgtcctccattcgcgccgccgcgccgtcgttcgccggcgagcttgcgcgcccgagccgccgctggtgatgacgtcatcgctgacgtcatcgttgccgtccgtcgtagaccggtcgtagaccgttagatcttggccgtccgttgtggataggatagatctcggccgttcgtttccgtgagccgccgccgtgcacccggtccaccgtgaaccctagccactgacgcaatatccccttttccttttcaaaaataattcattattgcgtcataattcaattaaaatccatataaatgatttaatccgatttaatctttgaaaattcataactaattcatcttagctcggatttagttggttcaagtctttaaatttttctaaaattgagatctacatgttaaaaatatccacatgtattgttcatgcttgtttatgtgctgttttagtgatttttttcttttctctttagattccgacgttcccggaaagtccgattttgcaggagaagattttgaggaattccaaggccagcaaggcaagtcacacagatcccaaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgagctttatatattggttcagctagatattagatatgattgctcagccatgcttagaaacactatttcatataaatgggatacttatgactcactattatttaatgatggcttaatgatagctcacgatggtcaatcgtgattggttaattaattaaattgccaactaaaacctgataatggtgggttgtgagtacatggttttgatggtcgtgctcatgacaattaaggaccggttcacgattttcggttgtgaaacatttaccgtgccaaccacaagccagcgtgggcaacggctttactttctgtatagtatggttcatagcagagcaccagactgtgaagtggcagagataagcccacgggggtcgctgaggagtccatgccttgtttataagggggtgattatgatctgggaatggtgcaccgctttgaattgtattatatagagggtattgtcacaatctctattcgggaacttgttaagtatcgcgacgcatggttgacatgatgttgaggttgtgtcttgtgggtacagtggtacacctctggccagagtttaaactattcgaatagccgtgcccgcggtaatgggcgggtctaacaatgtctttcgtgattagtctcatatttcacaccataataattgatgatgttaataatttgtttagctcctggtttggaatggtacattcctggtttggagatagaactgtgcagccgagattggttgtttagaatggttgggcctatgcaacagggtatgttgtatagcattggattaatactgtttaattaaatactttactgttttattaaattctgaaatatttattaaatgctatttatgcaaatgagactatactatgccaccctttgttatcctgtgcacttgcatatttgctgcgtggcttgctgagtatgtcatatactcaccttgtaatcattcatcagagaaggagatctacagtgatgctgatggtgtggaggattaggtgtacccctggtcaagctgcctgtggagtgtagtcgtctgcgccgtttatcttatttttccgctgcttagatctttattggttgagaggaactatctacctctgtaatgacattttattcgcttattaattagagtaataattgtactctattatcaatttgttattgtgtgcctcggctgattcctagacgagggtttacacacatgtaagcgtttggaattttggatagaaattccgggtgtgacaggtcactaccttatcgcttaaataagcgaatgcaaaagactcggaaatgagattgaccccgacagttggactatagaggataccgacatcgttcccttccatatggcaaggaatgattcggggagcggtatttatccaaattacttcggattaaagctctgcctcccttagtcattcatcgctcattatggatgttaac

SEQ ID NO: 59461 - DNA, 2726 bp, Oryza sativa
ccatgacaagccatccgataggaccacaatgctttggccaacctagtgtgtcattgccgaggataatcagagatctttctcttaatgaacttaatcaaactcttattagatgcctcggcttgcccattagcttgtgcataatatggcgaagaattcaacaatttaatacccatgctatcggcaaactgaacaaactcatcggacacaaaaatcgagcctcgattggttgtaatggtctgaggaataccaaatcgataaataatatgcttttgaacaaattgtatagcatcccctgaatcaactttcttcaaaggaatcgcttctacccagttggtaaagtaatcggttgccaccaatataaacttgtgtcccttgctcgatggtggattaatcattccgatcatatcaattccccaacctctgaatggccacggtttgatgatatgattcataaccgatgctggcgctctttgaatcgctccaaacttctgacaatcttaacatcccttgtaatatcggaagcaatcttccaacattgtcggccaaaaatatcctacccgccgaagcaaccacttcatcttataagccgattcatgagtgccacatataccacgcctatcgcaaccttggcttgataggcactcaaacatttaagcaataccccatcaatcgtccgataatacaattcatcatccaacaaggtgtatttcaaagctttatagcgcaattttcgtgaagccatgcattattttcgaatgtcatcgggtggtgagcctttcccagataattaatggccgaagatgactttattttcctatgggttacaatttgattagcttggaccttatatattggattggttcagctaaatgctataagtatagttgcttagccatgcttagaaacattagctaattaatgggatggatcatatatactacattattatttatggttatatttaatggtagctcacgatggttaatcgtgtaaagttaattaattgataattaaaacatggttaaaggtgggttgtgagcatatggttttgatggttgtgctcatgacaattaaggactggttcgcgagctactgttgtgaaacatttaccgtgccaaccacaagccagcgtgggcaacggctttatcttttgtatagcatgattcattatggtgtgccagactgtgaaacggcgagaagtccgtggaggtcgctggggagtccattgcctctggttttgacggggagattatgatctaggaacggtgcattgtggtgagttgtgttgtgcaaggggtaatgtcacagttcctttccgaggtaccgtggtggtgctgaggcgcatggtgacatgttgtgggattgtgtcttgtgggtacaatggtacacctctgatcagagtaaaactataaaaatagccgtgcccgcggttatgcgcgagttgggcaatgtttttcgtgattagtctcacgctactcattaatggtatttgtgctaattaatgtgactcctggtttggaatggtatattcctggtatagaggtttgatttgtacaaccggggttggttgttcagatgaggttgggcctatgcaacacgggtgtgttgtatggtgtttatttaatactgcttaattattcaactgttttactattctcttaaatatttattaaatgatgtttatgcaaatgagctttattatgccatcctttgttatcctgtgcacttccatgtttgctgtgtggcttgttgagtatgtcatatgcttattcttgtaatattcattcatcagaggaggagtacttcagtgaaggtgatgatctggaggactaggcttgatccgggttaagttgcctgtggagtggagtcgccatagctattccgtagtttgctgttatttttccgctgcgtagaatgttattctttgagaggaactatccacctctgtaataaattattatttgcgaatattaaatagctgtgtgttcgtactctattatcaatttgttattgtgtgcctcggctgattcctggacgagggtttaacacacatgtaagcgtttggaattttggatagaaattccgggcgtgacaccgattgagatggattctgcaaatattggaaaacatcatatcttcaatcatcaactgttatcgtagcaacttctactttgacatcctttatcatcggcttgtactccgatgctccttgagccgagtcattagcttcaacattttgctctcgagacacatgcgtcaaagttaccagccgaaatccatccatcaattctcggcacttctcattgtaaaccattaatgtatcattcttgcggtcgtttgcggtcgtcgccgaaggttcagaaggccgttctctctgggcaaggcaagtcacatcatccttgagcatattgaatcctagtttataaaattattttgatttaaattaatgcattatcgctttatttaaattcccgcattatcactgttttatttagccatgcctatttacctttgttatgaccttattattattgttattgttattattaccttgttcaccctagaataaacaaaacctcaactagtggacactctactcatggcaccactagtttagttttaggtagatgcttcgcaatttaattaggtaacattaggtggtttttcaactatagaccttgggaaatattcatatcatctggatactatggaatggtttggttatt

SEQ ID NO: 59462 - DNA, 17327 bp, Oryza sativa
tatcaagacaagaaattttgaaacatgagttctcatactccaaaactggggggcatgtgttaacagtgaaatttggtaagcccaaagttaccattggcttagagtcagtatcgacttcaaagttctagaattagccgatgggagtcaagtcgccatgatgtcgtgttcttggtggagttggatcaatcagagttggggtcatcggcccttggttgaacaggaaggagttgatggtgttggaccagaaataggtggcagcggccatcaagtgttcatctttggccgaattagctatggtgagagcgagggcttggccaattccaattttgtcccaatgggtgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaacataacaggagctaagccttgacttgaactgcagcgggaacaccactccacaggcatcctcgatggcacggacgaagcctactccccggagaaaccaccatctgacacatactcatactctggggttggggaaaatagagcaagactgagtactacccactgtactcagcaagtcataccggaataggggtatgatgcagggaattatcaaaggagagatagagcggtgaaactaatcacggtgaatctggttgaccgcccataaccgcgggcacggctattcgaatagttttactctgatcagaggtgtacaactgtacccacaagacacagccccacgacacgtttccgtgcgccgacatgccaccacggcataccggaaagaggccgtgataggacccttcgcataacctcctctaaccaagcacaccacacttcaggtttcacccccactcctcgcaaggcagcgggcagtcccctctcgtgcctaggtgaatccggaagcgacagaggccgtcgcagggcccgccccgttccatcacacccacccttgcctggatgcgtcagctagaggaaagctacactacaagcccagccgttgcccacgctggcttgtggtaagtacgataagttcttccagggcatccggcgaaccggtccttaactgccatgggtgcggccaacaaaacaatgcacccatagcccaccatgtgattcattttaattattcaacaccaaagaggtggtactaatccaacattaccattagaacctgcagtctatactttaataggatttttccccaatgtgtgctagttgaactaagcatggctaagcaattcctagtccaaagtctattcatgttataacccaagctaacaaaggaacatggtaccaaaatagcatggctgtaacaataggtaaacatcccatagtaacattataaaacaatgcagtatttgaagaaaaacaataaagcatttgcaatataggatcaacatgttcaagtgacaggcatgacttgccttgctctgctgctggaggaacctcggcgactatctcgaagtacaccggagcggggatgaaggtggtggcgacgacccggcaacgaggaggggcggacgggtggcggcggcacctaaggagggagaggagaggggttaggggattggaggaaacccgcggcgacaaaaatggccggccggagttgaagggaatggaggggctcaccgacgtgcgaggaaaccggagctcccgaggggttcgggcgatgtgaggcggtgaccgaggtgctccaagcggcggcgaagctaacggcggcggcggcttggcgcggtggcggctctagcggcggcggcgcgcagttggaggcggcagcgaacggcggtgcggcggcgagcggcgcgagctcggtagcagtcacgggatggagcggcgagagcgtaaaggggaataggagggcacggggaacgttttataggcggagggggaggcggacgtggccggcaggacctccgattttgccggcgacatggggaggagagagaggaaatgggggggattcaaattgcgaatcccgccccttttcaggcgcacgcgcgggccgggagacgcggggagagggcggcgtcacggggaagacgcgtgggcgacgcggcgtgggcacgggatgagcggcggaggtgggcgcggtggtttcggcggcggttgccgacgtggggcgggcggccggaggaaggggacgacaccgacaggtggggcccacctgtcggcgtcccgaggagagagggaggggcggcttgtgccggcccacaaggaggagggtgcgcgcggcggtagggtggactgggccgacggcccaagaagaggaaaaggagggaaaataaaaagaaaaggaggaaaagattttccctggtatttaaagattgcactttgcttattttaattggttaaaattatttcgagagctctgaaaattccactaaaaatcttgttaatgtattggagcatggggaactcaagaaaaattccaccatgccgaatttggttattaaaagcatttattaattaaggattcaactctaggttaattcaacaatttctttaggagatttattaaacaaattttaaagctggaaaggggaacttcagggcgtgacaaacctaccccccttaaacggaatctcgaccccgagatttggaagagctggcgaagaggtgcggatgggcggcctttaactcatcttctctttcccaggtggcctcttcttctgagtgatgactccactgaaccttgcaaaatctgattactttgtttctggtccttctctcgctggtttcgaggatacgagtcggcttctccacatacgtcaagtcttcttggatttcgatttgatccggacttgcctgttcctcaggaactctcaaacatttcttcaactgagagacgtggaacacactgtggatgccaagcatgttggagggaagctcaagctggtaagcaacttcacctcttcgttccaagattttgtatggtcccacgaagcgtggtgtcaacttgcctttcgtctgaaaacggtgcactccccggagcggagtaacacgaaggtacacatagtcccctgcttcaaacgtgagctctcgtcggtggttgtccgcgtagcttttctgtcgagactgggcaatcctcagcctttctctgacagttctgactttttcctctgcctcggttagcacctctgtcccgaacagttggcgttctccagtttgatcccagaagagcggagtgcggcacttccgtccatacaatgcttcaaacggtgccatttgcaaactggcctgatagctgttattgtaagagaattcagcatacggtagacttttatcccaagctccgccaaagtcaagtgcataggctcgcaacatatcttccaatatttgattgactcgctcagtctgaccatcagtttgcggatgataggctgtgctgaaattcaaacgagtccccaattcttcttgcaacttctgccaaaattttgaagtgaactgactccctcgatcagatactatcttcttaggtaccccaagcaaacacatgattcttgaaaggtaaagctctgccaaccttttcctagtataggtagtgtgcactggaatgaaatgagcaactttggtgagtcgatccacgactacccagattgaatcgtggccagatgatgtcctgggcagaccggttatgaagtccattctaatctcttcccatttccattccgggatctgaagaggttgtagcaaacctgctggcctctgatgttctgccttaactcgctagcaaacatcgcagagtgtgaaaaattcagctatttctctcctcatgctgacccaccagaatttttctttgaggtcttggtacattttggtgctgcctggatgaatggagtactaagtctgatgagcctcggtgagtatcagatcctttagttccttgtcgtcaggtacgcacaatctttctcccaaccagattgtgccatgctcatcctcatgaaaatctcgggcttttccaaccctcatattcttcttgagctcagctatttcaggatcatttacttgagccgctctgacttgatccacaagcgtaggccgtgcttccagagcggctacgaactcgtgttcaatgactcccacattgagatgttcaagctcctgctgcaattcttcacacatgccctcgatgcatagggcattgcagtagcttttcttgcttagcgcatctgccaccacattggctttacccgggtggtagtgaatgctcatgtcatagtctttgattagttccaaccatcttcgttgtcggagatttaggtccggttgggtgaagatgtatttcagactcttgtggtccgtatatacttcgcagcggttgctaatcagatagtgcctccagatcttcaaagcatgaaccactgctgccaattccaggtcatgagttggataattcccttcatgtggacgcaactgccgcgaggcatatgcgaccactctaccttcctgcattagaacacatccaagcccgtggcgggatgcatcgcaatagacctggaagtctttcatctggtcgtgcagaatcaaaactggtgtggatactaatttctttttgagctcctcaaaactcttgtcgcactcagctgtccatttaaacttctcatctttcttaagcaactgactgagtcatgggtcgggcgatcctggagaagttttcaatgaatcggcggtaataacccgcaagtccaagaaagctccgaatctgcgacacggtcttcggtggggtccatttggtaactgactccacgttcgatgggtcaactgccacgccctgagctgtaataacgtgacccagaaatttaacttccaacaaccagaagtcacacttgctgaacttggcatataactggtgctccctcaacttctcgagtaccagacggagatgttgttcatgttcttcttcggactttgaatagataagtatgtcgtcgatgaacaccacaacaaacttgtcgagaaattccatgaacactttgttcatcagattcatgaagaacgcgggtgcgttggtaagtccgaaagacataaccgtgcactcatatagcccttaccgagtggtgaaggccgtctttggaatatcctcttcccgaattctcaactggtagtagcctgatcgcaggtctatcttagaaaacactttagctcctttcagctgatcaaacaaatcgtctatccgaggtaagggatatttgtttttgattgtgacctcattgagtgcgcgatagtcgacacacattctcttcgtcttgtctttcttctccacaaaaatgaccggagcaccctaaggtgaagtacttggtcgaatgtaccctttctgcagctgctcatcaacttgcttcttgacctctgctagctcgttggccgccattctgtacggtctcttgtaaataggggcagttcctggtgccaaatcaatctggaattcaatttctctcttgggtgacatggtagtgaggtcttcggggaacacttctgggtactcgcagactatggggatatcctccaatttccgcgaattcttctcctcgatgaccactgggatttccacctcaatctgattcaaagagaccccttgctttggtgagactagtgatttgtacactactgtttctcccttctcgttggtcaaggtgactgtgcggttcgcacaatcaatgactcccttgaacttggtcagccaatccatcccaagtatgacatctaggtccttggattccagaagaatgaggttggctagaaatggtgatctttggatttctattgttatagaagggctgaattgtaccgaagtggagctattccctggggtatgaacccgcattggtgtgctaagttcctctcttattaacccatgcatcccgacaaacttctttgaaatgaacgaatgtgttgcaccagaatcaaaaagtactgttgcagggattgacttaacaggaaacgtaccccgtacgacctcttgtgctgcttgcgcctcctctgtggacgcgtggttgacatgggcctggacaaaccttggcccggcacgcctaggcttcgggcatttgtcagcgaagtggccaagctcgccacagttgaagcagggtcccggctttcctccggactccttcttgagctgttctaactgagccagcatagctggtagatctgactgggctggtgccattaatgggggtggagtcgagttgtggttgtgctgcttactgttgttgtgactgccaccgttgtagtcattgttgaagttactcgggtgatagggatggtgctgacagacgatcagggtggaaggcccacctagctgtcccaccatgaagcgaggctagaaattcataatcgccatgggcacaactagcaaaaccgtgcacccacagcccaccatgtagtgtgttttaattaactaacaccattacggtggcattaatccaaagctataccaataatcaaagtctatgtattaatgtggttccccatttgtgtaccctggctggtcctggacaggggtttaatacacattcaccttagaaattctggttcgtgaatttctgggcgtgacaatgggtctgcttgctagccgatatgcgcttgtaccacgtggtccagcttttctctggggaggttttctcaagggatggccaagacttgaaggtgtttttccaatgacctaaattagggttggctagtctgaaagggattctgttggtttcaccaatgatgaactcagtgggatcaggattgccgattggaccaagaaagtaatggttctcgtgagataggcttgggactgcaatcagattggaaaggtgctacgaatccaaaagaacagagaagcggagatcttgctagagtaggagtcgcttgggaatcgcttcatgcaccgaggggatcgacggagagagagaggacggagtttgctttggcggtgaaaacggaggaaacggtgtgaggtttctcggggacaatggttagtatttaaagcgctggaataacagtcggaaaacggcaagtgcgatattctctcggaatcgatgtatggaaaatccgaaacattatccaatattccagacttggggggcatgtgttaacgaccaaatttggtaattcaagggtcggatgtgaagaaggaatcgaaatggaggtcgagatagagattgtcccggaaacagagtaaggatcggctgaggtccgaatcggctatgactaagatcgacagagtttgagtcggacaaggttagccgattgagccgagcccgacagtatgacacggcgtatgttgtcggtttaggttgacgtgcttcatgatgattgccacgcatggataaagtcctgagaaggcaattgtatctattaattaggatattttatgtaatttccttagagatatgtttgggcaaaagtctgccgcaaagacttatggtatctcagagtttgttagagataagagtcgtgtccgagatagacatatcttgtaattctcgggtataaatagacccgagcctcatgtaataaaaaaaacaaacgttcaacacaatctcggcgcatcgccaccctttttactttcgttttgtttcgacgagttcttgctttcgggttaagctacatcggtttcgatcttcaacaagaggtaaaacatgttatggcggcttgtgttctcgggattagtgcttccatcttcatgatactttaatcttgtttatgtaattcatcgaattatcatatatcttatataatctccggcaatatcattatttaatctacaatcggctaccatctgttagtagaaagcagccgattaggttaaatcccgatgttggcttagattatatagggtatctaccactctatgacgcatccaacggcttgattgtctagatattgttcttcttttcatatttatagctgtatcagttgagtttgatcttatgagtcgtgattagaatctcaatctctagcctgtttttggttgccaattagagtagtatcggagtttcagccgatcttacctgatttagctacatttatcttatatgcttgattgacatgttaaatctgccctttatatcaagatcttgccgcttttaagtatattagacttttgtttggtatttttatttgctttgacgtcttagagtagtatcagagtattagccgatacatgctagatctatttgatcggctacgctatggacatatatagtctcattgttaatatatatttcgatctaagtgatttatactgtctcggcatgggaaccgatctatcccaatcacttgatttaagtatatgtcgacatcaggattatatattgttaatatctacaaccgatcgagtagatttagttcgttcttacttattcatgattgccgatcgattcacatatgacatcggcccaaagataaatgatatgtcatcggcacctagccgatgactatcgtttatagatttaactgcggtttctttgtttttgcttcttgttgattccaggatcaaatcaactggcacactcatacacccaaaggcaagttttggacctgcactggagttaagcagatctcccaggcctcgtgtttttacatcaagcttatgcctatgaagtttactagctttgggtttttctttgcactttcaaataaggttgtaatagtttggatctttaaagcattaatagttgtataattagtttgtatgaacaaatttgtataattaatcgaaagttgttctgtatatcaatctgtgcgtgatcgaaatcctggacgatcacgagtggatttttggggcaccaaacctaaattgggtgtcccaacagtactcatccataggggtagccttgcttaaattccgaaagtcaatacaaaccctaagcttgccattctttcttgatgactagaactatattggaaaccaactcagcatatcggcatggccgaataaagccagcatcatacaaacgagtaatttcagctttgatagcatcatatatatcggctttgcatctcctgggtggttgttggtatggccaatatcctggttgataggaagccgatgttcaataatcgatcggctgtgcccgggcatttcaaaatattccccagcaaagcaatctctatattctttcaaaagctctattaacttggttttgaattccgcggataaattcttactgataaatgtcgaccttggtctatcccctagacctatatcaacttcttccaaatcatcagccgacatgaaaccctgtcctaacttgccatcgagatcatctaatgtgcctttggtgtagaaatttgaaccctccacgacaccctcaaagtaacaatttaggctctccatcttcaattggttgtatatcacaatcaaacacttttaaataacctccttcccaaacttttccagacagtcagtcaaatccatccatcccccaaatagctaaatcggcactagcaacattaactgacctgtcggctggtgcgatctgtatcttgtcaccttgccattgaattaaacaatggtgcatggtagaagaaatacaacaattcacatgaatccaatcccttccaagcaacagactataggaacccttcccatcgatgacaaaaaacgtagtaggaatagttttgctgccgattgtcaactccacgtttaatactcctttccgaaggattgccaccaaaatctttaagaaccatattagtcgtgatgaggtcatctgcattcttacccaatttcctgaatgtagcatatggcatcagattcatagcagccccaccatcaaccattatctttggacatcggcatcccattgacaaatccataaacgtacaatggcttgatatgccgattttctgtcccctctggtttctcaaaaattgcttgttctcgtgacaaaatcaacttagcagaagcttcttccatatcatcagcatcggcttgattagtgtcgcgaccgagaaaatttgcattttcccgaacgctagtgtattaatccccttcccaggaaaagccagggtacaccacacaaacatgatacaaaaggcacatctttattatatcgataatatttatattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggagaaagatagagcaagaatgagtacaaccacagtactcagcaagccacaccagcagatgcatgattaatgcaagggggtacaaagggtaataatataggggttaagttttgcagtaaacagcatttaaaagacacttagttggccaaagtcattttataaagacgatcctagagctacacagtgttattaatcaaggccgtgaaccctcacgaacctgccttaacccaaggcctacgatgattcagaccgaactggcaacccgaccctgggtcccagctcgtcccaagccaacccaggccaaccattccacatttcagttgttaagcaggttttaagaattaaaacactaacttgggtacattgctaggcttgcccataaccgagggcgcggctattcgaataggttatactctgatcagaggtgtacagctttacccacaagacacatcttcctcacgtgtaaccacgtgccacataccaccacggcatacggacgaaagacgtgacatagttcccaacccatcctagccataaacaagagtatcgacccaaccccacctacggccggaacctccgggacaggcaggcaggattgagaccctagcagcaggacaccagccctgtgccatgacatctcgactaccgagccgcagctcgtgtagccttcatttgtcctagagatgtccatcgacccctgacttcgtccatctccatccgtgtacttttgtttataaccagactgagccacaaactaagccttacccactagacatgtggaagtacggtagtgctttgcaacagaggcccgagcttaatccttatagtgcccgaggtacgacaaacaaaacccaaccacgcacctcgagcccagcctaaaaccattttgggggttttgaatagaggtggaggtgtgaatccaatttccacaataatccaaccattccatagtgtccaagtgatgagaatattcccaatgtctagagttgtagaaccacctaatgttgcctaattaaccagcgaagcatctacctaaattcatactaggggaaccttgagtagagtgcccactagttggggtttggtttattctagggtgaacaaggtaataataacaatagcaataataatatggtcataacaaaggtaaataggcatggctaaataaaacagtgataacgcgggaatttaagtaaagcgataatgcaataatttaaatcaaagtaatttcataaattgggattcaatatgttcaaggatgatgtgccttgccttgctcgctttcccaaacgtcggcttcaacatccacgaagagcggatcttccgaagctgcagcgtctacacgaccaacggaaaagaaaaaggcttttactctaataaactccatataatgagcaggaacaaagcacaaatatgggttcttgacttcttaaggaaaaattagagacttgaacggtccaattccgagttcaaatgaccaggttatggccatttgaagtttatatgctctttaaatgaatatttgcgaatttcttcatttaaattttaatttaaaaagggtttattgcgtcagcccagggggagggggcgcgcggaccgggtccacgggagtggggcccacgcggcagcctcacggtccacggtggaccgggtgcacccgggctcacaccggccggcgccatgagccacacacgtcagccgcacccgagggcgcaggcggctgacggccgggccccacgcggcagccactcggcacgcccgagggcggccatgccggcgcggttggcgggaggcggcgcgcccgagccccgatggtcgccgccggcaaccaccggcgcggcggagcggcggccgagagatgggagggaagggggaaacgaggcggcggtccacggctcaccccagggcgacggcggcgacggaggaggtggtcggagcggagggaggcggtggcgcggctcgggtcaacggggacggcggcgctccggtggtcggcgaccgaaacggagaggcggacgaggtcggcgaggatgcggcgaagccgaaggaggcggcgccgaggtgggaggcggtccagggcgacgacggcggcggaccggagctcggcggcgacggccgagacagagagcgacgtcgcgagctcgaatccgacgaggaggaagggcggctgtcacagccagattttcgttttaggatttataaattatctaataaattattaatagaatttatattaaatgttcattaatttacaagtgaagttaaatgtgggaaataaaatttcctaaatttaaagcattgatggatttaatttttattaaattctccatgattaattatactctctgaaattttgttggatttttcagagctcaattcctaaatgatacaaagaagagttcagtaattatttaatcattaatgatctaattataattatgttaagtgcttttcttgtttaaaaatccttaatttataatttgttgtctaaaagggaattattagaaatgatcttaaaagcctagaagacaagatctaattttaatttgttaaatctcaatataaaagtgggctagataaaattttgttaaatacttctcttgtttctatagttcctagatttttctgggatttatttgagccaaggaagtatttttaataaatggaaatgcatttcatgaataatttaaatggaaaaatgtttttaaaagtcccttttggttttgggccgaaagccggcccaaaccgctctctctctctctctacctcggcccaagtcggcccaagccgagccgcccacgcgcgcgtgcgaccgccgctgacaggtgggtcccacccgtcagtcgtcgtcttcctctcgccgaaaccctagccgagctgcgccgccgccgccattccaaattcggccgcgcctttccttctccgatgaaatcgtttgaggggaaatgtttcccgagatcttctctaccttttcctttttggaaacatcgtctaaatcgctttggaaatcgccggatttgagttcgattcggatcgatttctctcctccgaaccctaaaccttccttcccgtcgccggtcgccgtgggccttcgccgccgctccctagcccctataaattgacccccgagctcccctctaaccgccaccaccctcgccttagtctctcgtcgccggtagagccctagcgccgtgccgctttgcgccgccgtcgccgccgtcgctccagcagtgcgccaccgtcgcttgggtcgtcgtcactgctcggggaggccgccgtcgtgatcaccgtctcgttgccgtcctagtccgccccttcgccgtcgctatcgaccgccggagcaccgtcgacgtcgtcaagccgaagaccgccgccgcttcaacctcgccgccgtcgtcgtcagtcgtcatttgccgtcgtccaagtgctcggtgagttcgccgcgtcatcctctacgcgtaggtgtcctctgtttgcgccgccgcgccgtcgttcgccggcgagcacgcgaggccgagccgtcaccggtgatgacgtcatcgccgacgtcatcgttgccgtccgccgtggtccggtcgtggaccgatggatcttggccgtccgttttggatggatgaatctcggccgtctaatcttatgaaccgccgccgtgcaaccggtccaccgcgaaccctagctgatgacgcaataattcccttttccttttcaaaaataattcattattgcgtcataattcaattaaaatccatataaatgctttaatccggtttaatctttaaaaattcataactaattctttgtaactcagtttaatgtggttcaagttgcaaaagttgtataaaataaagacctacatattaaaattatccataaattgaattaaatttatttaatcctttttaaatgggctttaattagatttaatcttgtaaaattcgtaataaattcatttgaagtcagaatgaggccgttcaagtctcataattcatctaaaattattatctacatgtttgtttactttttatgtattgtttatttggtttttattagtctttttcctcgttttgcgtgttagcttgtcgtttccgtcgtttcgaaagttcacgagtgcgccggaagtgttcaagaagattaattgaagaccctttattgcaaggcaagtcacacagatcccaaacaccgttcctttgagcatgttgatcctatatttaaattctctatttatttcaactgtgcatttattttcgaatgtcactgggtggtgtgaatctattcctttgttgtggcctatttgcattggttactctattctttgataccttgggatattataatttgactagttgagctttatatatattggttcagctagatgttagacataattgcttagccatgcttagaaacattagcacaccattaggataactaatgtttcactattacttaatgatggatatttaattgtagctcacgatggtcaatcgtgattggttaattaattaatgtgccaactaaaacttgataatggtgggttgtgagcacatggttttgatggtcgtgctcatgacaattaaggaccggttcacgattttcggttgtgaaacattaaccgtgccaaccacaagccagaatgggcaacggctggacactttgtataacaaggctcattgcggagcaccagactgagaagtggcggagataagcccacgggggtcgctagggagtccatgccttgtttataagggggtgactatgatccgggaacggtgcactgctttgagttgagttatgcgaggggtcttgtcacaatcactcaacatggtgacgtgtctgcgcggacacgataacatgctggtgggttgtgtcttgtgggtacagtggtacacctgtggccagagcaaaactattcgaatagccgtgccctcagtcatgggcgggtctaacaatgtctttcgtgattagtctcacacttctcaccataataaatgatgctataactggtaatattttgattagctcctggtttggaatggtatattcctggtttggagatagatctgtgcagccgggtatggttgcttcagaatggttgggcctgtgcagcatgggtgtgctgttcagtgttgattaatattgatgattaattactctattgttttacaattctcaactgtttgctaaatgctgcttttgcaaatgagccctatattatgccatcctttggtatccttgtgcacttgcatatttgctgtgtggcttgctgagtatgtcatatgctcaccttgcaataatcaatcaaacctcagttgaagacaagttgcgaaggagaagacgtttggcttataccccagttgagctgcctgtgggagtggagctgaagccatcgctagaccgttattccgctgctgttttcttttcttttgtaagtatgtaacgttattattatgatggatttttatattaaattgtcagtttgtgtacctaggctgattcctggacgaggattttatgcacaaataagttcggaaattactagtgaatttctgggcgtgacagcggcgagaggcggaaacggacgggggaggcacggggagggtttaaatagggttggaagggggagagggcggccagaggggaaggaaaccggcgcgggaggtccggccgccatcaatggcgccggcgggattaggggaggggtttccaaacgaatccaagggagagagggagggaaaatttggggaaagggagagggaatcacggggaataattcccccctattgattgcacgcggggacgacgggatgcggcggattcggcggcggcggcggcgcttggcgcgggcggagcggagggagcggcgggaggtcggggatgacgggtgggccccacacgtcagcaagggtggcgggcgggcccaaagggaggagggggattatttttagctttttctttttaataaactttgataattgttgttgttgcttaataaatatttttggtactctgaaaattcaagtaaaatttgagggctccttttagaccaaggagaatttaacaaaaattctccgggctacattcgaaattttcttgtacgtattttagtgtttgccaatttcttttcgaattttaattaattctattattccttttagggaatgttttttatttcgggatgaatttatcagaacgtgacaaatccacccctcttacaggaatctcatccccgagattcgaggctagcaagaagataggttgggcggtcttctcttcttgtctgacttcatccgtcgcgtcttctataacaaacttgcctagcaaaacttctccactctggactgcttggcttgatctcctgttgcagatggaatcttctcttcacctgacttgtccctagttgaacctttagctgacttcaactgggtgcggcacttgaagatggggcttcagttccagaacttcttataattcatatctttggcgtcaacctcatacaagttacccacttcacgttatgcgtcgatatcagcttgtcattactaggataccatgcttgtcatcatgagaatatcatgtttgtcatttacttctaacttgccaccaactgcctcatattagctttcctgctctccaggtgctagatactactgctattcgatgcgagggtcgataacttttgcctttgaattatgtttctcaacagaaccaacttatcccacttgacatgctttgacgtcttcccaaatggctttactgctggacttcttattgtctgatcgttatcctgccaaatctgaagcttcgttgttagatgtgattttattctgacctctgtagactatcttcgaacatatcacttggttcataactgggaatagctcccacgaacaagcagctcggattcactttctttacatttagtttacttcccactattatcttcaggttgtcattatttagcattcaacgtattcctttacacctttgaccttgatgagttccttcccattggatcatctccca

SEQ ID NO: 59463 - DNA, 1816 bp, Oryza sativa
atgccacctgagagagacagagttccggatagacctagtacctggaaccaaaccctatccataagagaccatacagaatggcagctaatgagttagtagaggtaaagagacaggtggatgatttgcttcagaaaggatacattagacccagtacttcgccgtggggagcaccagtcatctttgtggagaagaaagatcatactcagagaatgtgtgtggattatcgagcgttgaatgaggtcactatcaagaataagtatccgctacccaggattgatgacttgttgtcacgcccagaaattcccaaatagaattccaagcagaatgtgcattaaaatccccgtccaggaacggctggggtacacaaacgacaaagttgacatacagatccacatcttacaaacattataaaaagtcttacataaatgcagcggaaaacttaaaggataactggagctaagccttgacttggtctacagcgggaacaccactccacaggcatcctcgacggcatggacgaagcctactcctcggagaaaccactatctgacgcatactcgaattctggggtttgggggaaaatagagcaagactgagtactacccacagtactcagcaagtcataccggaatatgggtatgatgtagggaaatatcaagggatagctataatggttcatttgcataaagcgagcatttataaacataagttgaaagcagtaaaacagttgtaataattaaacaatattagccatccactgtccaacactaaaccacgttgcaacaggcccaaccatccacctatattattcaattccattagactaatctagagtgaatctaatcacggtgaatctggttgaccgcccataaccgcgggcacaactattcgaatagttttactctgatcagagatgtacaattgtacccacgagacacagccccacgacacgttacagtgcgccgacatgccaccacgacataccagaaagaggctgtgacaggacccttcgcataaccccctctaaccaagcacaccacacctcaggtttcacccccgtccccagcaggcaacgggcagtcccctctcgtgcctaggtgaatccggaagcgacagaggccgtcgcagggcccgccccgctccatcacgcccacccttgcctggatgcgtcggctagaggaaaactacactacaagcccagccgttgcccacgctggcttgtggtaagtgccatgggcgcgactagcaaaaccatgcacccacagcccaccataggatttattttaattaagcaacaccaggacggtggtactgatccaacatcaacactagaacctgaagtctatacattaatatgatttcccccattgtgtgctagttgaactaagcatggctaagcaatccctagtccaatatctagtcatgtcattccccaagctaacaaaggagcatggtaccaaaagaaatagcatggctataacagtaggtaaacatcccatagtattattgtaaaacaatgcagaatttgaagaaaaacagtagaacatttgcaatataggatcaacatgttcaagtgacaagcatgacttgccttgctctgcgactggaggaacctcggcgactatttcaaagtacaccggagcgtcgggagagccggaatttaagcgacatacaaagcaaacaatacaaaaaagctataagactactgaaacagagaacaaaaccaattttaatggattctacacatttttcttgatttactgagacttgaatggccttaaacggagatcggatgaattagttatgaatttcagaa

SEQ ID NO: 59464 - DNA, 2721 bp, Oryza sativa
aagatgcttatcatcggtacattgtttctactatgggttctaattaacacgaggcctcacgggtacggcgtttgctccagtgaccacaatacgattgggatgtctgcttcgtgtaaattggcggtaatgtggaggtcgactttgccttggttgcaggcagtcccttgagtaatgcccgggttctttgcaattatagcaaatcaacgtcttctttgctgagctatccgtctggggacgatcattctgacttggagttggaattggtggttggaaatccttgctaacattggcatcagtggtaccatagttgctatcaccattggagtctttctcagagtcacaattgctagggttgtcattctgggtgccatcattgatactatcgtcgacaccttggtgaatgatgttgacattgcacgcttgattcgagtggtcactaatggggcaagaagcatggttgttggtggtatcatcatcattagtattgctaatgttgttgtctgcattgtgtccatcttcttggggcagaaactcttgatgcgcaacagaagatccggtgatctgaagtggctcggtgcgctgtctttggttaccacatggaaatactgggatgctaacaatccttctcttgcagttcttcatccgattatgctcactttcgagttgtatggctttgtccacaagtttctcaaaatcttcatattcctctagtagtagttgcactgcgatctcatcctttaacccgtggagaaacttctcttgtttgtcttcatccgtttccacatcttctggtgcatagtgagccaaacaatagaactcgtgcaggtactctgtgacggtcaaatcttcttgcttcaggtagcggaactctcgttttctctgtgtgatcattcctacgggaacatgtgatctcttgaacacggctgaaaactcatcccaggtgatggtatgtccttctggccgtgatgcttcatagctatcccaccattctgaagctggtcgaaccaactgatgagttgcgaagacaacccgctcctggtctgtgcactgaatcaaccctagcttcttctcgactgtgcgcaaccaatcacaagcttccataggatcgacggcaatggcaaaggttggaggatcagttttgaggaattctgataacttgcactgtcgctggactgtaggtacttgaacgttggttgcccctgctgggttcttccgattttgtaatagttgaaatgctgttgccaacatgttggtttggttaaccacaatttggattagctctggtgaggtttcgttgatgcttttctcattcccattggcttgggttcttgagtcatcagatccatcattcccatagcctttgttaccagtgttatccatctgtcacaaggtagaggttgagagaggaagcatacaaggaaagaatagaccggaactagggacaggaccttaaaggaactaactctttttgttgatgtgttgtttgttttgcttattctgcaagttgattaagcaaacaacctagcatggttacatcacaacccaccgatgcaaaccacgcgctacacacacaagcaaggaaacacacgactaacaacactaccctagaggacggcctaggttctgcgactggttcccaagatcttcactgcttcttccacttcgctagcggatcctgcggtcttccggagctttggcaaacaattggcgacatctttttcttcgcaaagctgaccatctagtactagtcgaaaatccgaaggaggaagaagagaataaacattttgcaaatagcattagggaaaggaggaaaaaggaactttcgcaaatagtttcatttataaaatatgtccttaggttttatccacttggcttatcgtacagtcgagatggctctgataccagcttgtcgcgaccgagaaaatttgcattttcccgaacgctagtgtattaattcccgtcccaggaaaagccggggtacactacacaaacatgatacaaaaggcacatctttattatatcgataatatttatattactacaaaggcacttaaggcctgacaatcaaaaataaacagcagcggactagcgggcctacggctccatcttcagaggcgcttaactggggtataagccaggactccacctaagacttcttctccaaagcttctcttactgaagggggggaaagatagagcaagaatgagtacaaccacagtactcagcaagccacaccagcagatgcatgattaatgcaagggggtacaaagggtaataatataggggttaagttttgcagtaaacagcatttaaaagacacttagttgcccaaagccattttataaagacgatcctagagctacacagtgttattaatcaaggccgtgaaccctcacgaacctgccttaacccaaggcctacgatgattcagaccgaactggcaacccgaccctgggtcccagctcgtcccaagccaacccaggccaaccattccacatttcagttgttaagcaggttttaagaattaaaacactaacttgggtacattgctaggcttgcccataaccgagggcgcggctattcgaataggttatactctgatcagaggtgtacagctttacccacaagacacatcttcctcacgtgtaaccacgtgccacataccaccacggcatacggacgaaagacgtgacatagttcccaacccatcctagccataaa

SEQ ID NO: 59465 - DNA, 5842 bp, Oryza sativa
tcctagagatgtccatcgacccccgacttcgtccatctccatccgtgtacttttgtttataaccagactgagccacaaactaagccttacccactagacatgtggaagtacggtagtgctttgcaacagaggcccgagctcaatccttatagtacccgaggtacgacaaatgaaacccaaccacgcacctcgagcccagcctaaaaccattttgggggttttgaatagaggtggaggtgtgaatccaatttccacaataatccaaccattccatagtgtccatgtgatgagaatattcccaaagtctagagttgtaaaaccacctaatgttgcctatttaaccagcgaagcatctacctaaattcatacaaggggaaccttgagtagagtgcccactagttggggtttggtttattctagggtgaacaaggtaataataacaatagcaataataataaggtcataacaaaggtaaataggcatggctaaataaaacagtgataacgcgggaatttaagtaaagcgataatgcaataatttaaatcaaagtaatttcataaattgggattcaatatgttcaaggatgatgtgccttgccttgctcgctttcccaaacgtcggcttcaacctccacgaagagcggatcttccgaagctgcagcgtctacacgaccaacggaaaagaaaaatgcttttattctaataaactccatataacgagcaggaacaaagcacaaatatgggttcttgacttcttaaggaaaaattagagacttgaacggtccaattccgagttcaaatggccaggttatgtccatttgaagtttatatgctctttaaatgaatatttgcgaatttcttcatttaaattttaatttaaaaagggtttattgcgtcagtcgagggggagggggcacgcggaccgggtccacgggagtggggcccacgcggcagcctcacggtccacggtggaccgggtgcacccgggctcacaccggtcggcgccgtgggccccacacgtcagccgcacccgagggcgcgggcggctgacggccgggccacacgtggcagccactcggcgcgcccgagggtggccatgtcggcgcggttggcgggaggcggcgcgcccgcgccccgatggtcgccgccggcgaccaccggcgcagcggagcggcagccgagagaggggagggaagggggaaacgaggcggcggtccacggctcaccccggggcgacggcggcgacagaggaggcggccggagtggagggaggcggtggcgcggctcgggtcgacggggacagcagcgctccggcggtcagcgaccgaaacggacaggtggacgaggtcggcgaggatgcggcgaagccgaaggaggccggcgccgaggtgggaggcggtccggggcgatgacggcggcggaccggagctcggaggcgatggcggagagagagagtgacgtcgcgagctcgaatccggcgaggaggaagggtggcgagaggcggaaacggacaggggaggcacggggagggtttaaatagggttggaagggggagagggcggccggaggggaaggaaaccggcgcgggaggtccggccgccatcaatggcgtcggcgggattaggggaggggtttccaaatgaatcctagggagagagggagggaaaattgggggaaagggagagggaatcacggggaataattcccccctattgattgcatgcggggacgacgggatgcggcggattcggcggcggcggcggcgcttggcgcgggcagagcggagggagcggcgggaggtcggggatgacgggtgggccccacacgtcagcgagggtggcgggcgggcccgccagtcagcggcgcgcgcgcggggaggggccgagtgggccgcggggagtggagagagaggggaagggagatgggccgagggggaaggagggagggcggcccaagagagagagagggaaggaaaaagagagggaggagggaagggctttggccgcgggccgagagagagagagagggaggctttgggccagacttggcccatagggaggagggggattatttttagctttttctttttaataaactttgataattgttgttgttgcttaataaatatttttggtgctctgaaaattcaagtaaaatttgagggctccttttagaccaaggagaatttaacaaaaattctctgggctacattcgaaattttgttgtacgtattttagtatttgccaatttcttttcgaattttaattaattctattattccttttagggaatgatttttatttcgggatgaatttatcaggacgtgacaattagcttcatattccgtaggtagcaaaaaaaccatgtttaccgataaagatgtaacagctttgcccttgattaacctctttgctttgtcggcttcaacctcatcggctgtcataactttactcttaacacgccattctttctttgccttcttcagctgatggttgttctcttgctgtacctcctaaaaacgttccctgtttctcatcctctgaacccttctcttctgattcttactaaaaataccagaagggcaccattgcgaattcatgtcttcatcttcgtcctgaaggtgatcctggtgtactgagcccaatctctgatgaataggcaaccttttctgacccagccgatcttctatcaatggcaatctcatcccttcattccaacaaaacctgaaaaacttgcagtcccaatgcagatcaaaaccaccatcatcttcaaaatatctttcctcctgcttgtcatgcctcctttgatactagttaataatcttaaccgagttaagctgtgaacttcaatgatttcccccatcggctgctctcccggaagtgtgaaccatgttaacaagaaaagggtgaccatccaccttcatcgatcttctcgaatcattaaactttatttttccttgttcaatagccgattggatctgctgcataaaatctttgcaatcattagtagtctgagatccggtgttgtgccacttgcaatatttcctctttcgcagctcctcaaccgatggaattatatggccagcaggaagttggatttgcttctcccgaagtagtagatcaaatatcttgtcagctttggtgatatcaaaatcatatctctcgtcttttccagaaatcttcacccactaacatgtcacaaccttcttgttccttgcccattcggctgctgctactttggaatcatcatcttcctcggactcagaggcgtaaggatatacatgattaaccttcttggagttcttcttagcttctgcaaacctttgctcatgcaatgttaccttttgagcatggtgagccaaactctcaaaatcctgagccaaaaatctttctttaattggagaaattaaaccttagaaagcaagatcggcaaactgagaatctgccaaagccaagctgtaacacctgttccgcatatccctgaatcttagaatgtaatcttgtacaatttcatcatgtctttgcttaactgctgttaaatcagatatcttcatctcatgattcccactgtaaaaataactatgaaactgcttatccagatcagcccaactctgaacagaattatagggtaatgaagaaaaccatgtgaatgccaatccagataaagacaagggaaataatctaactctcaaagcatcaatagccaatgcttcaccacactggtccaaaaatcggctgacatgcttgtaagttggtacattatcctgccctgagaacttttaaaagtctggaactttgtatcggtttggcaatggaacgctctcaaaatactctaggtatggatgccgatacaaattactagtatcctttggtttaagaccaaactgctccctcatcacatctgcaatcatatcaacccaaggcttttgctgaggtgctcctggcagttggtgctgaatttgatcaaattgattatactagggcaaaagctgaggttgaggtgatccccctggttgatactgaacttgaagtgaatgaggttgatattgaaagttcaggttaccaccaggataattctgaggtaccaatcggctgatgctgttgaataataggtgtctgctgcccgattggtatctgctgaattagttcaacaaccggttgagttggcttgaacattgctgcaatctgctcttgagtcagacgatgaatattcctccctgcatgctgaggctgttgtctgctcaagagataagggtcaaccggttgcttttgtgctgatgatgatgcacccggtctcccaacagctgaggttgatgccatcgggtgctctggggctacaccagaagtaggctgttgcttgccagtcaacaaattcctatatggtggaaacacaccctcaggaaggaaagccggtcctttagcttgatgttcagcaattgtaccatcaaccgcagacttgatcatatttattaaagtgttgactaatactcctgactagttaatcaatgcattgtagacagcatagtcaaactgatcttgcaaattcttgatctcttgagaatcttccccttctgatttgtcgtccttgggttcatcatccttggctttatcacctttagttttaccatctttagacgtgcatgagtccgaatcatcattgggaaccacctttagtttatacctctgaataactatgcccgaacgagtctgcttgaatgaatgcaagtattgattcttcaaattgttcatcatctgctcgtactctagcatctattctggtgtcagcttatccagtcttatcgggatgatgttttcggggccaacgtcagacagtggtttagcagtctgcttaatgtctatcatgatgaaaaaacgtcacaactcggtcccactgggtgtaccaaaagcgtgttgatgcgaaaaacacacactggcctaggagatctgcttaactccagtgtaggtcctaaatcttgctcttggattcaaaggcgtgctagttgatttgatcctgtaatcaacaagaaagaaaaacaaagaaaccaaggttaaatccataaacgatagccgatcggctaggggccgatgacataacgtcaaatattgagccgatgttattggcattggatcggcaataaagaatgaagcaatataaagttggatctactcgatcggctgttgatattaatgatatataatctttttctcgaaatatatttgagctaagtgattgggatagatcgaacagaaagtcgagacagtataaatcacttatacttaaaagtactttaagatgaagattatatatacatttatagcatagccgatcaaatagatctaacatgtatcggctaatactccgataccacttcatattaagatattaaaacagacaaaatatatcaaacaacaagcctaatatactttaatgcaacaagatcttaatataaagtgtagatttagcatatcaggtaagcatatagggaataaagtagctaaatcaggtaaaatcggctaaaaccccgatactatctctattgatgatcataaaacaagctagatattgtagttatgaatattacttaatagatcgaacccaaccgatgcagcaataagcataagaataaataaagatctaggcaagatgatgaaaacttctaaaagatggtagatatgctaactctatcggctactctccaaagataagtatcaaccgattgcaggttaggttgtgaaactgataaagattataaagcatatatgataacttgacgatttacataaacaagattagagtatcataaagatagaagcactaatccctcagaacgcaagccatcatga

SEQ ID NO: 59466 - DNA, 1474 bp, Oryza sativa
ccattaatgagtagcatgagagtaatcacgaaaaacattgcccaactcgcccataaccgcgggcgcggctattcgaatagttttactctgatcagaggtgtaccactgtacccacaagacacaatcccacatgtcaccatgcgcctcagcaccaccacggtacctcagaaaggaactgtgacattacccctcgcacaacacaactcaccacagtgcaccgttcctggatcataatctccccctcaaaaccagaggcaatggactccccagcgacccccacggacttctcgccgcttcacagtctggcacaccataatgaatcatgctatacaaaagataaagccattgcccacgctggcttgtgattggcacggtaaatgtttcacaacagtagctcgcgaaccggtccttaattgtcatgagcacaaccatcaaaatcatatgctcacaacccacctttaaccaggtttttattatcaattaattaactttacatgattaaccatcgtgagctaccattaaatataagcataaataattatgtagtatatatgatccatcccattaattagctaatgtttctaagcatggctaagcaactatacttatagcatttagctgaaccaatccaatatataaggtccaagctaatcaaattataacctataggaaaataaagtcatcttcggccattaattatctaggaaaggctcaccactcgatgacattcgaaaataatgcataagttgaaataaaacattagctttaaacgggttcaacatgctcaaagggttgtttgggatctgtgtgacttgccttgagcttccacaaacacttccgaaccttcttcaacgaaagcgctctcctccggaacgtcggaaactaaagcaaactaacaaaatcaacaaaacagtacaaaaactagcataaacagtacatgtggatatttttaacatgtagatctcagttttagaaaaatttagcaacttgaaccactcgaatcggagttacgatgaattagttatgaatttccgaagtttaattgatttgcatctaataaagaaaaactaaaaggaaaagattatgacgtcatgctgacgtaatcctcgccggcttgacacgggcgatgacctcgccggcgcttggaggctcggccggactattggagggcacctacgcgtagaggacaacattgcgaactcaccggtactaacaaacgcgacggatgacgacggatggcggccggcggcgagcttgagcggcggcacagttcggtcgacggcggcggtggctctccgtgtcgagtcccaaaacaactctcaaatacatcctcgaaattatgcatagaataagtaaaaatccatgtgaaagcgtgcccacaattagactgggcaaagttaaaagtcgaatacggcttggaggatttttgtagatttcataaaagcctaaaatgagtacataaattttagtggaa

SEQ ID NO: 59467 - DNA, 9986 bp, Oryza sativa
caagccgatcgtgttcgccgcctgtgtttcatcaagagtgcgtcgtagccccgtcgtcgtctttgtcctcggctccgcatcatcaagccctgtgtcggccgtgtctcgcctccgtccaaggatcgccaccgaagtcgtcccctcgccgttcgtctccgtcgtccccaagccgccaccgccgtgcccgttcatcgtcgttgttcccatgcctcgtcgcgtggtggtaaggatccgtcctctcgctgcccccgtcctcgtcctttcagtgtcgcccgtgcccgttgtgcgattgtcgaccccggtacccgtgtatcggtgtcggtagtcgttcgcatgtgcgtgtggtgaccatgttagtgtgcccgctcggtagctgtgtggtttccacatgtgaagcccgcgtggtgtctagtggagtccgtttgtcggccactcacctcggttgacacacggggtctgtttctgtcgacctgtggactgtctctgtgtactcggtataccgtggtcctttaggttgacgtgtggggtacgcttgtcaacagcgtagccttcctgtcttttccaggctagcgcttacacatgttttataattgcaaaacctaattataataatccacaaatcttcatataacagcattaaacttcggatgaccagatcttggtcatacgaactctgaatcgacccgttcaagtctcttaatgtttgttataacctaaagaaccatgtgctttctttttatgtattgttattgcttctttataggcttgtagctttacttgtgtgcttcgcgtagctttggtcgttccggaggttcccgaagcgtggttcgcagtcgtcgccgaaggttcgcaaggctgttctatctgagcaaggcaaatcgcatcacccttgagcatattgaatcctagtttgtaaaactattttgatttaaattattgtattaccgctttatttaagttcccacgttatcactgttttatttagcacttcctattaatccttgttatagtcttttcattgttattgtttattattaccttgttcaccctaggaaaatgataccgcaactagtgggtaatctattaatggttccattagtatgaatttaggtagatacttcgctgattaattaggcaacactagatggttttataacaatagactttgggagttctcatagcatttggacactatggaatggttggcttttggtggaattggacacacacctctcttcctctttcaaaacccctaaaacctattttccggtggggtttgggtgcatgtcagttgtgggaagtagtaccccggccaatacaaggattaagctcgggcctctgttgcaaagcactaccgtactaaccacatgtctaatgggtaaggcttaactcgatgctcagtctagtcctgaacaaaaggacacggatagagatggttgaagtcgttgcgacgatggatatctctgaggcaaatgaaggctacacgaactgcgtctcggtaattgagatgtctaggcaaatgaaggctacatgggccggtgtccattagttgagatgccatggcacaggactagtacgcgggtggtctcacccctatgtgtgtggcgcacctggtctagatcctgttgctaggggctcaatcctggcctgcctgtccgggataccggctgtaggcagggttgggtcagtacttttgttcacgactaggatgggtgaagggttatgtcacatgtttacgacgggttccaaggccatggaatgcggagtaaagatgtgtcttgtgggtaaagatgtacacctctgattagagtaaatctattcgaatagccgcgccctcggttatgggcaagcctatcaatgtacccaagttagtggtttaattcttaaaacttgcttaacaactaaaatgtagaatggttggcctgggttggcttgggatgagctgggacccaggtcggattgccagttcggtctgaatcatcgtaggccttgggttaagacaggttcgtgtgggttcacggccttgattaataatatagtgttttactgcaaaacctaacactatattatcactccttgtacccccttgcattaatcatgcatcttccggtgtgacttgctgagtactgtggttgtactcattcttgctctatctttcccccccttcagtaagagaagctttggagaagaagtcctaggtagagtcctggcttataccccagttgagcgcctgtgaagatggagccgtagacccgctagtccgatgctttttatttttgattgtcaggcctgaagcgcctttgtaattgttgacggtcgttattgattagtttcgaccgtcaatattaccaaaatagaggagaactagtgatgcttgcaatgcataaatatgttagaataataatattccactagtattgggtttactaaccttttgcagagaatgacaataaaatgaaggagaatcgacatcaacttaaatgataaatcaatcgaacgatgtcgaagtccagacttatgtatgaatgggccaagaactcagaattgacacgacgaatcagaccaaaattcacaagtctacaaagtaaagcagcagaggaggccaccagcgaaaatgtgggctggttgggctggccccaggttcggccgaacctggtggttcggccaaacctcccgtgaagccgatggatgcagggttttgagggaacggtggagattcacaacctatggcggttgaagggtattaccgacctttccaaccgccataaccgtcattacctgcctatttaagaagctcactctcttcacttcaacacacacctcaagcaagagctctctcattcctctcaagtttagtttagtagtatctagctggtggaatagaattagaataggaatcaggagtccgaaagcctttagaagagtttgggtatggctctagtagcttccctttcctcttttgtaagctttgtacttttattagaaaactcttctaaatacatttatggtattggaatactttccaagtatatgagtacctactttacattatgttcatgttatactgagtatactgctagcttatctgggagatgctttggtgcgggtatagtgtttgcttatgcaattactctatgtcatgacaatgatattagagtagtatctagtagtttagacgtggtgtctagattacgggatatcattatttggggttatatattgcggatgagaggttggccgctgatggtgacagctcagtaagggtattcctccgcgcctatatataatcctaagttaatttccatgggagggtattcctccgtatttagctccggttggatggtcatgacgggctgtcgtaaggaactcggcagtcaggggtggcttcttgaagtaccaggagggcatcggatagagggtattagctagtataccagttaactagaatgtatgtatactatgtatattagaggtataggaatagattctctttctcttttctttccacctagcttagattaattattatgagcatgagtagtaatgcttgtgtgtcactctacccttggattatcttaacccctgcttataatacgattatcacaagtaatatataagttattagttgagttctctctacgtgatcttcccatgggataaaataaatacgataccctttgaatactctcggatgaagtgctacaatggtatatccgtgcgcttgcagatgaactctataaccataatataccagaagtatttctgcgtcattactggaaattatatttctagtaatgtcgttaagaaataccagcaagcatttctagcgccgttgccggggaagattcatgatagagattacttgaactaatactttatatttacctctgtataatcattttcctttgcaggcttatcttggttgttttcactctttcttgtgaaaataactggtagtgcattttcctctgtataatcattttcctttccgttggtagtgcatgactggttccaacctgccggaaaacttcaaagaaaatccataagttttcttccggagcatcaggccgcgagtcattgcttcgcagaaaactttaccgacagagaaaccagccgtaccagcgccaccaagactcttcgcgagttcgctgctccctctgctgacaatgtggccatcgggccacaagtcaacataggagatgtggatttcgatttgaagtccagcctcatcacgatggcgcaggctagcccgtcctcatcatgggatggatgactgtctgatcctacagaacttttacaatgggctcaccctgatgtcccgcgatcacctggacgcggcatctggatgagccttcttctctaaaacggttcaaggagccgttgaactcatagagaagatggtctccaatatgggttggagcgaggaacgactccagacccgtcagcgaagcatgcacaccgttaaggagacagagttacttgctgccaagctggacctcctcatgaaatgattggacgaccatgagaaacggccacaaggcaccgtcaaggccttggactctcacatcacgtgtgaagtctgcggcggcacgggtcattctgggaacgactgcccggaaatccgtgaggaggcgatgtacatgggcaacaacaacaatgggtatcgtccacaaggaggtcaggagtggaaccaaccacgcccatattatcaaggaggtaataataacagtaacttctttaaccaaccctccttgaaggatcttctttttgtgcaagctaaaccactgatgcactaagcaaaaagcttgctgccaatgataagatcttagagaacataaatgttaagctagatggctttgcttccgcatttcaaaactagctgagctttaataagatgatcgaaacccagttagctccgttggcatctttagtccctacaaatgaatctgggaggattccggggcaacccgactcctccattgaaaatgttaaggcgatcacaacgaggggaggtaagtccactcgtgatctgccatatcctaagcctgtaggaactaatgggatgtcaaaagaagcgccatctattgactcgttttgttgaagtaatccaaaagattcacatcaatgttgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcaggcctgacaaacaaaaataaacagcagcggactagcgggcctacggctccatcttcacaggtgctcaactagggtataagccaggacttcacctaagacttcttctccaaagcttctcttactgaaggggggaaagattgagcaagaatgagtacaacccccgtactcagcaagccacatcggcagatgcatgattaatgcaaggggggtacaaggggataataataggggttaggttttgctgtaaacagcatttaaatgtcacttagttgcccaaagctattttgtaaacacgatccaagagctacacaatattattaaccaaggccgtgaacccatacgaacctgccttaacccaaggcttacgatgattcagaccgaactggcaacccgacctgggtcccagcttgtcccaagccaacccaggccaacctttccacattttagttgttaagaaaattttaataattaaaccactaacttgggtacattgctaggcttgcccatatccgagggctcggctattcgaatagatttactctgatcagaggtgtacatctttacccacaagatacatctttactccgcattccatggccttggaacccgtcgtaaacatgtgacataacccttcacccatcctagccgtgaacaaaagtaccgacccaaccctacctatggccggtatcccgggacaggcaggccaggattgagcccctagcaacaagatctagaccgggtgcgccacacacatagcggtgagaccacccgcgtactagtccagtgccatggcatctcgactaacgggcaccgacccgtgtagtcttcatttgcctagacatctcgattaccgagccgcagctcgcgtagccttcatttgcctcatagatatccattgtcgcaacgacttcatccatctctatccgtgtccttttgttccagactagactgagcaccgagttaagccttacccattagacatgtggttagtatggtagtgctttgcaacagaggcccgaagaccggtccttatagtggccgaggtgctactagcaaaaccctgcacctcgagcccagcctaaaaccattttgggagttttgaatagaggggggaggtgtgtgttcaattccatcacaagccaaccattccacagtgtccaaatgatatgagcatccccaaagtctaaagtaataaaaccacctaatgttgcctaattattttgcgagcatctacctaaattcatactagtggaaccatgaatagattacccactagttggggttttattttcctagggtgaacaaggtaataataaacaatagcaataataataaggtcataacaaaggtaaataggcatggctaaataaaacagtgataacacaggaatttaaataaagcgataatgcattaatttaaatcaaaataattttataaactaggattcaatatgctcaaggatgatgtgacttgccttgctcagagagaacggccttccgaacgctcggcgacgaccgcaaaccacgcttcgggaacctccggaacgacagaagctacgcgaagcacacaagcaaagctacaagcctataaaaaagcaataacaatacataaaaagaaagcacagggttcttaaggttataacaaacattaggagacttgaacgggtcgattcagagttcgtatgaccaagatatgatcatccgaagtttaatgcttttatatgaagatttacggattattgtgattaggtttcgcaattataaaacatgtgtaagtgctaacctggaaaaaacaggaaggctgcgcttgttgacatgtagactccacatgtcaacctaagggaccacggtggaccgggtacacagagacggtccgcgggtcgacggaagcggaccccgtgtgtcaaccgaggcgagtagccaacaaacggactccaccagacaccacgcgggctgcacacgtggaaaccacgtggctaccgagcgggcacactaacatgatctccacacgcacaagcgaacgactaccgacaccggtacatgggtaccggggtcgacagccgcacaacgggtacggggcgacaccgaaaggacgaggatgagggcgacgagggagagatccttaccaccacgcgatgaggcgtgggaatgacaaagacaaacgagcgcggcggagacgactcgcggacgacggaggcgaacggcgagggaacaacttcggcggtgatccttggacgaaggcgagacgcggccggcgcagggcttgacgacgcggaggcgaggacgaagacgacgacggggctgcagcggcatacttaacggatgcggacgacggacgagaacgacttgacggagggacgaacgccacgacgaccgggaacgacgagaggacgacaacgatgacgaccggggccggcgaggagacgatgatggcagccgcggcagctgcacagaggtgaggccggcgtgggacacgccgcagcgatgcccatgacggtggcggcacaacgagacgaggagccggcgaggaggagcggccgaccgaagggacgtcggtgacgacgaggatggagaggaggcgatgccgaggacgacgtcaccagttcgccgctgcgatgcccgaggtggtggtggcgcggccgacggcgcacgggtagaggaagggccaaccggggaaattccggcgaagtggatggagaggccggcacggcacggcggtgttccggcgaaaccgaggagtggccggggaaggagacgatgccgcggtatcgaaggaggagacgaaggcgtcgatcggcgtatcggtgatgaacaggagccggccggagacggtgtagtggtggcgacgccactgaacgccggcgagaacgcgcctccggtgctctccgcgctaaacggaggacggcccgggggagaggaggcggctgcgaggctgctggtggcgacggcgcgaccggatggcgctccggcgaggtgggagaggcggctggaggcggccggcggcacaggagagagaggaggacggcggggagaggtggtgaggccacgggagagcgcgggagggggctaaaatgatagaacggagtgagggggttccattgtataggatggtggagggagccgggcatgggagaaggcggaacggccacgggaaacacgggcggcggccatggaaggcggccgggaatggcgcggccgttccgagcgttagagggcacgaatcaagggggaaattggggggaatcaaagaggaatcaatggggattaattccccctatttaattttggaatcccatgagtaaatcgcacagatttgagggaggaaaggagctagggttcacgggagagagaggaaggaggccgggcgggagcaggacgacaacccggcgcgtgggacccatgcggggcgcgcggtcagcgcgcgtgagggggggcggctcaggaggctggggcggctgggtggggcagcttgggccgggaggcggcccaggcgggaggggaggaaaagggaatgggccgggaggggaaggggaggcccaagagaaggagggagagaaggagagggagagaaagagagggaggaagagaggacttggtccgcgggccgagggagagagagagagggggcccaaaggaggaaggaggattatttttaggtttttctttttaataaactttgataattgttgttgttgcttaataaatatttccggtgctctgaaaattcaagtaaaatttgagggctcattttagaccaaggagaatttaacaaaaattctccgggcgacattcgaatttttcttgtacgtattttagtgtttgccaatttcttttcgaattttaattaattctattattccttttagaaaatgatttttgtttcgggatgaatttctcaggacgtgacaaaaccaccccccttacaggaatctcgtccccgagattcgaggaggctaacaagaagattggttgggcggtcttctcttcttgtctgacttctttcgtcgcgtcttttataacaaacttgcctagcaaaacttccccactctgaactgcttggcttgatctcctgttgcagatggaatcttcttttcacctgacttgtccttggttgcaccttgagctaacttcgactgggatgcggtacttgaagacagggcttcagttccagaacttctcataattcatatctttggcgtcaacctcatacaagttacccacttcacgttatgcaccgatatcagcttgtcattactaggataccatgcttgccatcgggagaataccacgcttggcgtttccttccagcttaccaccatatgctttagactatgatatcccgcttactaagaataccatgattgacaagttgccactaactgtctcatattagctttcctggtctccggttctagatatttcctctattcaatgtgagggtcgataactttgcctttgaattatgtttcccaagggaaccaacttatcccacttgacatgctttgacgtcttcccaaatgactttactgctgaacttgttattgtctgatcgttatcctgccaaatctgaagcttcgttgttggatgtgattttaatctgacctctgtagattttccttgaacatatcacttgtttcataactgggaatggctctcacgaacaagcaactcggattcactttctttacattcggtttactttccactattct

SEQ ID NO: 59468 - DNA, 30328 bp, Oryza sativa
aattgcggaataaattttacctttccaatagcattgctgaactttgcaaaagcttcaacttgcaagaattctggcaatacctgtacaattcatgattgtcaatagtatacgcaaattttaccatgatgaagtggtttagtgagtgcttacttcaggacttgcggcagcatagcttgataacctgtccatgagttgagacagcacggttttgatatcaacatttggctgccacaaaatagtaatgagtgagtaacaatcgcagtgaaaattggacagaaaattacatcccgattcttatatatcaaaatatacactgagttgtattaatttattctacggttgtggatttttgtgttaaatgcagcttaaactacagatcatgacagaacaaaatgtactacatgtacatgataaagccttttgcaaaattatgtgtcaagttcactagtcgcattttacaacaaagtagcaagtgaacaactgacacggtcaaagaccctatgtaaagctactagcatgcgcagattaaaagtgaatctgactcgcttgagttgattccctgattgagttgtattttgagacagatggagtagttaatagaacatcaggcagtgcaaatcaaattgatcaagcagacaaagacataaggatgacttggtagttaactcatttggttgacacaatcaactaaatatgtcacattataatcatccacatcagtgtttaatttctaacatgcaacgatatgcagagaacaatcaagttaaaataacataaacatgccaacctgtagttgcggaaatgcgctcaacaatgtttccaatgtctgtaaatggtattcgtctggaaagacttgtattatgcagtccatcaggtagaattgtgcaagttcatccttacaattaaccacctgccaatatatttcttcttcagcttccagtagaatcatggatcattttataatttgtcaacaaatctaattgcagacctgttctaatatccttggaaggacagtttctttgtacatgtcaaggtcaacaccctcaatctggcttagaacgtgaaggtttttgcctacctagaaaaaagaaagaacagtagcaatgtcattgaaatgacaccaaagaacatgtagtgtagggaatacatgtaattgatgattaccaaatcacgcagttcatttctttcttttccccgcttctccttctctcgaacagggccctgcaaaccataatcatcaaggccggtttaagttattatctggttagataatcttgagcttcctagaggtgacatctgtgataaaagcttgtattcatgaacagcatgggaaacaatgtatgcatgcgcagaaacctaaggcggtaaatgcatggtaggggaaagtatcgcagcacttgtactcagacttcagcttgaaaagaaaaaaaaaagcttcaagttgcaagctgaatcaaacctgatgttgcattcggacccagagtttgttcatttctatgaaattctgaagaacaaactcaactgcgacgttaatgctgtcagcatccctgtgtgatgaaagttgcaaaaggcaggtataaagaaacaattaggtactgtaaaagagaagaacataaatgtgaagtagcatatactttcaggacaaaacacttttgcgctctgcatgtcctaactcccagatataataaagtgaattgaacttcatgttgcctctagtgtactgatacatgatcaagcagcgctactggcaaagtggcaatagttaagacttccaatatacagttggtcctaaataaggattggtaaattatatatgagatagatagagcagcgatgacaaataaatgaattaatgcacaggaagtcacagaatcaatgcctacaccatagcatgcacgattcaaaacgaagagcaagggaactacgtacttaacattaatttgtctatcagttccctttcatttggattttgtgattacagcctgttcaaaaggtactatatgaatgccaaattaatgttgtagaataagacaacattttacatacatatgaaacattagtttatcttcagttactgaacatttaaacagcatggcatggagtgcattacccttcatactcggaaccaatatctggcagtttgtctcggcttatctgagataggtagcttcttaggaaaagcccacgaagaggatgttggatgcctcgacacatttcaacaaggtctttaagaacgtctttcgcaggagcctcttttgatttaatgtacacagatcctactgtgcagaggagatagctaggacatgaacaacaccaaatcaggttcataccataacagttcttcagcaatttcaaatgagtcaaaatcacatcccattgtacatgcaagcatgattaaccgttggcctcacattcaggtgtgacaagtgtattcaagttggtcacagtaaaatcaccagggatcagtgttctaaagtcagtgctaggcaccgggtagtcatcgtgattaggcattagatggtgcatttaggtggctaacctaccttgggtggtgttttgttgctattttagtgttatattgtctgaatttaagtaatatacttactaatttcttgggtttgactagttggtttgacctaggcgccagcccttccaactctctagcaccttcttgaaccatgtcggcaattgaatgatatggcttatataatgtctactggtatgagcactgatagtcaagcaataagactaattaagttcagttgtaccaagtaaatatacagtagttcaaacttcaaactagtcttttcaacaaagttaaagttactcgaaagttaaactatcgaagtaccaagttctgccattgatctagtagctacaagttattactagatcgtatagagttgtaatgatctacaggactgcaatacccaccacaaattcggctccagaaacctcacagagcaagtaaaacagagctaacagcacataattacacaaagttaacagctgtttatgcctgacaaggggtgcattagtcttacagtctgggcagtacgttgccagcatgctgcacaagctcatacaaatcaacaacggagcagctgccacgacgggtctcctccctgaagaacatctccagcttccgcatctcatcaaacgccctcatatctgcagcaaaatcaataaacccccatcaaatcccagctgaaaccacagccaaaattgggcgcactgaggaatcctgacacataagaaacactcacatagatcataatacttgtgcggcgagagccgcgaggtccgcagctcggagagcatctgcgccgagtacttgagcgcatccttgaggttgttcgaatcctgcgcacgaattgccgatcggggcagatgataagcgagagggggcagtcacagaccgagggagctagggtttggcgggccttacgagggcgcggtgcatgtagaaggcgttctgctggacgccggcgatgccctcggcgagccaccgctcctcgtcgtcggcgccgccatccggcagcatcctgaccgccgccgtggccgccgtcttcgctggctgcgggggtggatctggtcggcctctggtggctcgggttggggttggggttggatctcgcctctcgcgcgtgggcttgtcccctctcgggtttggatcggggcgagtgtttgtgttcttcgagtgtttttttatgatcggttttttcctcttttttttctgttttccgaagtggttcgatgattcgatctggatcagatgagttgacggccgaactgggtctggggtgggctgacttgtcggtaaaggccctgttagtttcaaaaactttttcccaaaatatcacatcgaatctttggacacatgtataaagtattaaatatagatacattaaaaaactaattacacaattaggggggaaatcgtgagacgaatcttttgagcctaattagtccatgattagctataagtgctatagtaactcacatcgtctcgcggtttccaggcgagttatgcaataggcttttcattcgtgtctgaaaactcgttccgacatccggtcaaacgtccgatgtgacactcaaaaatttttcttttcacgaactaaacaggcccaaaaacgaatttaggcctctttagttcccaaataaaatttttcacgctgtcacatcgaaatgtttggacatatgcatggactattaaatatagagaaaaaccaattatataattcgctgggaaattgcgagacgaatcttttaagcctaatgacgccatgatttgacaatgtggtgctacattaaacatttgctaatgacggattaattaggcttgataaattcgtctcagattcctagcggaatctgtaatttattttgttattagactacgtttaatactttaaatgtatgtctgtatatccgatgtgatatgcaggggcaaaaatttttgccaactaaacaggcccttactatctaagtgggtttaaaaatatgaatttactccatctgaaacctgctctattttttttcttctaaaaaagttagctatagccttttatctctactattataaaagttgaagatgtttttatcaatactttggtacgtcctccgtgtatgagtcggtttttaagttcgtttacttttggaaattcaaatatgtatttgagtcgagttttaagtttgttcgcttttggaaatacaggaggagtcgtataagaaatatctttttagaaaaacttgcatgttaacttagatttatcggactcctaattgtagcttatgattttctacaaaataatatatccaagcgatgatcgaactcctaattgcagttcatgattttctagaaaataatatatcaaagcaaattctcacagtaaatttcaccttaactagaccgtataacaataataaaattaaaatagccttcacccgttgcaacgataggcaatttttctagtaacaccaaaacttaatacgatcctttagccgatgagagatttattcttaagagacggagttcaaaaataatttaataacttttttttatctttagaaagttttgtctaatattcaatcaggactagtatttttttcttttatttctataaaacttgtatggtattcgattaggactagtctcaacccgagagtataaatatatacacccagattacacccggagtctttgtaatctatctccacatatcaatacaattgcttttggcccatcgtcacggactagtctcaacccaagagtataaatatgtacacccagattacaccccgagagtataaatatgtacacccagattacaccccgagagtataaatatgtacacccagattacacccggagtctttgtaatctatttccacatatcaatgcaattgctttcggcgcatcgtcacctttattccgacgggactagtatcaacccgatgagttcttagttttaagtttgggttgtatcggttaaattcgatctccggcaagaaaataaattctgtcatgcaaggaagtaaattcatcatcttcgcttgtatcagcgtagttaaaagcccagaactttctcggttaagtccaatattctatagttttgcctatcagagaagacaaaactagtcatttaatacaaattatgcctaactcatctttgaactgaaccagtagtaggggcaagacactgggataacacatcagaataccatcaatgattttgtcacacgatttcattctcatttcttaacaatctcgagtgctaaaatacaccgccatctggagtagtcccaaagggaccatccaagagaattcatgcgtgaaatcgcgttgttgagagaattcatgcgtgaaatcgcgctgttgagacatcacgcatgactacgtagtagtagataaataaccacaggacgagtgttcaaataacggaatatatagaacacctaattattacacttagtgcccatacggatcttattacatcagtgcatcggaaaaaaaaatcttactccatcaatagtatgtctgagacagtccagacaagtaacatggccatcgaggaaatcacgagcttcatagttatatcaaacctaaatgtgagaaaatatatatataagaattaatatggttagttaacaagtactagtaaagattaatggataggattcaagtaatatatgctaagggttatcgcaatcatcgacaagttgcaaaataccactgcgaaatagaatttagcaatggtatctatgaatatgattgcggtaatactttgtattgtcccacttacaatgggtcctctcgcttgatagcttccgattctttaagattctttatcaacgagagtagcttaagcttctcttcatcttgcattctaaacagctcctctccctcctcagtttgccttggtgctcttgaagattcttgcttaggcgagggactctgggcaataaaaaaatatatttgaattaaggtacaacttacaagcaagcagtttcttttttacttttatgagaacaagtaatttcccacgaataaggatcatactccgtgctagcaataagaatcgtaagaagagctcctgtctaattatgtcaagataacacaggaaaacaagatggctagatagacaagaaaatgaactgattatcataatttaacctatcgtgagtacagatgggagcactaattttggttaatctaaaaaagaatcatttatttagatccagtaagagagagaagcatttaccgtgccacgtgactcggaaacactggaagagaagaaacgatacggggtgagcggcggcggcggcggcggcgtcaggtgtttccggcggagaaggccgccatggctaagcaaccttggcgggataaccgtggccgccggctggggctgaatcttgggtagagcgcggaggcccatcctactcttgctcgccagagaccgaagagccgctgccgccatggtcgctggcgaaatcgatctcctctgtctatcgatccctaatcccccctttgtacttctgtgttaaccggaataagactatgagacatcttagagttggacttggacttgggagtcttggacacgaacatgtgggctgtggctgaggccttcacctcaccgtacaaaggaatataagttcactttgactcccagtaactgaatcggattcatatccctctccctctctctttctctccccttcggccttctgcaagaggcagtcagtagtgacggcgggagggtgggcaccggagcggcggcggcggcttgggtggggaatcttggattgctccgcctagaaatttccccagcaaaaatcaaagcaacagagtcaaaatcgaagcagtacaagcaaacagatgaagcagagaagggtcacgtcctcacgtcggtgagccctggaattgaagagcaagcaaatcaaggcagaaggaggcacaccttgagctcaacgttgaggacacagcagagcagatggcagatcgtagaggcgcatctggttgtcgcaacttggttcatggacccctcgacctggaacccagcacaatcaagcaaagcaagccaaaatcagagcgttggccctcgccgcacgccgcaggagagagagagggaggggggaggggctctgccgctcgctgccgtctccgcttgcccaccgccgctctggcccttgccgccgctcgccgccgtcttcgcttgcccgcgccgctccggccctcgtcgcacgccgcgggagaaagagagggaggggctccaccgctcgccgccatctccggttgcccacgccgctctggccctcgccgccacctgcgggagaagggaccggagggagggggagagagataagagagagacggcgccacaatatgcgaatgacattggggtcccacacatattttttttatccacctaggcgtcacggcaacgccatgtgaaacgaagaccaggtcaataacaccagtaaacgccacatcagcgaaaccattctccaaaatcaccaatggagtcaaattgcatcggtattaatatttggggatcgagatatctgatattgtggttgagggatatgaatcaaatttgatcagggagttaaagtgaacttagggcctgttcactttgatgccattttcaaccttacaaaattttggtaaagttatcaaaaaagtggctacatttagtttgctgccaaattttggtaactatataagaaatcctgccaaaattttggtaagttgccaaaattgtggtaaggtttttttggcatcaaagtgaacaggcccttagactgtgttcggatgtctgagttcccaactctaacagtgtgcacggaaaacggagcggtctattagcgcgtgattaattaagtattagctatttttttcaaaaatagatcaatatgattttttaagcaacttacctatagaaactttttataaaaaatgcatcgtttaacagtttgaaaagcgtgcgcgcgaaaaacgagaggagagtgttgggaacttggagttttaacacaaccttattccgccgtacaaaagtggagagggagagaaagaaggtacgcagtagcagctcgcttcctcccctctggttgatcttctacccttcggtcggccgaatcagcaagcgggaaggctggggcttgctcgatcccaaagccctagcctcctcgtcggcagatgcaaaggtttctgggtggattcgtcggcggcgatgcgcgtgaggaggcagtgaggtggatggtggaggcgggggatagatgagcggatgtgggggattgagactctgatgagcagaactgaggtgtggcaacgggcaatcggatccagaacaaaacgggtccaaacccaaatcaagttgcgggcccgataatagttgcacgaatcatggagcgatctacttcctccgtttcacaatgtaagtcattctagcattttacacattcatattgattttagtgaatctagataaatatatatgtctagattcattaatatcaatataaatatgggaaatgctagaataacttacattgtgaaacggagggagtagtggttaggaattcagctgaaaaaacaaaaaaaaatcagcaaggtgttacgtagcaaatccttaaaatttttattaataaattacttttcgtttgcaaatatgttaagccaaacgattgggtccacgaagcgtacattttttcctccccaacatactaggaaggagctttggtttggttcggtttgttattaggaaggagatatttttattattatatatacttccgtcattccatattgaaaaaaaaaaagagggagcgatgatgtggacacactgacatactccattgttaacgaccaaatccctcctcttcccatctctcctcctcctctcttctcccttactcggttactctctctcattcttctttgggcaggccggcccacgggcacgaggcgggagaaagggagggcggccggccggcgatggccgacgcgggagaaggcgagacgatggctcctcctaccgcgggcgcgaggcgggagagagggagggtggccggtggcggccgatgctggggcgacggcggccggtgatggccgacgcgggagaaggggagacgatgggtcctcctaccgcgggcgcgaggcgggagagagggagggcggccggtggcggcgccggccgacgctgggccggcgatggcggccgacgctggggcgaacttcgcaagcagacgcacggccccacacaggcacgactcctcccttgtcgcgaacttcgcaagcagacgcaggcactagcgagcggcagcggcgagtgagcccttgttggcctgttctgctgcccccatcctctgcaacctgcagcttttcttgagcggcacttgtttaagggagtgtttgggaactagggactaaatttaggcctctcataaaaatataaatccctaccataaagacttattcttttataagagggactaaaatttagccccactttagtccctctaaccaaacaccgcctcaatattgtttatgcatcgggtgtcatgtgctaaaacaagctagactgctgttgtgcttctgcaaacaaggaatcgcccaacagtagcaagaaagaatggttggagatgctttgctactgggtttccttccgacactgtagcggagctcaataatgtcagggatttgagctgatgagctttatctctgccctgaatgtttccttttgcagctatggttttggacttttggtgttactgacgtgaacatgttaaatgtatgtttgtggcttggtgaacctgcttaatggctgctataaaaccgttttgttcttttcatttggtgttactgatatgaagctaactgtaactgagtatgatgtacaaatacaagctagcagcctagcaaagcttgatcgatagcaatggcggcgaaggcgatcgactgcccgccagcgccgaggccgacgccggcgtcgacgcccagcaccgggttgtcgtcgtgcccacgcgacgcgctgaagctgcgtgtgtgcgccaacgtgcttggcctcgtcaaggccaaggtcggcgcggtggcgccgtacgagccctgctgctcgctgctcgacggcctcgtcgacctcgacgccgtcgtctgcctctgcacccggccctgcctcctcctccgcgcccagcaccgcggcgcccgcccgcgctgggccgcttcgccgccggcggcgactcagcgccgtcgacgccattcgagaccggccgccgccctcgccttctcccgcgtcacagccgccgccgccgccgcctcctcctctcccgcctcgccccgacagcctcttcccagccgccagccggctttgcccagagaagataagagaagagaagagtgagagagagaaagaggaggaagggagaggaggggagagagagagaggaggtgatgatgtggcatcctgacacatggggtcatgtgttctacgctgacttagctgtcacgcaggataaaaccgggtcaaaaccaccgaataagatattatgatcggttttgattagttaagtgacatcggatatttggttttgctgtttggggatgaatttgtaactcgatgataagttgagggatcttctgtgtactttttccttccatatcattatctaagcaaatagtgtatagagataaaaaaaaacaattaaatcttagtcgttctgaaataatcctcgtcggtccatactgcatgatgatcggagtgccaatggagtcgcgaatgaacgatgtcgtgatagaggaaactacatgccacggacaggtaggactccatcgtttaggttatcgagggaataagcgtaatgacatatttataactagaaaataatttactcttccatatacaccttctatacacctacacctaggtgtatgtattccatttattagtggatgatccattagcattaaattagccatgaaaaagaataaaattattaatttccaaatcaccgcatgcatatggcctagctgcccagcggatttggtgcaaatttgaacaagggcgttggcatgcatttgctttcaaatttgataacgtaccatagttatacccgtttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcctagaccagcaaggcttctggatggcttgcgggcttggacctcagcgccagccataatggcgctgaccgtgggacactcagcgccagcccacaaggcccagaccagcaagcctgctggatggcttgcgggctgggacctcagcgccagccataatggcgctgaccgtgggacactcagcgccaggtgggccttggccgtttcgagccttctggatggcttgcgggctgggacctcagcgccatccataatggcgctgactgtgggaaactcagcgccagcccacctggcgttgaggttggacttggccgtttcggccgtggcccagctcagcaagccttctggatggctgggctgggacctcagcgccaggtgcactggcgctgagtttggacatgtcagcgccatttagcatggcgctgacgtcccagccctgctaaactttagcaaaactttgcacacaacataggcaaacatcaaatcacagaaatttacaggcagtaatatatccagagaaccatacaaaacatacatccatccatcaatcccaacatcattccatacatccatagaatccatcaatacatccatgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggtcggaccactccttcctcgcccccgagggccgaggcgccccgacccctcgcgtttctactccacgtgtatgagttaggtgagcacagcggggctcacctaaccgcatttattgcgccgcggctaagcgtgtcacgccacacgaagtgcagtgcagtgcactcgattatccggtctgtgaccagtcacagaccggtcaaatcgcgggttaggtggcgacaggcggtctgacgcacgcttcgccccgtcccgtcaagacgagagcttctaggcactcgtccccggctggagctagcgtgttacatcccagagatgacacgttagccccgatcaatatatgccaggcttcatcctaaccattacaagcaagatgttgtttgaagaagggcgaacatgcatgttgctaagccaacgcgtggtggacaagaatgaccgatttgtgactggtctgacactgctcatgtcgtcagcacacggccaccttcccacgatgtgcctgtctcaggcagaagtggaggtaggtgtgtgccgtcccgtcaggaggatgttcggaggacgaccgtgcaaatctccgtccatttatgaagagaagaaaagtccagtttggaaagggaaaggggcatgtggtatccccttgaaatataaaaggaggacctggcccatagagaagggggatgatctttttctagattgagaacctagaacgagggttggatcttttacagattcgggacctagaacaagggagaggttggctcacactttgtaactccttcatacacaaatccaccaaaacacaggagtagggtattacgcttctcagcggcccgaacctgtatacatcgttcgtgtttcgtgctctttcgatagctggcaatctttccacatacagagagagcttgggatcatcaccctgagcccccggccgaaccggcaaaggggggcccgtgcggtctcccggtgaggagccccgcgctccgtcaatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcaccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacaagacggtaggtcctgtggagccacgccaagtacaactcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacatcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttcccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatggaaaaatcacaatgagaacggaaaggaggacaacagaaagtaaacattgaagcaacaatatgaacttagcaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgaccggctctgaatttgtattgttcggcttttgtgaccgtcggttggctgagcctttgtatgctttgtccatatcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatatcttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatctatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccaatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctagtcacccgccacctatctcctccactcttccttgcattaatctgccatttgcaatggcgatcgagacaagccacagtatactttactgacgcgttagattccttcacatggtacggccggtggacacggatagaataactctgtagccatattttcagatcatccatcgatcgaaactccaaccccttccttggttcatcacacattggttcgaaggcaccgtcatattgtggatccccatcagcaattgctagcccagatctggtaagatcctcgaattgtgttatttccgggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatcctcaacatctccttcctctcttaccggcacattctcctccacattaacttcctcccttaacggcacattgtcctctgcatgtacttcttcccttaacggcacattctcctctgcatgtacttcctcccttaccgggtcattctcttccctgacctccacatccgccatatcatttactccctcgcccccctccacgtcttcctcaatcaattcttccttcctactacacctctccgacagttcgtgacagctaatgggtgattctatgagtggactttcattaaggtctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacatttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgtggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcaggggttagtttcaaattaagtttttgaaaagggtcaatttgtcaaaaaaacggtagttatactctcttttctagtaagcaacagtatatactgttttttaggccagtatatacactctttgtagtgatgagcagtaatatatatatactagtttttttttgtgtattagcagtacatggtaaggattaccttatatttttgttgtagcagtgtatacttatttttgttagcagtcgtatatacttacttcagaattaactagtatatatactgattatttctttttttaatggtacgtgcagtatatactgttagaacgactgaatgagtagtatatactgatttttcttggaatgagtatatcctgatttttttggaacgagtgagtatatactgaattttttttgggaatgattagagaaatccgattataaacattgtagtatatacttttccccacttagtagtagtagtataaactttactcgttttacttaattagagcagcacatactaattttcttttggttcagtatatactgatttattctccgaaagagtatgtactggtttctttcccaaagtatatatatgaatgtacatatgtactgctttctgcatactctagtagcaatgtagtatatatagtatgttcacatactcttataagtatatactgtttactgtttattggaacagtatgtactgttttgttaccagtatatgctacttattcctttgaacagtaactgttttcttgaattttctggccagtatatactacattagtattgacggagcatatactagtgttttcttaatttggtcagtatatgctgctatacttttgttcggtcactatatactgcatctcatcgctaaaggagataatactgctttcttgtttgctcagtatctgcatatactactctttttttcttcagtatatatatgatgcatatactgcttaaataagtatatacactatttcttagatttagtagtatgtaccactattacttagataaaccatatatagcttttcatgtgtgcagtattatatgctttttcacgagaaaaatttagaagtatgatacaaaattcatctacaaatacaaaaaacaagaggtatatatgagctcatgctcacatgattcaaaatcaactagtcgatcgaaaaataaagaaaaaagaaataagaggtagatatatatattgctaaaaaattcagaatctattcagttctctgggaggttggaacaaatgccttaggtgtcgcctctgatttttggcagatcgatattagctctgaacctgaaatcaaataaccataggacatggtgcagtacgcgtttctaccgggcgttgcggccgtgattcattgactagacaccatcgtcgatcgaggatccgtgtgagcagctgccatcgttggacggtttgcctccaggttacggccggaagcccggaaacctctgccatgattgatacggttcttgtacgcctggctcactgcaaaagggggaaaggatagcagagatttagaagcgatcatgaatcagaatatctggaatcagaatatatatctagcagtcaaacttcaaggattggtaccaacaatgaggaggacgatcggccgatgaaccaccacgccgtcgtcgccggattgccagtagccaccgcgcctcgcgtcgtggccgaatcgccgatggatcgtgccggcgttgcggccgaatcgccgatggatcgcgccatggccgcacgccgccgcgtctgtatcgcgagagatatgtgtcactttagtgagaaaaaaatcggcgatggttagttaaattatccctgaataattatggattaaatcttattcaaaatattaacgggccagtgcagctatacccgttagggggaggttcgatcgggtagatcgctggttgaatggatggacggtagatgggagcaggtgtacttactcccagattcattttctctcactctctctctctctctctatatatatatatatatatatatatatatatatatatatatatatatgttcatgtgtgtgtatgatgaaaactccaatattaactctaaatttaaagttaaaaatttaaattttggcttatacgtgttagtacaagccaaaaagataaggctagtaagcacaccataatctacacagagatctcgtccgtgtcgtcaacggtttgttacttgagctgtaataaataaatatattctacgggagacttttatgtgcttggaatatatgagatccgttgatcacttctatgtgcgtccgaatgactcacacaactgacatcaatgaaaattaatctttgagaaaaaaaagatcaaaacagtaattatttgtaggtttaaatgtttaatccctgtaaattggcgcacctatatactccgactgcagatctaatagaaaatcatatactccctccatatcatattataaaagtctttttgacttttgttcctagtcaaaattatttagatttgactaaatttataaaaaaatttagcaacatctacaataccaaattagttttattaaatataatattgaatatattttgatagtatgtttgtttcgtattgaaaatgttgctatatgtttctctaaattttaagttttaagttttaaccaaatttagagaaacatatagcaacattttcaacattttcgaacttaaaaaaagtttaactgaaagaaaaaattaaagtgacacatggtatgaaaccgagggagtacattctaattaagttcgaaagaggggaaaaaaaactcattgtcgacatattgaagaaaaaaaaagcagctgaaatatcgtttttgacaaatataaatgcagcagcagtagatgcaaatagcaaaagtatacggatgtactgaataagaagatgaattgagctgggaaaattgatgagtatagccactcgtaaaaatccttccttacatgcagatcgtgtaccccatcgatctaaatccctttatgaccacacacaaactgtcatagaaactaaccaaacaacgagatttgacaaccaccaaggcaccaagtgaccagacaatctgctccgagtgacgatcatcgttttctcagttcgagtgataatccagagtctgcggagaagagtaagatcaagcttcaataagcactccagcaagaaaattaagaaccagaacaaaagtttaacacaatgatctaccagtatgaagatctatttgaaatagaatggctatagagcttcaatcatattaaatcgaatgcatgtatattaagctattaaccaacaaaatggtggcataaaaagacaaggaactactttttcccatcctatctagtacttccatagtagctgttgcaatggactcataaacaaaatcaccatatttaacagaataatatggacttcttaccgcccgtacctatttgccatcgattctggacctcatgagggcctccagcaatgttaggcagtaatactccgaccacacatcaggacgagccttgcatttctggaatgcaaccactgaatctgccctaaattgagcagacttagcaagctctgaggcgatctccttctgcatcgcgttggctgctgcttcaatctccagctttacttcagcacgaaacttgatcatatcctgcttgaggttagtctccatcttcttcatcttgtaatgaagagcaaggtggagagtcaagcaagcaagtcctaggagcataacatactttttcctgttccaaaaaatccagtcacatgaactatctacgactaaagttcaaaaggaagaagggggaaagagttgcggacttacataggtgggatgtcctggaacttcgtcttccagcctttgaaagctgcatggagaaccaaagccatatcctgcatttaacagaacattaatgcgcataaacagacctttgtggaaaaataaagcatgtagagcttttcttttaccttgagaatccccatgtcctcgaaggagtttgtaaagaaggcccttcgatatccccttggcgcagacgtagagaaactacagattccagccccaatcgcctaccacggtagaaaataaaagcattttagatgcatgcgggatgcacggccctcagcttgaagaggcagagaaagaagagataattaccctagcattgctgagactagagcatatgtttccggcaaccttcttggtaatagtgtcttcgacctaaaaacacagcagttagaaagagttaacattaggagaagaggagacaaaaggacaagttgcggcacccccagctagttcaaaagcaataatgtgttaccatagtcatcagcagaagcttatgcggattaatacatatggtcttttccttcatgagagagtgatagtactgcaaaaaaaaaaaaaacataacagtgcaatgtcatgaatacagacaactattctttcaaacctcacaagacagtgaaaaaccagatttactggatgagttgaaatccctaaaaccaccaccaccaacacattgacgattttgggggatttcaacctaatctatgagagaggagccaaaaaggaagccaaatttcatttctggatcaaggtaaatggtttcaagcaagtaatacaggaagcatggaacaaggctgtacaaactgatcatccagtaaacaagatgctcaacagcactgcaaaggccctgagaatttgaagcacaacacaatttggccaactacaagcttcggttcatatagaggctagctaggccttgcacaacaaacaagattgctgagtcctgaagaaaaggtatatatacaggaaatatttaaaagccaggaccctagtactagtagcagtgcccagggcaatgaaaaagcaatcaacaagaatttcatggctcaaacaggggacgcaaacacatagattttccacacaagagctacagccaggcctaggaagaaccacataaagcacaatgggagacagtattagtatacacatggcaagacacagcaagacaagtcaaaaagctattgacgatcactttcaacagattttggggagaaggtttacagatcatgcacaataaacgatcactttcaatagattttggggagaaggtttacagatcatgcacaataaataagttgggacctgattcacatgagatgagcagactccaaacaacagacaacaaacatggatgaggttttcggcgatattgtgacaatgtgaccaaacaatcaaatgatttcatattaggttctcaccctcgtggatccaggaagaaggaagcggtggaacatggcaaagttcaaaggcggagaagggcagaacagctgcacaaacaagagaaactcgtaaagtgagagaaaccgagatggggaagacggatcgagacatgcaacgcgagatccggcgccacgcgtgcacctcggaacccctcctcttcccggctgtcgcgatcaccttcacaaacacaagaggaggaacagaataagtgagaagagaccgagacgggggcggcggtcgtgatcagcttcacaaacacaagaggaggaacaaaataagtgagagagaccgagacggggagagataataaacctcggagcccgcagccatcttgagcaccttcttcgccgccgccgccgccgccttcgccatggtgagctctcacgacggaatcgaggccttggacttgggagagagagacgaagtgtggacttgggcgagagagagagacgaagtggaggggtgtttggtgatgcggattaaaccccagttctacttgagtcacccgaacccaagtacccaacccaaccccatcgcggcgtctggattttttttacttttaggtcccttttgaaaacctattttataaataaaccttttaaaaaacttatcctaagaatgttacccttttcgcggcccaacgggaagggtcaattcttgaaataagtattttagggatctatttgaaaaataatttttcagaaaggtctaaaatgtaaaaaaatccggtctcctcgcctctctttccaacccactcactctccttcttcctcctctaaaccctaaaaccacacggttcctgctccctcacccatcggaagcggcggcggcggcggtggtgggcatgggcgccttggcggcggcgacgtcgtcggcgatctggctcgtcgaggacgacatcctcctcaagaacgccgtcgaggtagacgatccccccctcccctctctcgccccggtcccttacaattcggggcggctcgaagtctgttcgtctcgccgcgtcgcttaggttaggcttcgattggagagttcgggcttcgttcttaagttgtttatggcggaggtcgacggagccatttttctttctttaaattttttgtcatgatagtcaggtcgtcagggtttaacactttaaccctcggccttgcgaaattgctcagctgttagtccgtatctaatttgggtggttattccctgtgcggagtcctgaacaccgttgtactgaatcgctttgttggggaatcaaaatcttgaagcagcatagggatttgttttcatagcagttcagtggctctgctatcatctagccaagaatttaatgtggcgcgtgtgcaaccgggtcaggtttgcaggacacacaccaccgggtgcaatttctattgaccccacacagagaccagtcgcttgacattttgcttgggagaaatttgcatactcagtgtctgcaggtagatcctatgtggtggaggaaataataatgagtgttatattcctctgcaagagtttttgaccgttttatttgaatttattttcaataaataaagcaaattgtttaggtcttgtatgcacctaccatggtgtgattgatctatagtttttgtacaagactgccctgattaatctatttaatcccatgcgttggtacctgtaattatatgaacacattccatatagtgccatgccaaattctgtgattaactagctttgcaactcaagacaatgaatactgttttatcttacatggcaacttgaccttgtaatcatagtaagtgggcttatcatattaacattattatgcctatctatgaagtatgcgagatatttagtactccaatcctgagttagtcatgttgaatactagggatttgttcaggaaaatttgatctgaagttagttaatctccagtctgcagggtcaggcaaaccttatctgtgagacattcttcatataagttttaagtgtctagctgcatattcgttctgaattctgatgttgtgaatggttccccatctcttcctaactgattgttatgatacttgtagactggtgcctcattggaggccttggcaaaaggagccgtatgtttctcccgtaaattcactcttaaagaaatacaggatcgttggaattctctgctatatgacccagagatctcaacacaagcttctgctcgtatggttgagtatgagaatgatctttccacttccaatcctctgaaggctaaagttatcaacgcaaagcaaaaggatttgtcattccagaaacggaaaatagatagtgtgaagaatcaatattatgcgatgagaaagagagtccgcaatgaaccatgtagtactgtcgaccttggttttcttattgacccttgttcatgtacaatgaatggcgggcagtgtgtatgtggaggcctagataaacattcacaaggtcaccatgtggttcataatacagaaccaggggtaagtacaatgaactgctttgggcaacaggatggaagttacaatggtggacaaactatgtttgttggaatgaatggacattctttccctgcaaagcatgctgagactgatagcatggttaaaggtggagatattgctaatagtgtcccgtatggctattctgatgtaagtcaaatatatgagcaagatgcatacacgcgaaaggaccctgatactaatgaagggaacaatgtttctttaaagggtataacagattttcagggttccatgcagttccagaatctgggctctagcaatcaatgtggcagcaaagtaacagaatcaaagacaatagtgattgctgatcactgtggagttgaacatgtccatttccctgtgaacagcagttcaagaatgcaagaacctggctcactccaggtgattggccaaccagagggttctcaaacaccagttggttcaatctggactgaggttgacgaaagaggcacatttactcttgacgatgataagaaaataaagacagacaacagtgaccctctagcattgcaaccaaatttagatggtgggatttgtgcagctggtttagatcatgcagccataacagaaggtgatttcatggattttccctatttcagcaacagtgaagatttagatctcctgaatggtgaaaactttttgaatattccacatgagacaaatcaggaggatttagatgatcctgatcatgtgaaaaatctgttgcatcctgatgaggccaacatttgctatgatcagacagatcctgatcatgtgaagcataatgtagatgtttctgggataatctcggttcctacttcattggaagtgccttatcctggtcggtttgttgaatgtgtgttgaacacagaagatcctgaaattccttgcaatgacgatgttatttttcctggcgagtctcctctacaatgctctgctactgattttggccagaactctgagcacaatacctgtttggtttcccctgcaactagccctgcatcaaatgtcgaacattccaatgtgagtgacaaagccctaataaagagggaagatatgacaaatactgaaccttcttcacaaccaatgaatctcagcccacccacctcagaacaaaaagaaggttcaacagcacctagtaaaggctgtgtcccactaggagctgaaccatcagaaggtccttcaactgctggtacactcgtgcattgtcacgttgacactaatgatgcaaactcatgtgcgtcaaatttaccctctatcagtgctgctgtatttgctgaaggatcaccttgccatttagaacagcagaataactttgatgactcactgagttttcctttgcccaattcagttgaagtgcccgatcacatgaattacaactcacatgataatcaaccagaattagaagatggggctcctctacagaactgcattccaccacatgaattgccagatttgggtcttcaagaccccattacaactgttcctgtatcaaatcaagtagaagaatgctctgacaatgaaaatgatgttccaaactactatgatctagaagctttggtatgtcccttagcttagctacttaaaagaattgattgttcttctgatttatccctttttgttattcattgcagatacttgatcaagatttaatcccatgggttcaggactctgagcagcatccaggaggtaaatatctccttttatcaaatcagtgtgaaaatttttttggtataagactctaccaacacatgcaaatatttgatattaaagatgtgtgttttaagcttagcatgagtaacgtactaatattatgatagagttgtggaaggaagtactgtgctcaattgttagcgcccttatcacgataatactatgtgtgaaactgaaatattgaccactttattggaataatttacagtcgagtggtagtgcttagtgttagcctcgaaggagactgaccatgataagagtatggagtatgaaatgttgattggctgtgaggcttaaggggtatatattctattcagaatagctgaatgcccgtgctttgctatggataaaatatatttttcatgaagtgtgctacccattgtttgctataggaaatattcatcttattttaattttatatgttgctatccattttgatttgattgtttttaatgttaagaagctcaaggagtgatttgcaaaatttacaatgcgagtacttga

SEQ ID NO: 59469 - DNA, 761 bp, Oryza sativa
aagtgtgtgcatgtgctgcctcatgcccatcagcacctgtgcatgcgtgtgtgtggagaggcagcatacgcaaaacgccgactggctagctactcctcccgctcctgcgtttgcagcagcagcgtttgcactgtactactactactggctggcttagctgctccgaccaggtaaacagtaactatatcgggcaaaatctttcccggccatttctggtgttgtagtagtaatttctaacgccaagccagcaaaagaagaaaaagaaaaagaaaaaaatcattgctctagctccatctccatatactacgtgtggcctactgggttgtgtggtctgtagatgatcggcgatcggtgtgtgaggctacggagatgcatggcgcagggtggggcgtgttatcggccgcgggtcgcgacggcaacctcgtattggtcccccgtccccggggcgacaaccccgcggagcacgtattcgtgccgtcgtcctgcgtgcccacaccttgcctccccatccgccaccgctcgcccggatctaccgtccctccacgtcgcaaaaaccgggaccgaacctagctatagccagtagccgatcgaggggcctatctatattttgtcaaacatttttttgaagatgtaaatacaatactccctccgttccataatataaaggattttaagtttttcttacaatattgaccagtcgccttattcaaaaaatgttagaattgttatttttttttgacttactttattatccaaagtat

SEQ ID NO: 59470 - DNA, 4706 bp, Oryza sativa
ccgtccgcgcccggcgcgcgccgctggtggtgatcgacgggcaccagaacgtgccggccaacagcgaggccgcgctcgccaaggccgtcgccaaccagcccgtctccgtcgccatcgacgccggcgaccagtccttccagttctactccgacggcgtcttcgccggcgactgcggcaccgacctcgaccacggcgttcgcggtggtcggctacggcgagaccaacgacggcacggagtactggatcgtcaagaactcgtggggcacagcctggggcgagggcggctacatccggatgcagcgcgactccggctacgacggcggcctctgcggcatcgccatggaagcctcctaccccgtcaagttctcgccaaatcgtgtcacgccaaggcgcgcccttggcgccaaggaaacccagtgatcgagccggcgccatctccgccgtacacgtgcccgcctacgagcctggatcaacggctctggtcgcgtctcctcctccagcttgcaaaatggtgctattattgttgctgctctttgttaattgccttgtgtttatgtaattcgtgtgaggcgatcagggaaaagaattacctgaaatcgtctaagttactagtgttatttcgtgtgtgctaaataagttttagatgtgaggtgaggtcgatctatcatgtaatgtactgaacttatatgtggtgttcttcgtggcaccgggaaatatatataagaaggttgttgttatgactaaggttatgccaaatttcatccaaaaaagactaaggttatgccaaatttcatccaaaaaaaagttatctcaattgcttcagtttttagcttgtctcgctgggcgttcctatgacttatgtgagttacgactcgtgggattcgcaaccaaaatcgaagacgagagctttgcaaccggagaggaattcggcctatttggtattttggtctagctagctctgcaattcgagtgagataacaaaacggcctacatgtggtgggctgggctctgggtaagtgctgcttgacttgtgaatagctatgtgggctgacgacaagtggactacgcactttgacagaaataaaaatggaaaaagtccaatctggctcctaattataggtcgaatcaatttttcctgaccacttaaggtgcacacgtcttttttttcatcaaagagaaccgtcctcaaaacagtaagttgttttgtatgactttaatagtttgaggagtcattataaccggttttacagttgaaagataaaaaaagatccgatctatatttgaggtgtcgaattggatctatttttttattaaataaaaggaaaattatgacttgtttggcgtatgaacatatggctatctttcttgcatctaacctttagcaaaagagtgcgtggttagccacaaaactgtgaccacatcttacaagaaattagcagatcatttttatatgattgaataccaagttatatttaaagtataaaatacttgagtataacttttgcttttttttccacgtatatgtagtactgtagttatttaactattttgtatatacaatgatgttgatcaatacacaccttataatcttcactcaccagtcaccgctaccaaacttcgcatatcttctctttttctttatctccaatcaacatcaacacctattcaccatctcttatacagttatactgtaactaatctactcaactcaatcaaacggatggcatgccatacgtgtgagagctaaatgtagacttctgcataaaacccaatggcgtttttaacactgaatgtctatataaaatatttttaaaacttacaccttagaaatttaaaactgaattctatattaatttttttaacctactccctccttcctaaaatgatcattatatatatttatataccaagaccaatgataatttaaattacatcaatcaagataccatgcacatattttgccacaatacatgcaacaattaaaacaccatgccaattacaccttagcatccacacattctctcgtgctgtattattgtattctgatgaaatccgtatccatatggctatatgatgatcaatttaagaaattttgaattctattatatgatgatcaattttgaaggagggaataataattacgtccacattactccagctatatagaagaatacaactttacagcgctagggtaggaaaattgttctatgacatagagtaggtaattaatgttgccgccggcttgccgccctataaataatatcaaattatgtgtgagagtataaatgaatttttcgtcttttgtaattagtaattaggttgaggttctgtatgaactgatcggtgcacaatttaacaggtcagcacagctagaattctatctcttgcatgcctatgcactctctccttccaaaaaaatatatatatatatgctcgctctgtccacattcatctctaggattagatttattttgggataaacggagtattacttttatcaccaaaatcaaataaaaattaactaatcttacatgtaataaagatcaagaagtgtatacatacatgtatgcttatgatgacttatcggattctgatgaaacatttaatttatctcttcatttaattaattattcgacgggtagaagcaacttatttgaaaatacttaaatataaaatagatataactcttatcgatggagggattgttttttagaaacagtaatttgagctagataatttacagttttacacgccgatttggagatgagaggctgtgtgcctgtgtgcatgcaagcgagcatgacggcatgagcacgccagcccacgcagcttaattgtggtgacccccggatcgagcgaccgaccgatcgaccagctgaggtgaaccacatatatctacgcagggttcaatggttgcattctgcagatggccttctctttcccggaattaactacgcgtcgtcgcttacgagaacgagagtcccaagagctgtctcttgtttcttccgaacgtacagtaatcgtataaaatcatgggaattacagtaagcgtgacaaattaaaacaagtttagtccgtaggacaacttgaacgataatcaaattgtttgaccactagtataatttttggtagcttatttaattctagagaaaatttaccaagaagtgatttcctatttgcctttgtcttgagctcgacgggtagtagtaagagcaagaataataatagactgtctgatgaatcttatttggtgactcagagctacttcctacgtctcttaatataagagattttgacatattgcttgtactgtttgaccattcgtcttattaaaaaaatttgaaattattaattattttatttatgacttactttattatccaaaatactttaagcataacttttcgttttttttatatttacatatttttttaaataaaacgaatgatcaaatgttacaagaaaataatgaatatctcttatattagaggacggaggaagtagctagttagtagtagctcttattggaattcacaacacaggaattttaaagatgatgtgtttagatatctcgcatgaaaatatccttttttttcacgaacatgcaaaaagattacatgtcaatatattagagggaaaaatttttttgatacacaacgcaatcagccagatcggtttatgctaggggaaagaagcgcatgaaaatatctgttttcgcgaactcataaactgtgatatcacgcacgaaaatatcataggaatttgattgccttctagaaatacgaagagagaaggatttaatagaggtaaaatgcatgaggtgtgagctcatgtgaaaaattcctatagaattgaactatggaaaagcaatactacaaagaaattatcaacttccagtcctatcttaggccttgtttagttggaaaaaaaattccggtttggttgtcgcatcggatatacgggcacacatttgaattattaaaagtattaaatgtagtttaataacaaaacaaattatagagtccaccagaaaactgtgggacgaatttattaagcctaattaatccatcattagtaaatgtttactgtaacaccacattgtcaaatcatggcgcaattaagcttaaaagattcgtcttataatttacacgcaatctgtgtaattagtttttcctatatttaatactccatgcatatgtccaaatattcgatgtgacaacgtgaaattttttattttgggaactaaatatggccttaattaaacaaccaaattagaaaaagaaaaatcctataaagctgaatccttcaaaatttcttatgagaatcatgagcgttaagagaaattgcacttgtacggatcgctgtaccagcagaacagcaacacgctcaaaaaccgaagcctggcacgaccaccagaagagcctcaacctttggaactacgcttgcatatatgaattgtataaatgatccatgcgctgcagtactcctcgctgctgctggtcgctgcaactgcaaaagcctcatgttgcccgctggttaaaccgcggtcacccgcacccttccaagaggcgcacagcaactcgatcgaagcagtgcatgcatcatgcatgcattgtatggcagctagcgtacacacgcccgcgcatgcacatgcacatggccccctcgcctcagctcgccggccgctgccggtcaaacccggccgt

SEQ ID NO: 59471 - DNA, 2993 bp, Oryza sativa
ctccttgttcaaccccttcaagaaatgaatgactcttcgcctctgcagccatttatttccaatcacaatgtcatcctcatgtttcaatagtaggggatcatagtgatcaagatctgcccataactgttgcagctcgctagcgtactcttggactgttctcccctcttgcttcaaattctccactttgttctgagcctcaaccatcatcattacatttccctctcctgaatacatgttgctcagcgtcttccatacaactgcagcattctggatagcttctatcatcctgccaatagaaggagccaccaaggtcatcaaccaagataccacagtggaatttgtagtattccacgtcctccatgcttggctctccttatcagaaggttcttcacaactctctagtaaaaaatgatccaccccttttgctctcaacatcagttgggctctcctacaccaactcaaataatttttgctcccctccaacctcaactcatttggcatcaattctagtttcacttcagacactccagccgcattcctaggacctatcatgcccatcttcagcaaatcctctagcaaacctttcatatcacctttagtaacaagcaatgaagtatccacaacctcctttccctccccagaagacatttttttcttcccttagcttcttctttaccacattaacagagatacaacaaggaccagacttcaatcccccatggcagatcaaatattagccaaatcaactaataggagcaacaacactactcctcggtttctcaccaaaacagaacagcagcaatagcactacttctcagttttcagcacagcagcaagtactcagtttcttccccaaatcagcacagcagcagcaaatacagcagcaacagcaagccaagcgcccacttcaccttctcaagtagcagcagcaccaacacctcagcagcagcagcaacaacctgctcctctgccacacgccgtcaccagctagccctccgcacgcgtcgtcgccgttggtgctccctgccatcgacaccgtcgcttcctcactccacgtcccgccttagcagcgctgccatcctgcgccggcacagcgcctcttcctgccacggccaccaaccgtctccgccgcgtgcggccacgctggcctcgcgcgtgtgtcgtcgcgccgcgccaacctcgcctcggcccgcgccgcgccgctgcgacctcgccagctagggttcaacctccccagtcgccggcgacccgctctgataccatattgttcaatttggggaatttttctagggtttgcctactcagctcaccccttcctcatctattctattagtataacactttacagataggtccttggtacaatacatatttacaccaacaatttctgtctcctccattagttgggaatgaatagtctacacacgtcactgtttagtagcgcaacatatcagctaatagtgggagtagctggcagattcaccaattttatggcctcacatatcagttggtaggtggtggcagattcaccctcactagattcaccattatacttaatatatttgtctagtttgaaaactgcttgtgaagcttttgcaatcataaaagtttaatctacttcggcatttaatgattcttttagccacacaccatcaggtgattttagcttcctgacatgtaatagtttcttgcttgtttgcaggtggtcagtaaacggggccctacagtcaccaagatttctggaatgactatcctggataatgatgcggttaatgctgtatctgtgctactaacaactgcggttacagcttatgcgtgcattcgcatcttttgaagatctttttactcaagtttcttccaaacacccaattccattcaaaggtgtcaaggcatggccccaagacaatgaaatgatggattaggcattttggctgcttgatgagaaagattcaattcactcaacgttgttcactactccaagaaaaacattgtttggttggttggtgctaccgcaagctgaaaagtgtcagttgtctaagcatatacagttaccctacttaatgtgaaagtgataagctggatagtcctgactcctgaaccctattttctgctgagctaaggattgtggactttcgtcgtgtggatgatggctgttgttatttctgtactgacctaaggatttgttgacttagctgtgtgagtttttccatacaaagctgtttgggacaaaggaaagctgctgctgatttcctttggaaatggtgcaaatcctccattttaatgagaaataaagcatccagtgtctatgtgtctctcctacgtttttcttctggtccaaacaacccaaattttagcagtcctgtgttttatcactttacagtatatcatactcccgtgtttttacctatgtgttctgtattcctttcttccaaacagccttaagtttttctacccactatcagcagtgttttggtccatgagagctcaggaattaatctggctacagtacaaaaagagctttattactgaagagtaaattccctattatacccttgaaaacccactcaatccttctcataccttgaaatttacccaatccctcctatacccccaaattttaatttgatctcttcaatttgatctcaaatttcgggggtatagaagagatcgggtaaaattttagggtatagaaaaggtcgggtaaatttccgaaaccgcgacttaagccaccaccattcacatgcatcaccgatgcaaagtcccaagccagtgccagtggttacgtcagcggcgtgttcaatgtctccattgatgttattgttgtcattggtgggtgtctccggttcccacatcagaaacaaccttctacatacatctccttatgaggcgcacccttggctatgctgcccaattgtgctgaggcagtaggtcttcgatccttctgtgcgacggccagccagataatgttgtcatgaccgcgagcttagggggtt

SEQ ID NO: 59472 - DNA, 5111 bp, Oryza sativa
aaattaaactctttagaccagaaaagatcaaacaacacaaaatctagtctactttttgacttgcagacatgtggatcacccccagaaaaaacgaaaacagttcacctctacacaattatacattgcacctgcgcatctacttccctgctagccaatggaagaactccattgtagaataccaactttctaaatgacgggtattattccactttcttaaacaaaaaccgagtatttggactccttagtccgtaccatagtccagtacataataacggcggcacacgccctggtctcgttcggcaccagaatttcaaccgggcacggcaggcggccggagacgagacgatggcaaacgtcacggcaagtggccagctagctataggctatagcacacggacgcccacaaccacaaccacaagaagcacaccgtacgcgccgcaatttgcaaacctcgttccgcgcgcgagcaagagcgcggccaaccagagccacgcaattctgcacccggttttctgggagccccccaccgattcacccgcacgagtccaaaaccgcgcgtacgcccacgccacgccacgccaccggcagcgacggctcgcgctctagcgatcactaatcgggtcgcgcgagcttggtctctcccctataaaaccacggctccgcgccaccaccattccggcagaaggcaacacacacccaaacacaaacaagagcatcatctgagcgtgcagagctcacacaaacacacgtacagatcgttcgtacaagtgcaacaaacacatggcgagcggcggagggaaggcgaaggcgtcgtcgtgggcggcggcgataagcgtgggcacggtgaggcgctcaaggaccaggccggactgtgccgctggaactacgcgttccggacgctccagcagcgcggcaggcagcaggccgtggccgggacgagcggcgccaagaccggcggcggcgcgcgtgcgctgcagcctgcagcggcggcggcggcgaggaggaaagcccagcagcaagaggaggagctgaggacggtcatgtacctcagcaactggggcccaaacaactaattgttactgagctgatcagtcagattaggatcgtgttaggtggttagattggttttggtgcttgcaagatggaactgcttgtatatgcagacgagttttgcacaagatgtatatatacgatatatatgatatggcaactaatcaagagctttggttatgcacaattctgtttctcctgtcctttgtgtttggccatccagacgacgcattgtcacttcgcttgaaagttggaacttgccttgatgaatctggaataaactcagaatctgaacccgttttcctcccatcctccaggcgtgcatcagattagcagcagaccaaagaattcttcagtatcaagtgaactaacgccatcagatgagtcatccgtcaaccagtatgacgaggaaaaagctcattcttcaggcagaaaaggaattcgcctgatggtagttgctcacttgtttttcgaagtgatcctttccttgcattggtggttggtaggatagataattgagtatccttgagcggttcagcaacactgtgcccggctttaatcaatttgttgtaatacaaaatcaaattttgtctcgcacaagatggatcctgaaaccaacaaaatacccggaaaaaatgtcgccatcgataccacttcccatccaccatattccaatgctacctgtgtgctgcaaccttcaagtggcacaacagggaagaagtactctcatgcacgacgctttactccaacacctccaaaaagtacacgataatactgaaaatgtccccatccatccccatttcttcagagttcagaattcatatatccctcccctctgtgtgctacgtctcctccgatacatcgcgctttcctgctcccttttggattcagttaccattccgttttgtccttagcgacaaattgcaactgaaaattcagttgatggaataccactactcgcagtgacgagagcgcacaacacatcccacatactggcgcacaccggaaaaagaaaaacacggtcaggagcaggtgcagtgaatagttggttgaatacagccgccaatccagcatcaaaaccgatggttttggaacacgacggaatatcactatgctctccctgtatatatacgcttaccagcattaagctttgtacgtgcaagaaacttcaaaggtggtaaagattaatctctgagtttgagcgatcgatccatcgaccgatgagcctgaggtacgcgagcagggtgttgctgagagcggcggcgcaggccatgagggccgcgaggcagccggcgcctgcggtggccaagccggtgccagcggcgaagccatcggcggtggcgccaggcacggctcagcggcagcaggcgaagcggctctccggtggcgtggctgagccggcggagaaggcggccgtggcggagaggatgaggcggcggcgcagggagaagtccgagaatgtgatgcagctcgtgtgctggggacccagttagccgcgatgcttctgttgctgctgtagtgctgtgacatcagttgagcagagtgactagtgtgatttgtgccttatgttcgtttccttttgtaagatggtagaatctgtgaaattttgacggtattgtattctgcaagatgctatgaaatagtgaagtactgttccttttctgaaattttgtttagccaatttcattttctgaacttaggaatgtatgcatggctctatttaggatttctcttaacattcttcgctctaaggagctaagatgttctttttgctcggattatgtgaaacactgcaacatccactgccaaaaatcatcctcttttcccccttctttctgtctttttttgcagaacatacagaaggacgaaaagggtacatgcagcatactgaaatttcaagattggtagtaaaaaatgtcaaaatggaatcagtccaccctggagaagccgagaagacgggaaaatgattcactacttgtagaagaggggagagcaaaacaatcttcagataattgatccagtacttgcagaagagagcacaatgatcttcagaaaaatcactacaggaagtgtatacacagacagactgactaacagtatttacaacaaagagaagaggcttaacaacacaaccgaggtacaagaataaacagtactagtattttctgtaccatagatgaacagacagacagtattaacaagaagtcaacaaagaaggattaacaacacaagcgagatccaagaataaacagtattttcggcatccatagacgatgattcacatacttaattacatcttcattcacatctgagattttcacagacgcagaacaaaaccttcacaccaccgtatgcagataagctatcgctagcctacacatctactagtactagtcttcatcaggtgttgggaccccagacggagaggaacatgacggtgcgcagcgactgctccgcccgcctccgcttctcctccgccgccctcgccgccgccgccgcgctcaccctgcccttctccaccgaccccgcggcgggtgccctgctgccgccgccgctgctcctcgccgccgccgacgacgtcgacgtcgtcgccgactgcgccttgtccttcaccgacctccccgcgccctcccgcacggcctgcgccgcgcgcgcgcccactcggctcatgtgcctcaggctcatggatcgatcgccttgcacgcaaacttcttctccgggatctctctcctttgctttgctttggttggattgtggtttgacgtggaggaggaggagacgtggggggtttatatatgcggagaggagaggaaggcgatggccgctgggaagctcggcttctggtgggcggggagcgcgcttagccgctaaccggcacacgggtttcgctttcgctggcgtgcgatagttatcttcttctgatgatgacgacgaaacggcgggcgttagcttaagctccgcgcgggtgaagaaaagtctagaacccgtttcgcgcgtcgccgatcattatcttattactactactctacttataggtgccatctgggacgtgtacattagttgatcaataattgttcttttgtactttccgagatacacagcgaaagatattttcacagaagataaaactcgtgatatagttctaaaagtaaaaacaaaaaaaaatccgttttactccgtaaactatttcattgcttcactcaacatcttaaacctttttttttcttattttacactttgaactattaaaaacaggtcaccttcctctctaatgatattgcttctttttttttccctacgtaagtcatgtttctcaataaaatttggtaggattaatagatacaatatagcctacctatcaacatttttcataattttttatcattgtatatatattcgaagcactaaacctgatttaaacatcgaggttttaaatttcaaacaaatagtcatgaacttatttttttaaaaaatgaactttaataatcgtgttgtctatggctatataaaatttcaatctaaaatacaactcgtataaagagaaacaaataaggcaaatgcttttagagtgaaccatctatcttctattatattattaaaacagccttaaaagaaagcaccacgttcgctgtggaggctaaaaattcccacattaatcggaggaaaggagaaaaatattaaccgttagatcatagtatatctagattttagcacctcagatctaatagataaagatatcagagttgtacagctaatagaaatctttccacggaagcttaaagaaacatactagaaataggaatcggagtaaaaaggagaaacgtacttaggaatcagagtaaaaaaagagttcgagatcaatacgactaaataaacggcctgtacatatatgtgaaaccaaccaatctgaaaaggaaaagtttatttctaaccgggatatttaaattcgttttgtctatatgaagtatttgaactttttctcatattaaaattaatgtattgatccacagcttgcgttccttaaaaacgaactcatgtccatgtcaaatttataacgatca

SEQ ID NO: 59473 - DNA, 866 bp, Oryza sativa
gattttgcaccttttccaaaagaaaatcagcagcagcttttctttgtccaaaacaacttttgtatgaaaaactcacacagttaagtcaacaaatccttaggtcagtacagaaataacaacagccatcatccacacgacgaaagtccacaatccttagctcagcagaaaatagggttcaggagtcaggactatccagcttatcactttcacattaagtagggtaactgtatatgcttagacaactgacacttttcagcttgcggtagcaccaaccaaccaaacaatgtttttcttggagtagtgaacaacgttgagtgaattgaatctttctcatcaagcagccaaaatgcctaatccatcatttcattgtcttggggccatgccttgacacctttgaatggaattgggtgtttggaagaaacttgagtaaaaagatcttcaaaagatgcgaatgcacgcataagctgtaaccgcagttgttagtagcacagatacagcattaaccgcatcattatccaggatagtcattccagaaatcttggtgactgtagggccccgtttactgaccacctgcaaacaagcaagaaactattacatgtcaggaagctaaaatcacctgatggtgtgtggctaaaagaatcattaaatgccgaagtagattaaacttttatgattgcaaaagcttcacaagcagttttcaaactagacaaatatattaagtataatggtgaatctagtgagggtgaatctgccaccacctaccaactgatatgtgaggccataaaattggtgaatctgccagctactcccactattagctgatatgttgcgctactaaacagtgacgtgtgtagactattcattcc

SEQ ID NO: 59474 - DNA, 3106 bp, Oryza sativa
gagggggtgaggacagtcatgtacctcagctgctggggtcccaattagctaggccattagtgttagctcggatggatctcgatctgctctgctgggtgtccgtttgacggtagcagccatggccggagacgtaattggccggttgctcccagctgatcgtaatatatcacgatgatgatgaaaaattctgctacttgagtacaattgcttcatgggtcattttgcctttgtgattgtgtcgtctagaacaatttatgaactgaccacttttacggtcatgcacgcaaaaatccggccgtgtcatcaatttaagatccaaactttctgggagaaaggtgttctgttcttttgatactgcaccgtaaaatttatgatcgaaatgatggaagaaatggtagcaatctagtttgtacttaatacttaccacttgttactgaatgatagtcagatctgtaattcaattcaatttggtatggaatttttttaagagaatggaaagattctcaacctttgcttaaaagagctacagccgctctacataattcactgaatggagagcataaaaaacattaaagatctaaacaataactaattgtccctaactaataataccaacataaaatatagaagcatttattcaagtttatttgtaaatctccatccgaatatagtaaaaatgtgtatgaccattgtctctagcttacggcatgcaatatatataagtattgtggaatgcacgaacgagaaaacatagatataacaaaaatcgataaatgcaataacaaaacatatgattgtaaaacaagaagaagaaaaaaaattagagaaataaccgtttgatgtaacgtgaaaaaagttcacataaatgttctgataagattggaccgtatgttaaacttcctctaatacttacatttatggctaattattttagtgttactctcccagaatataagaagttttagagttagacatggttattaaaaaagtactctctccgtctcatgaaacatagtactggatgtgacatattctaatacaacgaatctggacaaatgtatgtccagattttatagtactatgatgtgtcacatccagttctaaattcgtttttttgggacagagagggtaggttgaagggaatggtggaggattgtgactgaatgagtagtgaagttagacggaaaaagtgaatggtggatggttatgattggttggaaagagagtattgatggagaagttgttatatgttaggataaatcctgatagctaaaaattgttatattttgagacggagggagcaggtgatatagcacttgacattcagatgtttgtgatgatttcgttaatcttaaaatttatcggctcaattcatcgggggttcttaatgataaggtgtatgtccaatcatttgttccaaataacgctataaaaagatatgaatcctataacatttatctgttctaaactctaaagccaaaagaggcctaaagttatctattatattattaaaagaatagaaaaaggagcctccacgttcgctcttatggtctaaaaattctcacattaatcggagaaaaagaaaaggcagagtccatatagaaatacaatttagaaatagttgaaattcggaattgaaaaataatggatattagaaaaggagactagagtccatatagaaatacaatttagaaatagttgaaattcggaattaaaaaataaggaatattagaaaaggagactagagtccatatagaaatataattgagaaatagctgaaattcgaaattaaaaaatagggaatatcaaaagaggagactagagtctatatagaaatacaattaggaaataactgaaattcagaattaaaaataaggaatattagaagtagagtatagagttcatatagaaatacaattagaaaataatagaaattcggaattaaaaataaggaatattagaagtagagtatagagtacatatataaatacaattaagaaaaaaaatagaaattcggaattaaacaaataaggaatattagaagtagagtatagagtccatataggaatttaaaactaattaaaatttggaataaacataataaaattaaaagtagagtttagagtccatataaaaatataatttacaaataactaaaattcgagattaagaaaaacatgtgaagaagagtttaaagtcaatataggaatacaatttagaagtaactgaaattcgaaattaaaaattaaagaatattgaaagatgagtttagagtccacatagaaatacaattagaaataataaaaattcagaaataaaaataaataatataggaagaagagcatagagtatatatataaatacaatttacaaaaagttcggaatttaaaaaaagaaatattaaaagatgagtctagagtccatataggaatatatataattttcaaataactaaaatttgatattaaaaataattaataactaacacgtatataaaatacaatatgaatattacacattagtagttttgtaaagttattataaaatttaaaattatgttgtcattttaatatatttgaataatatattaagaaaacatatatgctattatatgagagaaaatagaatgatgcttttggaggccaccatgctagtttgaagtaattaagcaccaggcaggtggcttctagtggtgtgtttgtctgcatcttagcacgcatgcggtcagcatcgtcagcaaaacgctgggtgcagcagaatgcagcacctggtatactggaaaccatgctgtccagcccctggattccccctgcccgcctcccataactccgcgttcaccgtcaccggaaagaacatgtggtactaatttgttactagtaacaataatctgcacctaacgcatgtgatgtgagtcagtgccggcaaagaaacgatccatcatccatatagtttattgctcaccaagaaggtaagaagatcacaagatgcctcaggcctcagattagtagtattattttttttgatgaaaagattagtagtattgctttgaacggattagattagtagtatatggcagatccttatcatcctgtaagctgcaagggag

SEQ ID NO: 59475 - DNA, 4615 bp, Oryza sativa
ctgcactggtgggagctgcactacgacaaatggccctatccctccgtacgcacgcatatatatgcttcccatttgatcaattcaaccacatttttctgcaccaaactcgatcttatgaaaatgcgtgaacttctcgggtgtacatgtgtgtatgagcaggaggtggagaagatgacgctggcgcagacgacggggctggaccagaagcagatcagcaactggttcatcaaccagaggaagcggcactggaagccgacgccggtggcaggcatgaccttcccgacagtggaagctgccggaggcggcttccgacactccggccacgacggcggccttgcggcggcggcggcggcggcggcgctgccgctgtacatgggcagctggccgttcgttgtggacggcatgtaccggctcgggtcttgaagcctctggggatcgcatgatgttcccatgatcagcctgtgggacggtgaaatggaaaaactggtgaatcttcatcacgatctttcctctcatttttttttcttttttcctttttgtgtgtgataaaagctcagatgtaccacgtactactgtctgcttcttcgcaaatggatatgtaattgaaagctttaattctaaacatggcactccttctgttttgtattataagtcgttttgatttttttcattaaactttgttaggtttaactaatttagtaaaaaatatagtaataattttaacacaaaacaaatgcatcatcaaaaattttcaatatttacatataattaaattaatttaatgttatagttgttgctaaattctcatataaacttaattaaacttaaagaaaaatggctaactagattaaattagtatataatataaaatagaggtagtatattattcttgggcaagctagctctaacatctaatggtgggttccggccatccgagcttaactgcaatacaaggtttcacacgctgtccttgaatgaactcgtcgtgtcctaccgatcggccatcaacagtgagtgcgttctctgatccatctccttggaacagcacctttgtagggtagaatccaacttatcaacaactgcacgcatcctctgtaccataataagttcattttttatatccatttcacacatacaaataaaaaaaagaatacttccactttgttaaatcgcgatttaattatttcatctctttatacatttctaacatatttattttctacattcataaactcggatataatgactagttagaaatgaatctaatttagaaataaagaaaataaaactaaacttgttttgcattgccgcgcgcacaatgctcatgcagtggcagctcctccagctgctatggatttattactgtctgtctagatttgcactgttagggaatttctcatccagttgttggttagagagtaattgccccaaaatcaagttgccaagttgccgctcccccacccccaagtagcagctcgtacgtgcagatgacgacacgacatggatactgtctctgagagcaggtataatagcaagctataagccagttataaccacatatcgagaagaagagagaagagagaagaaagcgggttatagatttttaagccgactgtaatgcggactccaagacgttacatgtatgagaggtgggaccgaatattaataatgtagtatatttttatagttaactattgtatgaatggactattacattagctataattgttttggagccaacgggttggctatactattaaacttgctcttatgaaggcggcaggctgcgtgcacttttgaactgtttgaaaaaggcccgcactcctgtctataaaaaaataacagacctggtactaaaatgtgtcccatcttaataatataaatataaattcgtagtattaaaatatatcgtatcgtgtacttatatttgtcttttatttacataatgagcggtgacttatttaaattttttatatttgtggtacaacttatatatttttttaaaaaaataccttgaatttaaccaagtgttgatgtaaaaacacgaggcctgggagatctgcttaactctagtgcaggtccaaaagcttgcctttaggttcgtaagcgtgccagttgatcctgcaatcaacaagaaataaagacaaagaaaccacggttaaatctataaacgatagctgatcggctaattgccgataatatatcatttatctttgagccgatgtcatatgtgaatcgatcggtagtcatgaataagtaataaagaattaaatctactcgatcggctgtagatattaacaatatataatccttatgtcaatatgtacttaaatcaagtgattgggatagatcggtcgccatgccgagacagtataaatcacttagatcaaaatatatattaacaactggattatatatgttcatagcatagccgatcagatagatctagcatgtatcggctaatactccgataccactctaaattaagatattaaagcaagtaaaatacgtcaaacagaagcttaacatatttaattacgacaagatcttaatataaatggcagatttaacatgttaatcaatcatgtaacgtaaaagtagttaaatcaggtaagatcggctgaaaccccaatactactctaatcggcaactagaaagcaggctagagaataatattctaagcccgatttagtagatcaaacttaactgatgcagcactaaatatgaaaaaaaaaacaatatctaggcaatcaagccgctggatgtttcatagagtggtggatatcctatataatctaagccaacattgctatttaacctaatcggctgccttctaacaatagatgttagccggttgtaggttaaataacaatattgtcgtggattatatagaatatatgataactcggcgaattacatagataagattagagtatcataaagatggaagcactaatcctgagaacgcaagccgccataacaagttttacctctagttgaagatcgaaaccgatgcagctcaacccgaacccgaaagcaagaactcgtcgaaacaaaatgaaagtaaaaaggtggcgatgcgccgagattgtattgaacatgtgttagtttgattacatgggactcggggtctatttatacccgagattacaaaatatgcccatatcggacacgactcttatctctaacaaactctaagataccataagtttttacggcagacttttgcccaaacatatctctaagaaaattacataaaatatcctaattaatagatacaattgtcttctcaggactctatccatgcacggcaatcctcatgaagctcgttaacccaacctgacaatgtataccgtgtcacattgttagattcaacttaatcggctaaccttgtccgacttgaactctgctgattaaggtcgcagccgattcggactcagccgattcttactctgtttccgaaacaatcttggacttggattccgcttcaatctaatctctatctttgatactcgaattaccaaatttagtcgttaacaccaagttagaagaaaattggttaaatttgcataataatacattaataaatgagatttttttaaaaaaatattcacacatgtgtatgtagacacacacagctggatttttttttcggtggtcccggaatctctagatccgtgataatgaggacttcatctgagagtgtcttggacgacaaccatgctggagctgcagcatttactgccgtagagagccattggccattgccaaaacggccaccagccctgatgaaatgaaaggctatcagttgtccatcgcaggagaaattaatacggtgcgacctggctgtgagagcaagtttaatagtatagcccattactagctctaatttatctatagctaatctaatagtttatttatataataattgtttattatactattaatatatggtcccacctgtcatacacacatggcgtcttaaagtccgtactgtagctggctacagatctgtagcacactactcttttctctcatcttttatcttattaaatatgtttatagctgactaatagtctgctattgtacctgctctgagacagccgtgcaggaggagctgcagcattggtagtagtttggtaatacttccttcattataaaataaagaaatttactccggtccaacaaaaagtatttcgaggtattgttatctcacggtatcaaatcgtttctgaccattggatctagctaggcatgataggtattgttagatccaacaatcggaaacgatttgataccatgatgtactggtatctcgagatagtttttgttggaccaaagcaaatccctaaaaataaaataagtttatttttcattacatataaatttgtgaaagtaaatacattgagagtacataaaaagataaataattacaataaatacattgagtagtatatgataaagtaagagtattaaaagtcttttggtttatattaattattaagatgtatgagatgtgaaaaaatgaacttatttgaaacaaatgaagtactatgtatgtagttctccctccgtcccaagttataatgcgtcttttttttagaaaaatcaaaat

SEQ ID NO: 59476 - DNA, 655 bp, Oryza sativa
aattggagctaataatcggctatactattaggcaacatatcctatgcacacgctacctatgatgcactcatgcactcagcctccatagaccctccgatttctatccaacggatacaaatcttaggtgagcatttttgcagaaaaccgcccgcatcctacacctaaatttacaggtaaccccctcgcttgcttttctcctctcttgttcattcttctccccagatcgatccccaatcctcttcgtgctgggcgacggtggcatctccaatcgccctcgcctacatgcgcgtcctcctatcgaggctggtgagcaagcggtggccgtccggcgccctgtccaagcgctgtatctcgcagccacatggttgttctctgctcgtggcctggttttgccagctatataggcgtggtggtggtggtcgtcacaacggcggggctcgcgctgacggcatgcagcgcatttagggtgtttctcttcaggtcattagcacacgatgtttgattgggtcaaggatgatcaattaggatgaatcgatggcttatggttctctttttcttctttgctgttaactgaatgcaaaagattttgttttgatttctccattcaagtcttatacataatttgaggtgcggcgttttgtgttaactggctgcg

SEQ ID NO: 59477 - DNA, 8126 bp, Oryza sativa
tagccgatcagctatcgtttatggatctaaccatggtttctttgtttttcttttttattgattgcatgattaaatcaactggcacgcctttgaacccaagagcaagatagaaacaatggaaacctgaaacatgccttcccgagcaaggaaacccgagacccgacaaaaacggagtctgacttggactctgccggtctgaccgaccctttctagaggaaaccggcagagcaccaaactttggaaattttccctatttcaatcctaggtgccatatttgggtgtaaacagcgtcttcttttgttcaaatgccaactcagcatatttacgatcaacttgatcaacagtaccaagggggtgtgcaacaacaaccactggccaatatgattgctgatgtgatgaggggacaatttggttccaagcctaaagacagtgggatcatgtatcggcatccttacccataatattttgacagagtttctttgccgaaccgatacaagattccggatttctcaaaattctcatggctgaataatgtcaccacctacaagcatatcagccgatttctagcacaatgtagtgaagcatcggctatagaggccttgagagttagattttttcccttgtcattggaatgcatactttcttaagatgttacaaggagaagggtttcagagaacaatcaatgagaatactttctgagtggctggcaagatgcttaaggagtgatacgactggtaattagattatcgctctaaaaccgcgtgctctatgtttttcggctctcaaaaatggccgaaaaggcaatgagcatgtgttaacacccaaatgtagcacctaggcacaaaataggaaaagatattcaaatttggaaaggacccggtttcctccaaagggcaggtctgactaccgccattggattggtcagtcagactagcggcatgtgtttggtgagaccaactaaatccaactccaagtctaattcatcaggtcttgggttttcctgcttgagccgaggttttttgagttctagttggtctctatcccgagtaatacatgaagaatgccctatggaaggcaagacaaacccctttataagggctacagtcaattcaattgagcacacaacttccaacacaactagctaattaaatcgtatgttttaatatcacatctgaattttgcctagttttgtccatcttcgttagtttgcattgaaagccctccatcctcgccgctagagtgtgaatcctcgttataggtgttttttcctatttcatctaacttataaaactgatcttggtttagatttgtgtagatcgtggtggttgccgactccgtatccctgcaaagcatcaggtgttatcatcatgattggcggcatgacgaaaaaagttgccaacagtgaccttaacaacggacacataagcaacaaattgaagagaagaaccaaaaaaaatacagaagcattggtgcactctatatataaaagttttgaagccaaagttttaatttgtgaatggttgcgagttgtgacaaactcacgtgaacgcccacgctttttgactttggcatgacacattttttccatctactaagtttttatacttaattatatacaaaattttatatgtccaattcagatccagaaacaaagtttgttaattatgtacaatctttgtattttaaagttttttacttacaaactttttgggacaatccatcatggtggccccaacgcacatcggccggaacgaacatggtccataatgtgcaacccatggcgtgcaaacgttctcccattagacatactcaattgaaaggaccacacaaaacttccatcatttcttaaacagtgatatgtttatcatggcttgcgatatggtatggcttgtatatatgttccaaaatttaccatgagcatttaggtaggcgtgacgatttgtgttatcatgttatcactaaggcatcccgaattcaccaaacgtgaccattttacttaccaggtaccaccacttattatttagtcgacaacttgatccgaatgaatggtcttctttattctttatgatactatatagtttaatttataaatacactagactaccaaagaaaactgtggccacaagtgatactaaaatacttgcacgcatatagaggtttggatagggctgaccctgaaaataagtccactgtttggaattaaccgtataaaactatcacactaaactgaattgaagttagaagtcaaggagtagctgagatgtccataccagcagcaacaagagttgacatagtaacatggttcagaccattacattttttaacgaatataaccattacattttgcaactataaatatatattgatcacttcatcaatgcatccatgattgaatttgtgacgtgtgtgctgttcagaacgtgtagggatagcaattattataccagatgggtgtcacaatttgtaaagttgcctcttggtttatgaattcaagaatcaagaatccttgatcagaagtcagaactcttcactgaacactcaagcatgcagcatgcttacaggggatgtgtttctggacaagtgtctgttggattaccataacaaaagagagagaaaataaaaccaacagcctaatttcattttttgaaaaaaaagatgtgagatgttatggaggaactttgcatctgttattgatagagggtaaaaatggtgagaaaaccaatgcacgccctggtagcgctcctacgggttatggcaccgttcttaatagcctaacttgttaacaagctgccaacagctcttatgtcaaagttcaataccttgagatatatcaagacaaaagagcttccatcttctcgcccaatcgtcctgcttctaataagatgcatcaagactgagaaaaaaaaaagataaacttgtaaagaacatcagagaaatgcttcgtatgaacatgtaaggttggatatgtaaaaaaatagtgaaatatatcataaacttacaccatagtattacttaggtccacgatcatgttgtttacacccaaatttgacacctatggacaaaataggggaaaattgccaaagtttgagaagtgtcgggtttccttcacagcgccggtcagaccacaagtatgtgggtggtctgaccggctggaagggccggtctgaccgcaggtatgtggccggtcagactgtcagggtccgagtccgagtctgtcagggtccgagtccgagtccgagtctgttttcgtcgggtctcgggtttccttgctcgggaaggcatgtttcgggtttcctttggtttctatcccgagttgggcatggagaagggcctgtagagggcaagaccaacccctgtttaagggacaaggccggttcatagtaaacccccgaatataatctacttgaatcgttcttttaccatgttttctattttaccctagttttagtccatttttgtcgatttacgctgtaaattgtctggcgttgctgcgagagtacgacacctctttgtaggtttatcctgaaaaccttctgttttgcccacgagacgggtagttatcctcatatcgatctaaatatgcctagaggctgattttgatctctaaatcggctccgctagccggtttagttgtttttctacaaaacccatcttgatttggccgtttggctagatcgagatggttggcgactccatgtcaccgcaaggcgtttaagtgttgtgatcgtgtttgtcgacttgtcacaaaaagttgacaacacgatttttggtgactccactggggaacgatctatacggccatattagggccgaattttgatttagtctagtcgtttcgtcgaatcatcaaattagtttcggctaaacagccgaaattaacctacactttgccgccgatattgattttgttttcgagcttaattgttctgttcggtcgcagctagacattaaaccttgtgcatacagggagcagcagccggcttagataagtcgtttccttttgcttcacagggcaacgtagaaaaagatcaggctatcaaagccgatctgctactgctcacataccgaaaaaaaaatcatgaaatattgatctatataccgagagacaagcggtagtacatagtagtttcggtctctatttcttgctgtgcagggtgaccgaaaaagaaaaaaaaatctcaaaagccgttgcagtgcatcggctgttattatggaacatcaatttccaaatatttgttagatacacacagtagcataccaaggaaatcaagaccgtatattaatttatttggtcaaatatttcggctatgagctgtatggccggatttaatcaaggaattccttcatcaattacgacgagcgggaacgaaatcgataaggttacattggaggatcttgatgagaagtaatgtcaagtcatggaggagtggatcaaggcggtcacacaggtgctgttgatgaaatcatgcattaggacccatcaaggtgtggttctcaagcctggtcctcttcccaaatacgtctttgatgataaggtaacctccaattcgcccgatccaagtcttgccattcgaaaacatattgatcgttgtgtagatgcatattttagtgcttattttgacaaaaatatggtagaagatgcttgtaaaacttattctgataagaaaattggctctaaaatagccagttatcaacaataccgtgctacttctacttttgcgtctacacaacatattcataatactatggatggatcaatgggtgttcacatagccgattccaaaggaaccagttatacaaaaagcttagccaatggtcagaccgcgcatcacgccggtcagactgcactctttgccggtcagaccgcgcccgccatagccggtcagaccgtgccctatctccgcaagatagtgcctcctatggccggtataaccgcatcattgaccaccagtcagaccgggccattggccggtcagaccaggtgcttggccggtcagactgggttatgcatagccggtcagaccagcaccctggaacctcttccagagttttgtcccatgactaatagcactgacttaaattgttatttgcctcatgttagtactggtagtcatgctattccacatacacatgctattgcactgataatatagcatgtatagccgaaccaagcgacggttcggattatgctaataatttgtgcaatggtgccataataagtatagccgaaccaaatgttggcttggattgttttactaagttagataataatgcaataaccaatatagccgaaccaagcgatgatttggattgtgttactagtttagacaataacaccattgagaatatagctgaactaaatgacggttcggattgtatcacaagcaaaagtagcggtaacaccccgattttcgttcaggattaaaaataattaaacaatgcatttctagaaattaaataaaaattaaagcaatttaatcatgtgaaattatagaggaaattaaaattttccttcaaaaatcattggccgagaatattttgtaatattctttgtgccctaaaatactctctgaaatttcccataaactttgggagctcaagaaataattttaacaatacaaagttcattttatcaattaaaataaaaagaaaacaaatttaattctccttccttgcccttgcgccattttcggcccggcgaccctacctgtcagctcctccttccaccttcggcctccagagccgaagcggccatgccgcccttttgtggcccacgtcgccgccgattccggctcctcccgcttgcgccctcgtgcccaaaccgcatgaaagcggttcctctccacctcatctacactctccccatgtttccccctaaaatcgcgcctagatcgagctccacttcgcccatgatgtcgtccatgtcgccggccgttgccacccgtttccacccctctctgccatgatttcctttcccgcgcccatataaagcatctcccagttctcctctaccgtttcccctcctcccccgagcttcccatcgcctccctcaccctccccacgccgtgatgtgcactagggtcctgatcttccgaaaggttctgataaacaacgatttgggcggagtcgcgacacaaatcgatccggcttcttgaacgcgcacgctcttgagccccgcaatcgcaacaccacgtctcctctggttatcacccctgtcgaaacgcggatgacctcgccgagaaggctaatccctgtttgccaatcgaagaacacaaacaagaacgagatagaaacaaccaaaattgcagatgaatgattaagctcacgagttggggtcttacaaactgatctagcggcgaaactgttctcgacagaataatctaagcaaaacccaaaaacctaaagatggtggcggtattgatatatagagtttaggatcgtgcaatcccctctcgatgcaaccctaatgggttccaacatgatacacggcacaaaggcccaaatacggtgacgcagcaccgggacagattctggacgtcaacttgttcggtcgattcccattgactcggaaagaatttggacatgagaccaaaaccattggaaaggttatctccttagctttctatccatataaagaacgccccaagccgagcatgtatgcaacctgggcgcctgttttagtgcagattggtcctggactccgaattgcacccgaggtcgaattggtttgggcctccaccttgacttggacgtcctcgatgatcctccatggctctaagtccttctccaagtgtcttcttgtcccctccattgttcctaatcacaatataatcattaggtaacaatctattctcgaattcatacaaagaagaacataggaacgagctcacctctaaattcaattgtcgcgcacgagctcttgttatcggtcctggaatgaccgttggaggattgttgtgtgtatctgaggtagtgatgtccgcatcatcctccccctcttgaattgaagtcgtccgcgactcaagctcatcctcttctcccaagtatggcttcaaatctagaatgttaaatgtgcgactaaccccaaactcgggaggcaactcaagtttatatgcattatcatgaatcttctcaacaattttaaaaggaccatcagcacaaggcatcaacttagactatctcaattccggaaatctatcctttctcaagtgcaaccaaactaaatcacccggttcaaacttaacctcttacttacctttactaccaacaattctatacttttcagtcatcttttcaatgttgagtttggttgactcatgcattttcaaaataaattcagcgcgtgccttagcatcattatgaaccctctcactagtaggtaaaggtaaaatatcaataggagcacgagggttgaaaccatacactatctgaaaaggacttaccttggtagtagaatgtgttgcccgattgtatgcaaactccacatgaggcaaacattcttcccacatcttcaaatttttcttcaaaatatcccttaacgtggtacccaaagtacggttgactacctctgtttggccatctgtttgtgcgtgacatgttgtagaaaacaacagctttgtacccaacttgttccatagcatgtgccaaaaatgacttaagaattttgcatcacgatctgaaacaatagtagaaggcataccatgcaagcgaacaatctcatggaaaaacagatcagcaatatgaacagcatcatcacttttatgacatggtatgaaatgtgctatcttagaaaaacaaaaatgttatccctccccctcttagttctaggcaatcccaaaacaaagtccatagaaatatccgcccaaggaatacaaggtacaggaagaggcatatacaaaccatgtggattcaaacgagacttagctttttgacaagtggttcaacgtgccacgaacctctcaacatcctttctcatcctcggccaaaagaaatgcaaggccaaaacatcttccgtcttcttagctccaaaatgtcccatcaaccctcctccatgcgcttcctgtatcaacaaaagacgaacggacccaactggaatgcatagacggttagctctataaaaaaatcca

SEQ ID NO: 59478 - DNA, 707 bp, Oryza sativa
tgcacccggagcccaggcctaaaccattttgggatttttaatagaaagaacgggtgtgaagcaatttccacaattaccaaccattccatagtatccagatgatatgaatatttcccaaggtctatagttgaaaacccacctaatgttacctaattaaattgcgaagcatctacctaaaactaaactagtggtgccatgagtagagtgtccactagttgaggttttgtttattctagggtgaacaaggtaataataccaataccaataataataaggtcataccaaaggtaaataggcatggctaaataaaacagtgataacgcgggaatttaaataaagcgataatgcaataatttgaatcaacataattttataaactgggattcaatatgctcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcataaaaatgggctcttgacttcttaaggaaaaattagagacttgaacggtccaattccgagttcaaatggccaagttatggccgtttgaagtttatatgctctttaaatggatatttgcgaatttcttcatttaaattttaatttaaaaactcatttattg

SEQ ID NO: 59479 - DNA, 1282 bp, Oryza sativa
ctttggtgtctagctcgtgcctgccgtcaagcgcctgtggtcatcgccctagtcttccgctgtttctcgtttgtctctgtgtgtgctgggccttcgctgcccatgtaataagttaactatttacgcttccgcttgttaaactctgaattgtatcaacttttggtgtaccttgcctcctgggacaaggaataatgcacgcacgtcaggaacgcccgttgggttatttccggtcgtgacaccgagccatgaagttaagcatgaaatgaccctcgtacaaccgtacttctcgtatgggtatagacctagcggagtacacagccaagcgaagccagtatccctgcatagtggttattcttagtgtgtgtgggtcagggcctacggtggggcagccattggtggggtcgcgagggcgagtgcctacaatggtgtcgccatcggtaggactgccatgtgtaaactggacttaactaaaacttaatgcatgtgtgagtcttcccttcccgggagcgccagaactcctctcactgttagaaacttataacgcctagagtgcatgaggatgcaagttcatggagcgggtactgtcaacgtgaggttattgaaaggctttgccgtggcaagtctcattcgttgggacgtaggctcatgtgttgggcaagtcgcggagtacgggtaaagtgtacatccactgcagtgtgagtaaaaccaatctattcgaatagccgtgctcgcggatattgagcatcgggacatgtattacacttggctagactctaaattcttaaattgattaggatgggatatgcatgatgattttcttctggcggatcacctcctctagagaagaaaaggagtaaaccccagaaaaccattacggccggtaacgggaagccatctttgggaagataaaggggtggcgaacagaaccgttgctgtgtaataaacactggaattaaaactggactagtctatactagataataggcttgtgaaaagaattgtgaaattagctttatgcaaataaaccaatggccgtaccttgaatatctctatcatatgcactgttgttatgatggcttgctgagtacggttggtactcactcttgctattacaaaatttaatcagtggatggcaatgaagtcgaggaggatccctatgcttatcttcaggaggatgcggaggaggacggcgctccgtaggtcttagttatggtcgttgcctgtggcaatggcatagccgctgcctatattctgctgccttatctatttctgttattgcttg

SEQ ID NO: 59480 - DNA, 16007 bp, Oryza sativa
aatcccgggggtatctcagctggaaagacatcctcatactcctgcaaaaggttagtaacaacaggaggtatcgaactagcaatatcatctagggaaaccaaggcttgtttgcatatcaaggaatagcaaatatcatcatctgaaatttcagcaatgtcacattttgttgcaagcataacaccacccttcaacttaattccctcaaccttagaactaggtgaaagcttatcgtttttaggtgaaaaaactgatttagcaacttgctgattctcagattcattaagtttcaaactagcagctcgctctttatcagcttctacaatttcagcaggggtcaaaggtagcaatgtaattttctttccattatgcacaaaagtgtatttattcctcctaccatggtgtgtagcatcattatcatgttcccaaggacaacccaacaaaagtgaacaagcttgcataggaaccacatcacaatcaacaaaatctgcatatgagccaatggaaaaagaaaccctgcaaacctgtgttacatttgctcttccggaatcgtttaaccactgaatatggtaaggatgtggatgtgtacgtgtggtcaagccaagcttcttgaccaaatcagaactcaccaagttgttgcagctacctccatcaatgattacacgtgcacgacggttgttgatgacgaagaaaatctgaaacaaattatggcgttgtaacctctcaggctgctgtacctgcgtgctgagcacccgctgcacaatgatggtcctgtaggccgttgtgtcatcacgaccaaagacttcgccatcctcatcctcaacttcttcttcctcctcttcctcttccacgtcagaggtggtaatgtagccatcttctgtagcaacatatgcccgttgactagggcaatctttctgcacgtgcccaaacccttggcaacggtggcactgaatgcgtcccgtggagatggttttggggcactcttggcgggtacctgcaaagaacctttacctaactctgctagtcgtggtggagatggttttggtgccgcagaagcttcggatgcagctggtcgcttgcttgctggctggaaaggcgcccgaaatgaaatggccttgggcagtcccgcagatggcatcatgcacggagtgtatgtactcgccttgttcttgccctgttgctcacgcccctgcaattccttctctgcaagcatagcaaactgaaacaactggttgacagagttaaattccttataatcaacaatgttctgaatttcctccctcaaaccagaataaaaacgacaaatggcatcctcgaccccctccactatgcctcagcgtctcacacccttttgtagctcaccatagtaatcctgtacagacttatacccctgttccaaacgcattagtttctttcatagatcctatgataagatagaggaacaaatctaccacgcatagctaccttaagttcttcccaagtagtaggtaaaaccccctcatcagataacccagcccaccacatgatagcaaaatccttgaactcactactggcttgtcaaactctatgttgctcaggtacaaggtaggcattaaacttctgttctaccgtcatctcccaatcaaggtatttctcagcatcataatatcccgaaaacgatggtattttaaacttaaccttagcataaggatcgtcgggcacacgattattattaccttgttggtggcgagtgccacccatacctgtgcggtttgtgcgtaggcgacgttgtagtggtgccattgaaaaaccattgttacctggggactctcctcaccttcgttacctgaaacactaaaacagcaacaaacggtgaaggttatccctaataatctactacgcaggtgtagtggtgcctctcaacgattctcagcaatatggagtacctaaccaagctcttgtaaggttcttaccagcaaagcaaaggatacctggaaggcatagtcagcgattgcagggatcaagaacctgtgctgtccagaagtaatatgtggagataggaaggccaaatatatgtatatgagtggtacacaatccaatgacagatagtaatgctaaataaaaatcccaagtcacttgcccttcgttgctggtctactcgtgtcctagacagtagtggtaacaacaatcgctcaaggaaaatgacaccagtaaacagcaaggaaggacttgcaggcaagcttcggcgagtttcagcaaaaacaacaaaaccgaactggcagataagctcaacggagcgcgtcgtgagctcaatgcactactggaaatcaacttcactttttttttcttttatttttttgatatttttttctttttccagaacacgagaataggcacacctccaagttacagctcaatcggagttgatatgtggcgtatggaattttctgaaaccactataaacaatgtgcaggaacttgtgagctcgagcagacaattttgcaagccaaattttggaattttggattcgccaaacccgccgaaggtagggagaaacggatgtaaaatttgcctgattccgagtccgtatgcaaaagttatggctgtttgaagtttcggcttccgtctaggtcttcgagaggggatataacctagtctattttgcggtggaactgggatatggtggcagcggagtttgtagggtgttctggtgatatgtggtgatctggatgggtgtttatgatggctgaaacggctctcaaaggataaaccctaacacacggtgaaggtggcggctagggttacaaaggaaaaacagacgactagactaaaacacgcactagaccagcaacaggaacttaaactaggactcaaactcaacactacggactctgaaaaagaatcatgcaaaggctaaacacggtttaggttaaggtgactaacgactaaattttttttggcttttctgtagaccccaggataattgcgaaaaacaaaaactaatctagggcaaagaaactgagcgaacctgacggtgaacctagagctctgataccacttgttgtgcactagggttaccgatcttccgaaaggttctcataaacaacgatttgggcggagtcgcgacacaaatcgatccggcatcttgaacgcgcacgctcttgagccccgcaatcgcagcaccacgtctcttctggttatgacccatgtcgaaacgcggatgacctcgccgagaaggctaatccctatttgccaatcgaagaacacaaacaagaacgagatagaaaacaaccaaaattgcagatgaatgattaagctaatgtgttggggtcttacaaaccgatctagcggtgaaactgttctcgacagaataatctaagcaaaacccaaaaatctaaagatggtggcggtactgatatatagagtttagggtcgtgcaatcccctcttgacacaaccctaataggttccaacacgatacacgatatacggcaaaaaggcccaaataccgtgatgcagcacggggacagattttggacattaatttgttcggtcgattcccattgactccgaaagaatttggacgtgggaccaaaaccattggaaaagttatctccttagctttccatccatataaagaacgccccaatctgagcacgtatgcgacctgggcgcctgttttagtgcagactagtcctggactctaaattgcacctgaggtcgaattggtttgggcctccaccttgacttggacgtcctcgatggtcctccatggctctaagtgcttctccaagtgtctccttgtcccctccattgttcctaatcacaatataatcattaggtagcaatctattctcgaattcatacaaagaagaacataggaacgagctcacctctaattcaattgtcgcgcacgagctcttgttatcggtccttgaatgaccattggaggattgttgtgtgtatccgaggtagtgatgtccgcatcacgccatcccccacctccgtgctttccggcgagttccagccgcgcgctaccaccgcatcgcgctgccaccaccactggcttcggcgccgcgagggcaaacccggccaccacttcccctccccaaaccaccgccaccaccaacccgagccaccgccgcctctagcgggctcccaccggtgagcatcgcctcgcctggccatgccgccgccacccacagtgccgccatgcccagccacaccctgtccaccgctcctcttccccaatccattgccgaaacgccaccgccacgttctccatctctctccgccaccattgccgcctccagctgcgccgcgtcgcctctctggtccacctcacgctgcgccatcgccttccccggcactgcagccatcgtgcgcagctcggcttccactccatctccctcctcaacccctgaagcactactcccaccgtgaacccgagccgccacttccatttgccacctccggctgccgctcgtcgctgctcccgatcatcccaagtcatgccacgaccaccattagctccaccaccgtgaggacaagctcggccactgtcacgcccagaatttctatccaaaattccaaacgcttacatgtgcgttaaaccctcgtccaggaatcagctgaggcacacaatgacaaattgataatagaatactatcaaacagctaattaatattcgcaaaataaattattacagaggtggatagttcctctcaaagaataaaattctatgcagcggaaaataaaaacaaagactaaatagctatggcgactccactccacaagcaactcgacctgaccaaagcctaatcctcctgaaaatcaccttcactgaagtactcctcctctgatgaataaatattgcaagaatgagcatatgacatactcaacatgctacacaacaaatatgcaagtgcacaggataacaaaggatagcataataaagctcatttgcataaacggcatttaataaacatttgagagaatagtaaaacagttgagtaatttaaacaatattaaataaacaccatacaacacacccgtgttgcataggcccaaccacatttgaacaaccaaccccgattgtacaaatcaacctccataccaggaatataccattccaaaccagcagtcaatttaattatcacagtattataattaataacgagtaatgtgagactaatcacgaaaaacattgttagacccacccttaaccgcgggcacagctattcgtatagttttactctggccatagatgtaccactgtacccacaagacacaactccacaacatgtcaccatgcgcctcagtaccaccacggtaccttggaaaggaactatgacaatacctctcacacaacacaactcaccacattgcaccgttcctggatcataatctccccctcaaaaccagaggcaatggactccccagcgacccccacgaacttcttgccacttcacagtctggcaccccgtaatgaatcatgctatacaaaagataaagccgttgcccacgctggcttgtggttggcacgttaaatgtttcacaacagtagctcatgaaccggtccttaattgtcatgagcacaaccatcaaaaccatgtgctcataacccacccttaatcaggttttaattatcaattaattatcataacacgattaaccatcgtgagctaccattaaatctaaccataactaataatgtaatatgattcatcccattaatgaactaatgtttctaagcatggctaagcaattatacctatatagcacacttagctgaaccaaaccaatatataaggtccaagctaaatcaatttattacccctaggaaaataaagtcatcttcggccattaattaattgggaaaggctcaccccccgatgacattaaaaaataatgcataagttgaaataaaacattagctttaaacgggttcaacatgctcaaagggttgtttgggatctgtgtgacttgccttgagcttcttcaaacacttccgaaccttcctcaatgaaaacgctctcctccggaacgtcggaaactaaagcaaatgaacaaaatcaacaaaacagtacaaaataaagcataaactgatgtgaccatggctactacggatacatccgttgctcacatcatggatgaacaacaagatatcaagttcgagtcctccaagtgccaaaatccaattcggccacctgctacactgctgacttcaaacggccgccgaagctccatacgacctccgttttcagcccgtgagtatttgatggaaagctctcggagtcctctttccaatgcatcaagcctcattgccaaattccatctcagtcggcagcaactgaagaaacaatgtgctgtgacacctgtaatgggcctatgggcttgtaacctcatttgggaccccggcccaggtggggcccatgtggggtgcgccccaagctggtggagcacgaccctaggcacccctaggtcgtcctcccacccctatatatagctagttaccccttcagggtttcttgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcattggcaagatcagcaacccacggagaggtgtatcgatcgctaaggcgcaacacaacgtctcgtacggctgtagtcagatcatcaacgtttcttccaaatcgtagttatcgcaactcaccgaaagatcgggccaataacagccttgagtgtcgagaggaactcagggttcatcaggtggtatcagagctttcgttgctcggtgagtttttatcttcctataaccagaaaatagccatacaaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgtcgctgccaccgtgtctctgttgttgtcgggacctacgaaaacggaatcggctcgctgccacgattctatttttgtagttttcagaagtttctgtcggttagttttggagttcttgagttgcatctagagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctcgccgagtcccactcgcccctttggccgagtccgaccccctccctcaattccacggttccgagttgtgtcaaacaccttggcgaatttttgtttggtgtcggtttcgagatctgtttggaaaaacggaaccggcataaattcagcattccattttttgtataattttaattttgggtttagacttttatatttgagtccctgtaaaatttatatttatgtttgagtccctgtaatcttacattaaggtccttgagtcagtttttgttaaaaaaaatcaatcaagaaaaaagtgagaaaaaaaaaggcagaaaggtgcaaaaaaaaaaaagagaaaaaaaaagccgcaccaaaaaaaaaacagaaaagaaaagaaaaaaaagaaagaagaaagaagaaagaaagaaaagataaaatactgttatgtttgagctaaactttatatatcagagttgtgcatgagttgctcctagtgctatcttgtggtatcgtttgtgtctaggctcgcgtctctagtacgtctagcctaggaccagcacggtacttgactttgaacaattattcaactttgcattatctgatttgagcatttgctattcctttgctacatatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggctaaaagcttgagtgtgtgcgatttttgagctgccactacctagtagttaataggaacgcgcatatttttgtgtatgtttcttgttttctactaacaatggcagggatatgcaagataattggggatagctgtgctcaacatcgacatcttcgtcgagacatgaggagggatcaacatgaccattatgaggaagtgcgtaatcacgaaaaggaggagagagacatgaaagagccaccaattccattgttcacactcaagttcgagacacctccatcatctaaagaggacatccaaggtaaagtaaatggtactgaaattaatcaaggtgagtgcattgttaacgaagtaaatttgtccacttttcatgcaaaagtagagcaaccgttagtggaaccaaatgctggaattcctttgtcacaagttgatttactcgctgttccttgtgataaagaagagttgtgtgataatgcttcacttatatccatgccacaactagtgaatgaacatgctattcctagtgtttctttgtgtgctgattttaagcatgctgttcatattgttaatgaagttgaggaacgtaaattgctatcttctttaaatactttgggctatgttcagtttgatgattttggtgagctcgataatttgaaggagaaattatttgctaagtctgatttgccatgtctaactaatgctatttttcatatctttggcaaatataatgatagaggaatatatttggtgcatagagttttcatttgtttggatttagagaaacatgttattgctaatcacactatttcgagtttctctagttttgattggatgaaataggttattttgaatggactatatgaagaacaccatatggaaaaaccgaggacggttttccgtgaagaaggggataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccaatgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccaagaaaccctgaaggggtaactagctatatataggggtgggaggacgacctaggggtgcctagggtcgtgctccaccagcttggggcgcaccccacatgggccccacctgggccggggtcccaaatgaggttacaagcccataggcccattacaggtgtcacagcacattgtttcttcagttgctgccgactgagatggaatttggcaatgaggcttgatgcattggaaagaggactccgagagctttccatcaaatactcatgggctgaaaacggaggtcgtatggagcttcggtggccgtttgaagtcagcagtatagcaggtggccgaattggattttggcacttggaggactcgaacttgatatcttgttgttcatccatgatgtgagcaacggatgtatccgtagtagccatggtcacatcataaacagtacatgtggatatttttaacatgtagatctcgattttagatgaatttagcaacttgcaccacttgaatccgagttacgatgatttagttatgaatttctgaagtttaatcgattttcaactaatacagaaaaactaataaaaaggatttatgacgtcatcgatgacatcatcgccagcataggctcggctccacatgaccaccagcgatagagagctcggttgggctatccgaggacacctacgcgaagaggacgacgacgcgaactcaccggtgcaagaaactacggcggacgacgacgaacgacgaacgacgaccggcgacgagctccgacgacggcacggctcggctcgacggcggcggcggcgctccggcggcttgcgatagcggcgaaggggctgccgaggtgctcctcctccgcaagagcccaacggcggcgaagtaaagcggcggcgacggctacaatggcggcgcggcgcggctggagaggcgccggcaatggcggcggctagggctacgcggcggcggcgctatgggcaatgatagagctcgggacttgaggggaaacatagaggacgactaggggatgctttatataggcttggattagagagatcggactccaaacgagaggaatcgaagccagaaaaatctagggttagtttggagagagaaactcaaaacaaattcgattcggtttatccgggcaaaattgatctccgaaactttaggggaaagggagaggataaggaggagatgatttcccctcaagcaatcgaactcggggacgatcggttagggcggaatcgaaggggaggcggcggcgctcgggctcggctcggccggccggaggtaggagaagaccccgacatgtgggccccacatgtcggcggcttgagaggaggggggccggctcggcttgggctggcgtgggccgcaccgccatgcgcgaggaaaagaggaattgggccggaaatggcccaatgacctaggggagggttttaaagactttttcaattaaaataattcatgaaatgatgtttcatttattaaaaaatactttccttgctcaaataattcctagaaaaatctagaaaatagataaacaagcaaagtatttaataaaattttatctagctcaattttatgttgaaacttttcctagattattagagtttaacttgtaggcttttaaaataacttctaaaaatgatttaaagaatgaattattaaattaggcgattttcagggcgtgacagccaccgctccactggctccaatcaccgccgtagccttcttctccctgttgaggtgagcttcgccttaattcaccagcctctagccgcttttccccgtctcgtcgtgcatttttcctttctcctaaccctaccaccgcatttcccaggttcttctggccgtcgtccgcctattcctgctcgcggaacaccgccggaccgccgttacgagtcaccccgaggagcccgccgccgcctctccttgccgccggccgcctccttccgtcgtttggccgctcggtgagctcccctccttcctctctgcccactcggtttcctctcgctacctctcgcgccgttgccactcgccaccggcatcgtcaccggtggtctcgggcctggcagatgccgccgctcactgccgctcgttgctggagcgcttgtgccgtccggctgcctcggccgtccgatcggccctcggccgatcagggccgtccttgtgtccgcccacgtggtcgccacgtcggtgacgcgtcggcgccacgtgtgcgccacgtgggccactcacccgagccgcacatgggcccggtccatcgtgcgcctgagccccttgagtcaccggcgggtggggtccacttgtcggcgccacctcttcccccctcggctgatgtcataattcgttattaattgtgtaataaatcgatattaattctagaaattcattcaaatggctcaaaacttctaaaattcatatctaattcatacgaattccgaattgagccattcaacttgcaaaattcatttaaaattgagacctacatgtttgtttactttttatgtactgtttccttggtgtttattagattttttcctcgttttgcgtgtcagcatgtagtttccgtcgttttggaagatcgcgctcacaagaaaaagagttcggaagatcgtttgaagaagcaaggtaagtcacacattccccttgagcatattgatcccaatttataaatgttttaccatttgcaaataaatatgcatgttttgttaattacatgggattagggtttacctatctgctcgcttgtgccatagtatttgatatccatcatttgtctacattgggtgataattcgactagcttgtgttacttatgttaacctagctagatcatatatgcttagccatgcttaattaccactagctcataaaatgggataattaaatcattagacatttagtatcttgacgagctgcgttctcgagacatctggccatgtttcatggtcgtaattatccaactaaaatgcgactgaatggtgtgctatgggtgcatggttttgcaggtcgcacccatggcaattaaggactggttcacgggaaaccctagaagacttacagtgcttaccacaagctggagtgggtaactgcttgatttgaagtatagcttgaccctttcctaggcaccggtggcgagggtgggcgtgatggagttgggtcggccggggtgtccggttgtctagctgtcggattaaccgcggcgcacgagggactgcccaccttcgaggtaggggtgggggtgaaaccttagagtggtgtggatggttaggggagggttatatgaagggtcttgtcacaatcactcgacatggtgacgtgtctgcacaggcacggtaacatgccggtggattgtgtcttgtgggtacagttgtgcacctctggctagagtaaaactattcgaatagccgtgcccgcggttatgggcgatcgaccagattcaccgtgattactcccatccttaataattggttaatgaactggtgtacttcaggtggtttggttgggcctgttcaacgtggtgtaccgttatttagtggagatataatattactttaattactcaactgttttaccattttgctcaataaatgttttacaactgcctttatggaaatagccacaaacctccctttttctccccttgcacagtggtttggttggtgtggcttgctgagtacggtggttgtactcagccttgctattgttcccccttttcagaagtgtagtgcttctgagctgaagacgaagttagaagaccaaggctcagaccccagttgagctttgcatgtggaatagagatgaagccccgttaggatcgccttttccactactgtcgttctcttttggtgtgaggactaagtgcctttgctgtaagtattttacgctttatttacgtttggatctgtttattacttgtcattttgtgtacactggctggtcctggacagggatttaatacacaaaatagtctagaaatcagggctaaatttctgggcgtgacaaagtggtatcagaaccaactcaactgtaggttgagccaaatggtcaaaccctaaggacaagttttctgaaaaccttatttgcaaaatgtctcccctccccctttggcaattctttgcgaagcggtttattaaagttcttgtccatgtccctccaattcttttagttgtaaaacctggacgacaaaaccatcagcctcatgcctgttcggaagtcaagtcaagtctcaagcttcgtgcagggagcaaaagatcagttcagagtcgtcgttccgcgaagatcaagcgaagttttcccgaagtttaccttaacccaatctttcccggaagaatagtttcgttagctgatagatcgtgtgttgtttgcttgtgcgtaggggtatggtttgcatcattggtggggatgcgaccatactaggttgtttgcttaagcaacttgaacaataaaagtgtactcacaacagatcagaagtggtttaaggtcttatctttagcaacccctctcttccatctatcttccatcctggtagcagatggtcagtgtcagggagaagagcaacaatgacagtgtgttaaagccacagatcaatggttcagttgaaagctacaaggtaccccaatgccagaagaacccctgctcatgatcaacttttggtgtccaagattagaagatgggtgtattgatgtaggagatgcaaagctcgatgcaaggtcaaatgtagcggaagtaattccagcagcaagtttgttgaggtcagagccactagatcagtccaagacaacaagctaccagttgagtcagagtccctcgctctggatcggaatctggttagccaagatcagatggtggatgtgtcagttgttgatgcagcagcagcagagttcgatgcaacagttacaatggtagtgtcaccaacaacaaatccaagctcagatgcaagcccggaaccagaacctgagtcaaagctagtatatccaagttagcaagcatttgcaacttcaaccaatgtatcgccaagtccctagcagacaagcacacctatgcatgctatggttatagtttaaaagggtagttcttgcaaggtgttcaaccattcatggaagacgtacgacatgtcacttctcagaaggtcaaggcgtcagcgtcatcacatcaacagcttcatttgcaacaccctagctcctcaagttgtgccagttccaatgcagagtcagtcagatcagttttgagaaataaactatgcaactcgacaccgaagtcaggccagaagcagaatagtcatgttagccattacagctgatgcagaagttaattagtagccaataagttcacgagctgaataagggtcacttttatgtggattttccaatcgacaactgagtgttaagtcccaagcatggtcagattggaagtgcaccaccttctgtcatttgaattacccggtgaagtatctagttttcaaagccaaggtcctttgtaaatctaagaagtgttggttatttttcaaggacaacagttcaattgttcccggtaaggcgaaagtatgactactcactgcaagtggggtaggtcttagagatgagttttggctcacctcgtcgccgtttcacttaaaggttcaacccagtgtagcaaattggttagtaattaaaggagtcagttgcgagccattagcagagttaccacaatctcaagtcgacaggttcaattctaaggtacacccgtgaggcaggtcaacagttcggtttagagaagcaacattagggacagtcgcaatctaggcaggagataggtcaagcaggtttcctggaattacttgtgattcgagtcaagaccagttcaagcggacatagggtcaatgagtaacaaacgccagatgcaagcttcatcctcttctagccagcaaggtgaattgtcaggttaccaaaattgtcaatatcaacaattcggtccaaggtaagtaagctccatgagcatccgcagtcctggtctgggtcagttcaagcagaaccagtcagttcatttgtttgtagtgatgaggacacaactagctcggatataaccatgaccaccttatgtattgatcaaccaaaggtgcatatgttctatattcgatttacttgttatatatttgaacaaacgttgctacacattgagtttcgtgtgttttcgttcgcagaggtacttgcttgggtgaaagaaaagagaccgagtgtaaggaatgcatggatgattgaagaggttgattggggactaaaccaagaccttctccagttatacttctacctcaccacatcacttttggcccatagaagacaagagattaagttgtacacgttttggattcggattcggacctcctgacagcatcaacttcaaacggatttagccgctgatatataaggaatttcggggcccatgagtacttgttggaaagcttattgagtctactttcagatatttttggtcccatgtcaaaattccaaccgagctgccgggaatctgcaaaacaagccatgtacctcatccagtccgaatctgatttggg

SEQ ID NO: 59481 - DNA, 1290 bp, Oryza sativa
tatgcgcacttgatatctcagtaatgtaatcgtgagtaccagactacttgatccagggaaatggtactattaacacgagtgattcctgttataaaaacgggggtctacacaagatcacttgtttcttgtgtgaaggaattgatcatgtaccaaaagattgtcaactcagttttctgctgacgaagaagatggccaaccaacatgcccgttctaatggagagaagcatcaaggcaacacaaatcctcgccaagattacagtttcagcctaactccagtgccaggacagaggaatcaaaatgagaaaagaaaatgccgagtccggaaagatatctgttgcttcagttgtcaagaaatgggtcatttcgctgacaagtgcccaaaaccgagaaacatggctgccagcacgtcagtccacgcaactccccgcaatcagaagcttgctcctcagcgaattgtcatccatgcatcccgaagcagtcctatagcacgcgttgcaacagctccaactccaacgagtgcactaccacaaggtgtcaatgcaccatttcagtcccatccacctgctgacgagacagaggccagtatctgcgttgtacctttggatgttccaatacagcagctgataaatcaagtacaagatgaagaacccgagtgtaagaaagttattgtttgttacaactgtagtgaagaagggcattactcgagggactgtcctcaaccaaggcaaaatcggcccccacattttcgccaatttacaggaagcaaacatgccaatcgccaagtggtcactggagcaaatgcagtacctgttaagcctagtgctagtcaatagcaaccataatactcttatatcggtgttcaagtacttttgttttatagctgttccctgtcaatcatgtaataacagaggaacatgagataatgaatgagtttgacaagtttatgaaagatccatgttaagattgcaagtactgtgagttgtgtacattttgttgttgattaaggagacctagggtctcatttccgtaagctcataatctgttcaaaacaacctacgattgatggcgaagaaaatcaagtgatcaaccaaagagacatttgtttggactaagagtttcagatgtgtcttattcggatcaaaggcaacaatcgtcagtctagcttttgacgaactacttcaagggttctctgaaagacagcacgcccaaggacctcatcgccccagaagtatcctcaacacccggagtgaagagtacctggttgagaaaggtcgaaaggtgattaatgga

SEQ ID NO: 59482 - DNA, 5179 bp, Oryza sativa
gtacacctctgatcagagtataatctattcgaatagccgcgccctcggttatgggcgagccgagcaatgtacccaagttagtgttttaattcttaaaacctgcttaacagctaaaatgtggattggttggcctgggttggcttgggacgagctgggacccagggtcgggttgccagttcggtctgaatcatcgtaggccttgggttaaggcaggttcgtgtgggttcacggccttgataaataatattgtacagttctagaatcgtgtttacaaaatagctctgagcaactaaatatctttaaatgctgtttactgcaaaccctaaccctttatagtataactcctttgtactcccttgcatttattctgcatttgtgggtgtgtcttgttgagtacggtggttgtactcagtcttgctcaattttttcccaagcccagaagaagagttcctggaagatggaggttttggtgtctagctcgtgcctgccgtcaagcgcctgtggtcgtcgccctagtcttccgctgtttttcgttgtctttgagtgtgctgggccgtcgctgcccatgtaataattaactatttacgcttccgcttgttaaactctgatttgtatcaactgttggtgtaccttgcctcctgggacaaggattaatgcacgcacgtaaggaacgcccgttgggttatttccggtcgtgacatctcctgtgaccggcgacggcggcgagggggcggccgaggttccccacctccgtgcgcacctaacggcggcgatggcgaacgcgacggcgcggcgcggctgggcgtcggacggcggcggcggcggcttggacggcgtggcggcggcgctacggggcacaagaaggctcgggagttagggcaaacgaaagagggcgactagagggtgctatttatagccttagattggagagatcggactctaaccgcgagtaatcggaccgggaaaaactaggtttaggttttggggataaactcgaaaacgagtttgattcaggtaagatacgaagcgattagctccgatttttgggggtaaagatagaggacaacaaggggatcaaaacccctcaaccaatcggaaggcggcggctcgggcggactcggccggccggaggttgaagacaaccccgacatgtgggccccacatgtcggcggctgtgaggagggggaggccggtggctcggctgggctcggcgtgggcccgcggctcgcgcgaggagggagggataaatcggcccaacggcttgggggagggtttttaacactttttcaattaaaataatttgtgaaatgttgtttcatttattaaaaatacttcccttactcaaataattcccagaaaaatctagaaaatagaggaacaagcaaaatatttaatgaaattttatctagctcaattttatgttgaaaattttcctagatttttagagattaacttgtaggcttttaaaataatttctaaaaatgatttaaaatatgcattattaatttaggcgatttttagggcatgataaacctaccctccttaaacagaatctcgtcctcgagatttagaagaactggcaaaaagatgaggatgatctgacttcaattcatcttctcgctcccaagtggcttcttcttctgaatgattgctccactgaaccttacagaaccgtatgacgcgattcctggtgttcctctcgctcacttccaagattctaactggcttctcaacataagttaaatcttcttgaagctctatacgctcaggatctgcttccttcataggtacacgcaaacatttttttaactgcgacacgtggaacacgtcatgtattcctgccattgacagaggcaactctagctgataagctacttcaccttttcgactcacgatcttaaaaggtcccacaaaacgcggtgccaatttccctttggtttgaaaacgatgaactcctcgcagtggcgtaactcgtaggtatatataatctccttcttcgaaagccaaatccctacgacgattgtcggcatagctcttctggcgcgactgggcaactcgcaacctttcttggataatcttcactttttcttctgcttctcgcaagatatctgtcccaaacacttgacgctcaccagtttgatcccaaaggagcggcgtacaacacttccggccatacaatgcttcatatggaaccatttgtagactagcttgataactgttgttataagagaattccgcgtacggcagattcttataccaacttccaccaaaatctagaacacaggctctcaacatgtcttctaaaatttgattcactctttccgtctgaccatcagtttgagggtgataagcagtactaaaattcaaacgagtacccatctccacttgtagtttctgccaaaacttcgaagtaaactgactacctctgtctgacactatcttcttgggtacaccgtgtaaacataccactctggccatatataactctgcgagcttatttcccgtgtaggttgttttgacaggtatgaagtgagcgactttagtcagcctgtcaaccactacccaaatagaatcatgtcccgacgacgttctgggtagaccggtgataaagtccattcctatttcttcccatttccactctggaatcttcaacggttgcaacagaccggctggcttccgatgttccgccttgactcgctgacatacatcacatagagccacatattctgctatttctcgtcgcatgctggcccaccagaattgttgcttcaggtcttgatacatcttagtgctcccggggtgaatggaatacaaagtttcatgagcttctttcatgatagtatccttcaactccttattgtcgggcacacaaattctttctcctagccacacaattccttgctcatcttccacatatccgatggcttttcctcttctcatgttcttttttatttcttggatatcaggatcattcacttgagcttatctaactcgatcaaactgggtaggttgagcttctaaagcggcaacaaaacctttgttgactattcccaagttcaacctttccaattcctagcataactcccaaggtagatgtcatccttctgacatattacagtagcttttcctgctgagagaatctgctaccacatttgctttacctatgtcacgcccggaatttctatccaaaattccaaacgcttacatgtgtgtgaaccctcgtccaggaatcagccgaggcacacaataacaaattgataatagagtacatttattactctaattaataagcgaataaaatgtcattacagaggtagatagttcctctcaactcaatcaataaagatctaagcagcggaaaataagataaacggcgcagacggctccacaccacaggcagcttgaccaaggctacacctaatcctccacaccatcagcttcactgaagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaataaaacagttaagtaataattaaacaatattaaatcaacgctatacaacataccctgttgtataggcccaaccattctgaacaaccatcccggctgcacagttctatctccaaaccaggaatataccattccaaaccaggagctaatcaaattattaccagttatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttacataacacaatccaccgcagcgcacctttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatgagtcataagttatcccaataatgtgctaatgtttctaagcagggctaagcaattatatctaatatctagttgaaccaatatacatagcccaactagtcaagttataaataacccaaggtatcaaggaataaagtaatcaagaacaaaagggctataacaaagaataggttaattccacccaatgacattcgaaaataaatgcaatagttgaatagaaacaatagcttaaaataggatcaacatgctcaaagggttgtttgggatctgtgtgacttgccttactggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaagggatttattgcgtcagcgggctagggtttcggtggaccgggcgcacggcggcggttcacgcgaacggacggccgagatcgatccatccaaaacggacgtgtcgagatcgatcggtccacgaccggctcacgggagacggggacgatgacgtcagcgatgacgtcaccaccggcgtgcggcggctcggcggctcgacaaagcaagcccgccggcgaacggcgacgcttcggcacgaacggaggacaccaacgggtagagcgcgacgcgatgaactcaccggtg

SEQ ID NO: 59483 - DNA, 4980 bp, Oryza sativa
caactttgttattgatgactttttcagttgaaatcatttagtaattataaatgttgtttgaaattgtcataattttaaattcaaattcaaactgttcaaacgaagtcatatataaaaatgaccaaaataaaagatgaagatcttaataagttatacaactttgtagttgacaacttttccatttgaaatcatttactacccgaaaaattatttgaatttcttatattttaaaattcaagttttatatagtttaatcaaactcggatggagaaatgaccaaaataaaattggtagatctcaatgagttatacaactttgttttcgacaactttttcacatgagttcatttagtataataaaattcgattcgaagttttaatattttaaaactaatttttttccctcctcatccttccaaattttttcatctcctcttctccctcccctcctatcctgatattttaccttttaattttccccatccttatcctattcctatctctcctctcagcctctcactctttcctcctctcctctctctctctccgacagcgaggcacggagcgggagcggcggctgctgcgcggcgcggcgcgtggcagcggcgggctcggcaccggcggcggcggccttcctcgacctcccatccggcgcgacagcggcaggctcggcaacggcggtggcctcccttcaccaacctcccatgcgcggtgctcccttcctcgacgtacggcagcgggcacggcgacgacgacggcgggcacggtgacgacgacgacggatctggacggcgggcatgcagcggtcacggcgacggcggcggcggcggcggatgtggacggcagcggcgccctttgctctcctctccaccgagcgtcgccgccaaccctagatccgcctgcagctcctccgctcctccacccaccaccgccgtatcttccctcatctggccatccactccggtgatgtcgagcgcgtggtgtcgcaagaacgttgcctcgtttggtgagaggggatagtgcagcgagccgcctccaatcccttctgtcccactgctactcgctgtcgcagagaggagatttgtccgaccgggtttcatgttaagctgtggctttatttcccaccatcctcagtcccatcctatttctctttcttgttcgagcaatcgaatctgatttaaggatctgattttctcttgctaattttcaggagtcaaccgtctatttgctgtcccgtgcaccaacacgaacattgacccgatttcattctgacacagtagtagtaagtatcacgaattgtgcattttattctaaaatgtactagatttatatagcgtttgtcacacattgactagaatggatctgtttagttaatttgtctgctgtgctgctgattttaaaagtttagtgtatagagttaataaaaacgtgtgtgagctgatagtttgcaggagtgataaaattcccatgtgagcaactttgttgtttttatatcagtgcagtgtttagtaggaggaaatgaattaaaggacaattcaggggttgggttggttgggtcagtgaagaaatcagcaaaactgcagtccacaagatacaatgaattatgcttacaaggtgtttgtgttaatgactgcaagttgacacttcacagcatgtcctttgcattttaactacaaaaggtcgtgttctatgcatgctaactcgtgctcatcactagttgatagatttgtgcagttatttttccctgattattatgttatctcactatatgatgcaaaaatttaaagctcatgttatctcatgatgtgatatgctctttatacaatctcttagtagttctccaaagtgcctcaccaatttgtgactgacattttttcccaataaaatgctatgctgactatcgcattatatatctcatttttgaaacacaatagtatgagtacttgcttttgattttgtatcgtagtcattcactcaatatgtatgctgccttgttgtaaaaacagggtagtatgaattaaatactgaagcctagaaattcactcccatagtacaactgtaaatttgtaactgattgaattgcagtaattgctttggtactaataggtagtgtaaattggtattggtaactgactgaaacaatactcacttctcatatcctgtccatgacatctactgttcatgctggctgtttatcttttcatgtgcagattctagtattccactcgggtgtttcctgcaataagctgagtaagtaattttagacttcagtgagcagctgtagattaatttatcattatcacattctaatagtttattaataggattcatgtcgataaacaagtttacatttccttgcctttctatcatttgaaattgtttttagttaaagtaaacggtatgcccatggaactttatcttgtgctagattatttttctttcagcactgctcagtaagctttcatatttaccaattatcggaaacatctgtcaaatctagaatttcatatccattctgtttctaccaatcgcacagtggttttacacatgtgttgctatcttgtctccttaccagtatctaacaattgcaaggatctacactcaagtattaactcaaggcgacaaacagcagccacccatcatcttgactgattcgatattgaattattgatctatggaagaatttgttgctttggtctgctgatagatatattaagatgaaatatatgtagctgcttcatctgttgagatgtcacatgactgtctgaatttgtagattaggcaagctagcttgtcttaaagctttgatatttctttaattaacatgtgtatgttgaaacctaaatttatttggtgaattatgtagtttcaccttatatggatgtgagctgtggtgtatgtagcatgtgtttcttttctgatgaaataagtgacaataaaaaagaaattaaatggaaatcagaaataaaaaagaattatatccactgtacaaacccagtaacgattgcttcccgtgtgtttattttactatatcacacggtaacacactggagcataccgagagttttagtcagagcacggtaacacacttgatgatactccctccgtcccataatataagggattttgagtttttggttgtaatgtttgaccacttgtcttatttaaatttttttgaaattattatttattttatttgtgacttactttattatctacagtactttaaacacaacttttcgttttttatatttgcaaaaaaaaaaaatgaataagacgagtagtcaaacgttgtaagcaaaaactcaaaatcccttatattgtgggacggagggagcaccgagttttttttttgcacccgggaacctactgttcatttgacggtgaactccgttacgttaaaatttgccacgtggtagggataggtgttcccgtgagtttcaggacacccggtatggtcactagtgttaccgtgcgctttttgcatacccccacgggaactgagcacggcaaagtggtgaagccgccgtgtgttcgttaccgtgtggtggcacacggtaactctgttcccgggcgtttttggcttgttaccgtgtgtttttgacacacggcagcttcccagcctctttgtaagatatcgaaactaattattggatgaaataggatggtttccttcaggaaacagccccaatacttttgagtctttagaatccaatctgttgttatactatactccatcttttgtgtcgacctactatatatatctatcctatagctagctaatgagaattaattaagtttcagaaggaggtgtcaaattaaaagtgatagaaatgataagctgtcttaatttgcatttgaatgcttgtgtgcgacgcaaacacgtctctgcaggccatcgctagctattcgatcgcatgcacgcatcgatcctgcatgccgtatattgatgtacatattgatgcacatatatacatgcatgcagatcgaataatcgatggagaattctagatgacaagaataaaaatcaacggtgcaagaaactgaatcatgtatcagaaattagatgtaatcacaaagtcattgttcagaaattatgattccgtagtacaaatccttatacaagtatcggaaagtgcaagtgatctgaacttacccttctttaattgacttgtgaagaatgaacagcaccaagcagagcagccgacagagaagtggacagcacgagccaggtcacgtcgccgccggggtacccgcgtcacgtggaggatctccgccgcccgggtcgtctttgggcgaggaggatagtcgcctcctcgtcgcgggtaggatagccgtagccgggatcgtctcgccactgcgtagggttggctcgtcaccgcgtaaaatcgggcggcgtggcggctgaggaggaggaggaggagacaactgcggcatcagagggagagaggggaagagatccacggcggtgatggcgtcaggggagagaggagaaggtggcggcgacgattagggtttgctcggagagaggttgggggaaggaggggcgacaggtgggagactgggagtcgagtcgggagtcgtgagccgagagggagagcgattgggggaaggagaacgcgtctggaggaaaagcggcgtatactgaggtggaaggtggagacgatcatgagtgttagatctcagcgagataatctggaccgttccatgatgaatgaaggaatgaaagatgagtgaaaccatttgttgaactataaagtagatatagaggaggtatagtgttgctcatgagttggcgcaacctgccctgagaacgaaacaatgtgtggtttggcgattccaagcttctctgtgtgtatctgagctcctacctggcgaatgtaatctttctgaggagtaatatattttcccttttcctcgcgaaaaaagtcacatgaaagcattttaaaatattaggccgtgtttagtttgtgtgcaattt

SEQ ID NO: 59484 - DNA, 5681 bp, Oryza sativa
gagaaattgcacttgtaccgatcgctgtaccagcagaacagcaacacgctcaaaaaccgaagcctggcacgaccaccagaagagcctcaacctttggaactacgcttgcatatatgaattgtataaatgatccatgcgctgcagtactcctcgctgctgctggtcgctgcaactgcaaaagcctcatgttgcccgctggttaaaccgcggtcacccgcacccttccaagaggcgcacagcaactcgatcgaagcagtgcatgcatcatgcatgcattgtatggcagctagcgtacacacgcccgcgcatgcacatgcacatggccccctcgcctcagctcgccggccgctgccggtcaaacccggccgtgccgtccgtgtcctctccgagacgtaccaatcgcaagcccttgtctctgcctcggctgtttccgatccaagcacaagcacgcacaccgccgacacacgctctgatcacgctgctgccgcgcggttggtgtctctctgcgtgtgtgcgcgcgtgtcgtcgcgtttggtgtgcatgtcgtcgtttcggagagcggttagttctcggtaaagagaagctagttttctggtgggtaaccttcacgtctcacgagctacgagtacgacgcattggtgcagcatgcaggggcgtgcaggtgcagctttgatccaaaagccaaaagggagggcagcgagtgcctaccaaactgccgtcagcctgactgcatgaggggcaagacccggcacacgcgtacaagtatatacgtcgcgggttgttgcccgagacgcgaacgcattattttgcgcatcgccaggggaggccggcgccggtggaaggagtgaacgaacgatccagcgcgcgcggggccggacgccggagcgcatggaaaccaccgtaggcgcgcggccggtagctagagtgcgctcgggcctaatgtgttttgggtggaataccggggtacccggtaggccagtacaggccgggttggtgtaatcatgggtatatgatttcatccaataggatttaaatcattgtgcccacgtgagtattacgcattacgcatatgcagttgcgtcttcgcacccatgatgttttgttaaaaaaattagtcgatcacccaaaaacgctattagtcatctactcatctgcatataaccgtcgacgtccgaaaaaattggttgaccactgaaaaacgctattagtcatttaggcttcacggtaccgttggctccaccactacatgtgcttatagtcggtttataatattatagaagttgtttgcggttatctatccgacccattaaattttaggtattgttaaattcttggtaagttttgacactagtaattcttaaatagagttgagatggattatacatgtttgaattgctatccgtgtgaagccaaatattgatgatgtggagaagttttttattagtacttatagtgtactgtacactctctattacaaaaatataatgtgctttagctttttatatggtcgctaacaatgtactcctacttggcaatttgtttcgtaaaatatcattagtgaccactgaccagtgagaagccaagattatctcaagtctagagctgaattactgtagtttttcatatactccctccgtatatgaaaaaaacgttgttctagccataacctcgtttgcgatttaaacgacgttctgaaccgcagcagactatgtggacgaaattacccttgtgtctattcgatagccgctcccgcaattaatccgcagcacgcccgcgctcgcctcgtttaattccttaagcgtcgcatgcaggcatgcaacacgccgctcaacctcgccgctcacgcttgccgccgccgcttgcgtcgcgctcgccggtcgcgctctcgtcactctcgccgccgctgctctcgtcgcactcgccaccgccgctgcttgcgtcgcgctcgccggccgcactctcgtcgcgctcgccgccgctgctctcgtcgcactcgacaccgccgccgcttgcatcgtgctcgccggccccgctctcgtcggccgtgctctctcacgctcgccgccgccgccgccgccgctctcatcgcacttgccgctgccgctcgcattgttaaagtagtagagattttgattgtgtttttttcatcggaccggtaacaacctgtcgtgtttctcccgcaggaggaggcctgccgggcagtccgcggttgggccggcacacgcgtagtacgtacgcgcgtacgacgtacacatacacgtcgccgtttgttgccgtgacgcgtacataccacacatctcgcgcatctctcatcgggtgcactacgcagcagcccagcacgtaggcagcggctcgctgccggtggaatagttgagccggcgcgtacatgggcgcgcgggctcgccgcgtacatgcgtgtaggcagcgccgcacggcccggccgcgcgatcgcgatcgcgacgagatcatgagatgacggaggagcgcgtcacgcccacacactccaaagattgtccctatatatatctttggttactcttcatcaggcgagatcttgtcgatcctattttcgtacataagcggtaaaaataattgcagtgcccatgttatattttgaaccgctacaaattactatgtgcagaaatattatgataccactaatcttatttatctctgctagagtccccgcgaaaaaaaaaagaagaagaaagaaatctctgcaggagtgcaaccaaacgctccaatgggcaatgggggcattcggccactgcagagagaataaactgaaaccggtgcatgacctggctaaggagtaaatgcaaaaaacatgtaaatttcccgaatgtatcgatgaccattttcgttttgtatcaaatgttttgcctagtatactgtatagtttttttttagagctagtatactgtatagttgaatcatctagaaacggaaacccaaaatagtaacagtgtcccataaacaacaaataaaatgatatataggacttttttgtttacttgttttgccaatataccattttgtccagaatttttgagaaaccataacttttacaaaaagataaaaaaattatcgttgtacctggatgttgttatgtttacttgtccttatattcgatgttatcgtcatgcttagggatggcaggttttcccaatagcgaggacccattgggggtgcatcgccctgaaaccgactagaggtagagcgggtttgatagtttacccacgaggccacatgggggccaaacaataacatagtaactatccatcaaaatatatatacaattgattattactccatcaaaggatggatcagtccatggcagcccatatgccatatgcaatccaatccatccaaccatgcataataccatcgtcgcagaactcgtgtacatcgcacaacgtgctacctagcacctctcacgctcttcctcctggtaccaatgagcaacggccgacctctttttcctccaccaactcgagcaaggagatggcccagcaattggcgatgttcttgacccctaaatgcccaacgattgcaatcatccctaacatgctgatcaggtctgctaattctctttattactccaccattgtgttctgcatgcaggctttgtcaagccatcgaccatcatccttcctccttgtcgcatcaactctcgtcccatgccttgcagggccctggttaggggtacgggaactcgcttaagatgagatgagagcatattttgccccgaagtagacgttgaggattggggaaggggacgtttcaggttcacccgctctattgtcacccctaaccaacatggttcgacactgttgttatgtcttagagtggacatggcacggccgggctaggtagatcgatctagccatctcagcacttaacccgagagctcttaaatatatagtttagcttgaaaaagcaatggtgatgttggggtcgtaggtgcatacctccacttatcaaggctcaaatcacggcgaccacgttgttaggagatcgatagaaatttaatgagattaagtatttatcaccgaatttcttctttttaagcgtgtgttaaaggaacaaattcacggatgtgtgagtggtttgtatgtgcataaaggtgtttatggatatgggtctaccttgtaatgaaatgaaaatggttgggcctatctctctttttctactgttttatagtagcaccatttgcaccaatacgaggacactcctatccttgttcgatccgaggaattgactgacgagggatccctgtaaagatggccggttaatcgcttatgtacactattgcagtgatgatgctgtactcgtaccgtatgtgcccctgctgctactgtacattcagctgcacagtgcaacatcagcctgtacgtgagacatggcagtatggcactactagcagtagcagcttgtatagcatgttcttttcacaagctataccggcgaatttcagaattcagatgatactaccacagcactcgacagagcttggtcgttgcgtaattattccgcgcaaccagggacaggcagtgagtacccaaagctagcctatcaggtgcgccgctgtaagtacgtgacactgtgactgtcactgtagccacagtactgcagacaaacgtcccaggatctgatgggctggaagatggggttcctgtacactcaggccggctgcatcatcagaccttcagttcaacacatcgaaaccgcacagactgtaactctggccggcccccgcactgtcgcattgggctcagcccatctgatctgtagtctacaggcgaatttttttcgtttttagatttttttttaatatttacagaaataatctatcgacaaaaaaattgcagaaatagcccctgccgccctaatggtgggcggcaagctgacgtggcagacgatgggtcgaccgcgccgtctgccgccgtcggccaaaattgcgattaggcccttgccgctcgtacagagggcggcaaggggctaattgcaattttgccgcccataaagagcttgcggccgtacttttttcatctgggtcccagatgaaaaagtacggccaaaagatttttctatgttatgttaataataaataaagaagtatttattggtaaacttgttaatattgttataaaaatgtattgaagttggttgttgcgcaatttcatatgttaagtgaggtattattttgtaccttattcgatgtattattactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggaggaaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctatgtggagttagaacccttctggtgtctatccattctctgtattgacatcacgagacctaaagacatgacatgccgaagtctgacattacacgacgaaacat

SEQ ID NO: 59485 - DNA, 7717 bp, Oryza sativa
ggtcgtgatttttgccgtacctgcgaaggcgtcgtttcccttggaacgcagagagagccagagatcgacagagccgagtactgctattgtatagttgtatgcattcatgtatagccccagggagcaagtatcccagatccacgtgatcgcgttctaagattatacgtcttgtattgcttgtctttgtgttactagtactacaaaaaagtacgtatctacttttcccttgcgattttgctagatctttgtcaacagattttcacccccaatatttgtcgtttttctatccgtaggatttgcgccatgattcgtgcatttccctgtgtggatgagaccgtgtggcctgtgagcagatggcctgggagtcaatgtgggccaatccatgttaaattttggattccgcgctattatgtccgtaaccgttggttgtttcctcgctctctttctttattctcgctctttctctacatctctttctcctctttcttttctcttctcgttttctccgtcgagagagagagctcgccggcgagagagagcacgagcagctccccggcgggagagagagagcgcgcgcgctcgctaggggagacaactcgagagagagtgttttttgagtttcttccctgatttgctggcatcattagcttgtgttttggttttttcaatgtcaatagggctaggtttagaagattcgggtcaatacatgacgattttttttgctcccaacgtatggatctgattcagaatcacttgttttagttttggaatccgtttaggttttggattccctaagtttttagttatagtttgattcagttcagtctagggtgttttgttactagtccattgtttgcaaacgaccagattcgatggtgttctatgtttttttttctaatccacgagggtttttgtatttttggttcgatttttcttcaggggtgttcatgttgggggttggattcaggggtatttgatggagttaaaggtttaattcgaggtggatttaggggttttttctaatcacccagatagttgatcattttttggatccctgcatgaattttcttcagggagggggtcagattcatgagttgattatttttgctttgatttatgtgtgatttgaatatagtagggaagcatcattgcaactttatctgaatgttgcatttcactttcagtgattagttgactgatctgttaactccttgcatgagtctgaatttttctgcatgtaaagcatttcgtttcagagatgatttatctgtcaactccctgcatatatctgaattcttatgcatctgaagaatttcgttttacatatgcatgctaactgaaccccaagtatgttttgtgttgccttctgcagcatatgaatcatttcgtttcagagatgtacggtttgatttcccagtatgctgagttgcttggttaaattaaacccaaacccctacatgcgttctgctttcttcagattgtattctactgtactatttgctttataaaattcctgtacatgttctgaacttttcagtgctgatctaaatgagttagcagcaagccaatacctgaacttggtccctgttgctttgagaaattatgggctattggttgcatctgctctttcttctcttctgaacttttgttcattgtcaatcgctcgtaaatcgtaaatctgtttgaattggcgctatttctgaacttgggaacataattggcactatttctgaattgggaacaggggatagcacgctcgtaaatctatttgaattgtcagtattttttgaatcttggagcaggctattgcacagtttcagtcgacatgagctttttaaaatctcatacttcagcaaactgaaaaataatttggagggtttcagtctaatgttgatctaatgcatttcaatggtagcaaaaccaaggtcacttgggtgcctggaggtattcacatgcctgaaatatctgtatgattttttttcttctttattctgaatgacccatcgtcccatcccaatattgttcccatgttaattatgtgtggagcttgttagtcagttaactcatttgctgtgaaatttaatcgggaggctcaacaacaacaccctgtctggtccattcccttctggtccattcccttctgcatcagctaacttgtcacatcttgttgtcgagtgattttaatatatgtgcacagaagtttgagatatgtgcaaattatgtacaaaatttaatatatgggcaaatttgtacacaactagagatatgactgtttggaccacaatgctctgtttttttttatcctaggctctaatctaattgttgtgctttgttaaacaccactgtctgaagatgattttcacttgaggaaaatcttcagtccattgtgacaaagtgactccttttctgaagaaattctttattttttgaagaaattcaagcatgcttgcagttttagcccagttacagtctatatgtattgtagttacatatgtaacttttgttatttctcactgtaactaactatagatatatagtccttgaaaatttatcaacgctacaatctctaatttgttgtatataattttatgctagattatattatctgccaagatcattttatggtgcataatgctaggtgagcatgataactgacctttcaatgttttcttgcttcttatttctctggacaaaattttgtcactttcatatctctccgattgcatatcccctgatttttcagactgtaacccatcagaccctgcatgtttatattatttgtaacataatttagaacttgttataataggggaaaatatttaatgctgctgcatgagtactgaatttttttgaagaaattcaagcatgaaagctgttatagcctagttacagttcagatgtaatgtagttacatatgtaacttttcttatttctcactgtaactgactatagatagataggtctttagatttttcaaagccgccatctctaatatatgtgctagattaaattgtctgtcaaggtcaaatatggaccataatgctaggttatcatgattatgacctttagttgtcttcttgcttcttttttcatcagacgaaattaatgttatctctttcagatctctctgattatgtatccactgttacttgagatcgaattgtaacagaacctgcatagataggttatttgtaatataatttagataatgtatattagacaaaatttttttgaagaaattcaagcatgattgtagttacatcccagttacagtcaatatgtactgtagttacatatgtaacttctgttacttctcactgtaactggagatagatagtttttcaaaaaaaaaaaaatcatgctttcatgtatacaaaattgtgctagattttatgactgacaagatcaaatttggtgcataatgctatctgtccattgttctcaccttcaagtgtcttcttgcttattaatttttctgagaaaattttgtcactttgacatctatttgactctgtattcacttttgcttgagcttctaatctatcaggcgttgcatgtttcaatcatttgtagtacaatttagaacaagtcataatagtaaaaaaatgttaatgctgttgcatgagtactgaattttttgaagaaattcaagcatgattgtagttaaagcccagttacagtcaatatgtactgtagttacatatgtaatttctgttatttctcactgtaactggatatagatatatagttctttaaaaatttatcatgctactatctctaatttgttgtatataaatttttgctagatgacattttctgacaagataaaaaatggtccataatgctaggtgagaatgattctcacctttaactgtcttcttgcttctcatttcttcagacacaattttgcttctcatttcatatccatctgattgtgtatctcctgatttttgagattgcaatatacgtgaccctacatgattaggttatttgtaatataatttagaacattttgtcataggcaaaaaaaaagttagtgcatgagtactgaattttttttaaaaaaaaatcaaaggatgattccagttataacccagttactgttcaaatgtactgtagttacatctgtaacttttgttatttctcactgtaactgaccgtagataaatagttctttatatatttgtaacataatttagagcttgttatactaggggaaagtgttttaatgttgctgcatgaatactgaatttttaaagaaatttaagaatgattccatttacaacccagttatagttagatgtacagtagttacatctgtaacttttgttatttctcactgtaactgactatagatagataactctttatatatttgtaacataatttagagtttgttataattggggaaatgttttaatgtcgcagtataagtactgaattttttaagaaatttaagaatgattccatttacagcccagttacagtttagatgtactgtagttatatatgtaacttttgttatttgtaactgtaactgactatagattgatagtttttgttacgagtttttctgaaaaagttacatacttttaactacttgatctaaagaaatttcctattccaagcacttttctccaaaagaaattcactattccaagtgcttttctccaatatttttacagaactgagttgtttttgtttgatttaaaagatgactggcagaatatggtgaagtcaatggggaaaggtaaaggtggattttgtgctaggtaatttgttacctggaagattatgtcttgttgatttcaacttcttgacctcaatgttcttggtaagaatttgcttcttcttctttttctcgttctcctcactgtctatggcgtgctcgatttgttttgctcgatctaggggatttgtgcgaactggtgtggtctccctgtgttattttgtttttttctaacctttattggatgtgaagttgatcattatgggccatgatgtattttgcagttatggcctgtataattttttgtattgttctatgggctagaattcgagcccatgtagttttgtgatctgactagtcagagaaaaaaatatgtagcattttttgtgtcctttggatcttaatctaacggtaggaaaaaatctgggtgattttgacccaaggatttgtcgacaaagacatagctagttcctttcccttgtagtattactccattattaaaaaaaaatggaaatacatggataacgagcgagtgcttcggtttcgtacatgatgggctctgtatgagatttggacattgcggaggggacaaagaaattggtcagggcatcaggcccagaaaagttagatgggctcaactataggccactctaaactaaaagtcaggtgggcttggcacagatttttccttttcgttttatgcttgcttggttgttctacgactaataacaattaacacgaaaatgccaggcgtcaaatgcccgatgggcccgagaaaaatcgggcgccgcgcagcccgcgccaggcgtctccaccacgtgcgtccagttgcaacagtcttccggatataacggaaacaccatattaagcgaatccgttttattttttttccaccaataatattgcaataatcttgtttaactggtccttatacaacaacaatccctcgtatcccttatcataattgtactattgaaacatacatccacttgtttttgaccacgatcatgaagaaaccgcattggagaagagtggatctatcccaccctaacaccgtctcgccatccctcaacatttactttgtgctgttgtccatagagagggtatgcaattttcaaaagttttatggtcatattttaggagttcaagttcgtagactatttataaatggattgagaccctatttatatgggaataaaatttttaaatccctatcacatcggatatttagacactaattataaacattaaacgtagactattaataaaacctattcataatcttagactaattcgcgagacgaatctatttagcctaattaatacacgattaacttatgtgatgctacagtaaacattctctaattatagattaactaggcttaaaaaatttgtctcgcaaattagttttcatttatgtaattagttttgtaagtagtctatatttaatactctaaattagtgtctaaatacagagactaaagttaagtctctggatccaaacaccagactggagcctagtactacctccatattttaatgtatgacgtcgttgactttttatctaacgtttgaccattcgtcttaatcaaaaaatttatacaactatcatttattttattgtgactcgattcatcattaaatgttctttaagcatgatataaatacgttcatatttatacgaaaaatttgaataaaacaagtggttaaacgttggtcgaaaaatcaacggcgttatatattaaaatacatagggagtatcagataaccatgctcagacagaaaccatgtgttggagcacccaatgtttcgcggtcgttatgggattctcattatctgcagatgatccctgtcctcgcggtcgtactagtcctcaaacaacaactttgcaccgtactgctgcgttcggtagtacgagtgtacgaacaatatcgacatcaaaccgttgccactcccacacgtatcgcttggccgcacgaacgcgtacacaagcctaacgcaacacgcccatgtgtgtaactgtaccacactgtttagactggtccatgggccagccaatgccatccccacgaacgaaaaatagtttttgaccggtccggaacgtcctttttagcctgccgtgtcacgtcttaaagctcttaattatccgatcacgagaagggaatacaaaaacacacacaaacacgcataatatgaacgagcagtattgcgaccgtgacgcgcaggatggaattccaggtaaaactacaaggtaggagtcgcagattgcaagcttgactcgaccactccggtcactggcctagctgtagctagcttgctgacgctcacgtctagtagtactggtcggctgctggccgagaggggcactgctgccgacgtgacatacgaagcttcttttatcgatgatatatataggtagaccgtccctcttatttaataaattaataaaaaaataaaaaaattagtcacatgaaatattattcatattttatcatctaataacaacaaaaatactaatcataaaaaaattttctaataagacgaacggtcaaacattgaacataaacaatacaaaactacacttattttagaacgatagtactgctactcctcgtcctgaaataaataaactgatataaaataagatactccctccatttcaaaatgtttgacaccgttgactttttagcacatgtttgaccgttcgtcttattcaaaaatttttatgaaatatgtaaaattatatgcctacataaaaatatatttaacaatgaatcaaatgataggaaaagaattaataattacttaaattttttgaataagacgagcggtcaaacatatgctaaaaagtcaacggcgtcaaacatttcgaaacggagagagtatattttactagtagtattataaatctgaataatttgatttattttgggttaaaaggaatacatgtttaggttcgtgcacccatgtttagtcgtaaactagctg

SEQ ID NO: 59486 - DNA, 717 bp, Oryza sativa
gaaaagatgtgctgctacgaagtaattatctgatgaacagtataatcactgtataagtaatgtttatcaaatgttcgcgtttgccatagcagagacagaaactgtgcgtgcatctgcacacgagagcatgcagtttctcagttctcacggtaatcggaggcgactgtttggtttcaggtgaccgtccgctcactaactggaggtttgaacggtggttggatcagcccaaattcaggtcttctcactgtaccagttcagtccaagctgccatcttcttaacacttcaagaagaaccaaccaaaacccacctcgctaacgccacttaaatctcctgtgatcttgtccatcagattgtctaatgcgtggtgagatcttcactgcaacatttggaatgaaaatgacgatgctgtagccgtgttcattatttcacattctgttccgggcgacagattttagctgaaggcatggatgaaccaggtgaacctttgcttgggctagagaatttcttcgacgaagatgttgatttggtaagtacatttgttaggatgtcgtggatttgaagcattctttgaaaaatgccgtgattcttgtggatatgtgacaggagaatctgcccctggaagacgtttttgagcagctgaatacgtttcagagtgggctcttatcagcagatgctgcagaacgcttgaagttgtttggtgcaaacagattggagga

SEQ ID NO: 59487 - DNA, 1429 bp, Oryza sativa
ccaaagttattacttacaaaagatatgaagcccagtttcataccaatctccatcttcatccttccaagcagctatctgttcaaggcatttccccaaaaaaaaaaacaataatccacaaatgctactaacagtgaatatgagctattaagataaaggcaaccaaaaaaaaaagaatgaataccaaaaaaaattaaatgcaacataaaagcataagagtaaaacctttccacccaaaacatcccttgcctcaagcaatatgggtttatgaccagcatctgccagatattttgccgttgataaaccagctaatcctgaaaaaaaaatcaaagctaaaaactacaatgctaagaccacgatgtgactgctatcaaagttagatatatatgtaaattattcatctgtcaaatcctagaattatatcatacctgctccagcaatcacgacctgtaatggtttagtgggttgttcactgtttctgaaaaatgaagatagttgtccagcttccaaaaaggttattggttttctagtggagggcttggaaaggcctggcaaacaacctgcagaaaagccaatcaaatatattttcacaagagatggaatgtgaggcaataatagagtacaaaggttgaacctgtagagcaccgagcctccgacggaatctttttcctttattccttaagacaagagatttcactccaaagctcacatgctgactacttttcagtgcttggatgctgctacttgcgaagcacctatgagtaggaagttgtcccgcaaagatcttgcttggctggttccagttatgttcatagatgacaggcagccagtatccatgctgaagcaactcctaaaattatattcagatctgatttgacaaataagcacgcaagagcgtctgcaaaaacaagaggaaccattaaacacacaatacacaaaaccgtttgttatgaaagtcagccaagtatcactgtatcagtatgtaaatttatcaagtttgtcatcactatttgatgaaaaaaaaaaaacgagccaaagaaacagattctattctagtccagtcgtcaaatggaaacatagcatgacaataacaaactgatgccaaaaggaaaaaaagagcaggaccagctgttagttgttaaagctatgtggacagtggtaatattggtttactccctaatcttccgagtttctctatgtggctgcggccaatcaaacttttatagttggagagaaacatgaaaggaaaactgcatatgacccgcataatttggttagtgaagtaaatggattggaacagatcaagcatggcacaaaaagcatgaaaggctcaaatgatatcacactagggcagggcagctggagaggacctcgtttgcctcctcatgcaaaagtgggggttagcgcaaactgaactcacaaccatgcgccc

SEQ ID NO: 59488 - DNA, 2852 bp, Oryza sativa
cgcgacccgaccatccatcggccatccaatcgcggcgcggagatttctcactaccgatgactcgggtaactcgtactaggtggaagcgagccggaataatcccggaggagcccagccgtgagctgtccccagcctggactccaacgagagaaaacacacactaatcacaggcgcaggtcacgctcacggctcacatcgcgccgctgacgcgcgggtcccccgtgcaagttgccgtgggtgcgcatggctggatgacaacgagggtttagattagatttaatcgtggcatttggagggaataataataatatacttctactccagtatttgtatgacgaggcgattaggataacgtatggaactggacaggtcatcagttttcaaaaaaacaaaaacaaaaaaaactggacaggtcatccatcctttgattcctttccatgctctatgctctattttcccccattttaaaaggctcgcagcgcatatgcagtcaagatcgatcgtcgctttttcgtgctccagctagattagccacctgctgcagtcctgcacccacccgtgcgtgcccttcattttacttaatcttttaattaccagtaccactaatctctacagttcttgcacatgagatcgcatggcggcatgggcatctctatgacgacctgaccttcgacttggaggtactactagtagtacgtgaggttgggcattggatccccgagacattccgggctccgctcgtggagcgcacagtgcgcgcgatcgacagctcgctcgcgctgtcgatcggtcgccgcgatccaagatgtctacagctccggcgcctgactcaccaacgtgaaacggctccgtgctgctgctgctgactggtgaggaatgagtccgcgctcccgaacaaaattaacgatcgatccgtggatggatgatggtgactcgatgccgccttggatttgatgcggtttttccatgtcgtcgttggacgtatatcaagatttcaagaggtgagaacagcacctagctcagctggtagggagctgctaggagcaacgtgctagcctgagttcgaatccgtttgagcaacaggttttctcaccatttcatcacaacacaagttaggccctgtttaaatcccacctaaaattttttcaccatatcatatcgaacacttggacacatgcatggagcattaaatgcggacgaaaaaaaccaattacacagtttgtgtgtaaattgcgagacgaatcttttaaacctaattgcgtcgtgatttgataatgtggtgttgcagtaaacatttgctaatgacagattagttaggcttaataaattcgtctcgcagtttacaagcggattatataatttgttttgttattagactacgtttaatatttaaatgtgtgtccatatatccgatgtgacacgcaaaaactttacaccctggatctaaacaccctcttagtactaaaagtatgacaaagatacacaaagtgttgctaacaaactgttggtcgcagaagtgaaaagatttatcaactactccctcctcccataatatagcaacttagtatcggatgggacactttatagtatcatgtccggttcgttgtactgtgaagtgtcctattcgggttactttattatgggacggagagaatagtacgtgacaagtatatggcatatgagataacaagttagtaaagtatggactgttatagctatagctatagtaacggaagaggaacggtatgtttaacacatgacatggcgaattagtatgacaaaacaaatactctaggtttctattagggctagagaagaaactcagtttatatgttcatgtttcaaaactagtatctagagcatgtttgatatggtttcagctctagctctatttctctttatttctcttaaagttaaaatctaactaacagttccaactatatctagaataggaatagagtggattggagtgatctgaaaaataaagcaaagaggtgaaaacggattaaaccttcatcggttattcatattccctaataagcctatacattacaaagtaatctataggtaaaccttttatatatttgttcgtaatgacttaaaagtcaatattaaaaaaattacgttgaaaataccttaaactcaacttcaaatataaagttcgaaaattctaattttagcttttgatttggtttattatgtcaactgatgaggcccttagccttattatgggatggggtgtctagatacattgaccaatcctaggttgctatattctgtgacggagggagtatttgagttacttttatactccatccgtccaaaaaaaccaatccttgatttgaacctagacacgtataaaaagtccaatcctaacaatgaatctacacacacatgcgtctagatttatagttacgattgtgcttttttatgcaacggaggggtaccttttaaagctattattatagcaccccgtaatggcgataaaactaccttttattttcaccggagttagatttccataaaaaaaccccaaaaacgatttcccacttgggacgaaaattataaatgacatttccatcaatttagttacactgacaggtgggcccggaccaattccgactagtcccaggtggcccaggtcccagcctctgttgctggaaagcagctagtactagtttggaaccagaaaagaagcaaacccaacgaatcaaccaaccgagatctccccactcatctctcatctcgtaacagcccaacccagccaagcaaaagccacagagccgcactgcccgttcggatccggctagctagcctccagctcgccttccccttcatgccagcacgctccc

SEQ ID NO: 59489 - DNA, 4540 bp, Oryza sativa
ctctgactagaaatggctggtactggttcctattgtcttgatgttttatcctgcactggcagatccaggcacaaatcgtatgaatgaagcagatcaacaagcacctgcaaagctgaaattgcagttatttccaatcaatgaagccacacgaaaggcattggaaaaggtaaatatgcctgtttgttgccaccaagctgcaatatgaaattatgaatcatgtgtttcctgcagcagctgtgttagcacaacagctattactgatttactattggctcggacactcaaatcactgtggttgataaaatttctcaggataaatgggactaatggaatgtggagtgcaaataaccttactagcactatttaccttatgaattttcgatggtgtttgagatattgatagtcctatcttttttcaacaggatgaacataatccacatctggaactcacagttagcgctaggaaaaaaatatcttctgtactagaacatcttaaccgcaagtggggcagctcaaacattgcgtctggagagcttttgctttttccatattgtgctcaccgagaagatttagctacctatcagagatggaccacaagagatacagttgtggtggctgatgtttttctttctgtgaatagcccgcctgtttttcgattaaggtatggatgaattcctgggtaacaaactataatattgtgataagaccatttgttgaaagccgtaacaagtgctaactgttgtcgccaataaggtatggttggttttcccttgctgagcttgaaggaggaagtggaatatcttcaactcattttaagaattgcatgatgcctgaagacatccatgccaaatctccctcagacgcttgtgtgcagaaggatggtacttttctcaatagttgtgctcctgaggaacacctttgtaattcaaaagatcggccggcattatttcttgctatgacatttagtacaggcaagagcgctaaggggcaagagcagcacagtgattttcccgccttatggtttagcaggcagaagcaagaaaaagattccacaaaccaagttttagaggtccaacttcagttccatccatatttttgtcaagtgaacattaatctgctatcttctaattgcttctgttatacttcaggctaatctggggatggattgtgctataatatctgaaggagagtgggcagatacccttactgatatcagtgttggatacttactaacagaagcatccataggtactaatacagattgtccagggacagctattgccaaaaacacattgtttcttgagaatccctgcagctatgattcatttgatgctgctgttgctcttcacgcttctcgtcataaaacagtagagcagccagcccttgcatcccattcgaccatctggggtgctgaagaaacctgtgatgagttcagttttaacttggcagcatctaggaagcaagaaagttcaaacacttcagctagcagctgtcctggtagtgatagtggtgttcttcctttcacctcacaagggttttcaggctttcttcaggtttgtttccatctcttggtctcttgtagaataaaacgactttttatacatcaatgttgttaatctatgatttatttcatgtttgcaggacttagcaggagcaaaggttgctgataatccttgtatggatgatgccaaagatatggaggcactttgtgccaattctccacctcgaagtaaaagtgattctgggttaaaggatcaatctctagctgacttatattgggtactagacagatatcctatccctgcctgttttagtttctagtataatctatcaacacagatcataacttactatgtcttctctttggataggctgattcacttggaccactggacttagagataccatccgtgagataccaagctgaggacttactcttaggagacagtcagaatagttggaatcgcatgatggtgaatagcctggatgcgtttcgaaacctgtcattcttcatggcagataagaatgactcaatcccatccatcatgtagaactgtgaattctgggcgccgttcattgctctcgtcgcttgctatattggctagtgaagtactaccaaggatgcatctcgctgtagaggagggtttgcattgtccaagtgaagctgtttgtgggaaatccaacagctgcggacttgctgttctttgcagtcaagagggacgcattctgctgtgtaagatatatagtaagagctgtactaagatgttacatgtatgtcgtgtaaattgtggtgtccctgtacaaaaagctcacacaatctcttggttacagtaaagcttctgatgactgccgtgtatacaggtatgcttctgatcaattgccctgaactgttctcagttttgctttgatatctgaagtttatcggcatactgtgttgtttatgatagtatgcgagcagcgtttgtttcttcaaggcgacgccagaattttctgatgggtttggttaggctggaaacctgaccagtacatgcgagatcgctcagttgggcttctcccaattaattttgggccatacccataggtaatcttgtgcttctcccttcggccagattcctcaatgttcgctgaatatgtaacagcgattcaaggacatactcagacataaactcaggccctaatcacaacctatataacaagctacatcaagtaagaagtgtagaataattggctcataaggactcgtcaacagatgcaacttcccaaatcgggtaaaggtgtaatctgatcgtcgtagaagtaggaacaatggcaccagagataatatcgttattcgtaaagtaaagaactaagattcacaaataccatcaatatctattggagaggcagcgaatcgtccattttgtttccctttttttctctctctcgcctctctatttcctccaccatgaagaacacctgacatgtgcatgccatcagcaatgccaaaccagtacgtcaatttgataccatgaattcgtgccttcatggccacatcgacgacgacatcgagcaaagcatggtgattggtgagcgtagcacgacagtacgtacgagggccctgatgccgacaccatgcatgcccttgcgggcaagcaatcagattgcagttgccgctaaattaaagaggattttcaatggtagcagcagcagcagcagcagaagagcacgcaactgcagccgtccgtcgtgcggttcatggtggctacaagttagagagagagagagagagtagagagatttaactggggcaaatgagtgacccaaggcatggggatctcatgttgcacgccgagccatccttcccagcactcgctcgtactatgtgtagttgacgaggagagctatagatcggcacacgcgaaattcgtgcgttggtccactaagaaaaatctgatcgcactctacatttctcaaagcgtttcgatcacattggacggagccaaaatcatccccactgcctggttagacccaaccgcacttaatttgaccgacagaacgaaattgatttattacggtttgttctgttcaatgagaaaaaaaaaacccctcaatttgaaaagctaaaatttctgacaagatcaagatgtgaagtttaacacctcaccaaattttggtatagttttatgattaaaaatttgttgaatttttatatgttattccctccgttctaaaatataaaaacctataaccggatgaaacattttcgtctgtccagattcgtaatagtaggaaatgttctattcggtcgtaggttcttatattttgatttagtcttgtttagtttattgtcttatcaagaattgactatactaacatttggggcttgttcaaattgatgtcattttaaattataatatttttttaagtaaagttatcaaatatatgcatccatttagtttattacgaaactctagtaattaaataagaaatcatgctaaaacttgataatattattaaattgtctaaatttaatatgatttattttggttataatctgaacctgataacgttagtttcggcaacagatcgaacaaagctcttttaatacctactagatgagcatcgtgtattcgcgtccatatgtgccgtgtcatcaggacggataacgcacacgcatgcacgccatgttaccccgaacggatcacaggaggcgtcgtgtcaaccatagcaagggcccccgtcaccactgtagcagcacacgacgctcatcgatcccgggaagcttctccgtcgaatccaccccggttggttggatcggatcggaggagagccgcacgcgcagggccgcacggctggatgcagatgggaatcatgggatccgtcgcagcgagcgctgtggatgatgagctgcatgggcgccggcttggctggcacagcagcagcagcagcagccagcgcacgcgagattgaatgcgcgacgcgacgcgacccgaccatccatcggccatccaatcgcggcgcggagatttctcactaccgatgactcgggtaactcgtacta

SEQ ID NO: 59490 - DNA, 1011 bp, Oryza sativa
tattgttcgttggagcatggcaagaattggtcaaaaattgctatgagcatttcagctttcttttttttttctttcttttcttttttgcgattttcctcttaagatgtcatgctatttactcttgtaaatctgaatccatgcattggtgtctatgggcacttcaaatttcaagtttgctaatgtgtttgtttggtgacatactgacatgcattatacagtgttgcaattaagcccggcgaaaacgtgtagtaattatttgctctttttcatgcagttactgtcctcaatacgctcttcactatcctgaattctccggggcagctcaaaggttggcaggcaagtggtgaagcccttgtggccaatcatggcagggtatcacgtgctcaggatcatcagttactgcaatgtgagcctcatcatgaagcaaagtagtttactacttactcgaccaccttcttttttacttcttacaatattttctttgtgtttgatgttgtagcaaattaccaagcttggggctctccggtaatttggcgtacaatatgaataccatgggttcattgattgagatgtgagtatctgagattattcatatctgatcctgtcaagtgacaattcagttgataacagtcttaattgattttttaatgcagcgatatgagccaaaacaaccttggtggtggccaacagatacagtacaatcttcccactaataagcttgagaggctgtaagttcctcaaatgaagttgtggtttagaaagtacatcagcttttctggtgtctgtgtgctaagtggttattgtttgcagcaatctcgcaggaaaccagttcactggaaatttaccctactcgattttctcgatgtctaatcttaagtatttgtgagtatctttgcaaacatcaagttgattttgcttttaaatttgtataatttggtagagctaaatgttttctctttgtatgtgcagaaatctaaatcataaccaattgcaaggaaatataactgatgt

SEQ ID NO: 59491 - DNA, 619 bp, Oryza sativa
ctctgggcagccgagctccgtgcgacgtcaacgacagtggctatgcgggtgcggtggagctcggtgcggcgtcgatgcggttgtggttgctaaccaccaaagtggaggaagaggcagatttaggttttcctcttgaatattgtgatgttttagtccatgtaccatgatgtttcatcagttagatcaaaatgttgcaatgtggttttcgatggtgttccatttttttctcgatgtgctcggatttgtctcatgtttcaatacatttgaaactgttgcttctacgttgtagtaaaatgtttcattgtgtgacttgattctgtttcaccattttcagcactgaaacattttcaattcgatggtgttttattcttattctcgatgtactcggatttgtttcatattttaatatattcgaaatcattgtttcatacgttgtaaaaaaaatgtttcatggtgtaatttgattgtgtttcagcattttaaaagatcgaaacattttcaatctacttggtgaaacatttttttcctcattagtgaaacaacacccgatttttgacaaacaaatcggatgcccgatttgtaggcgcttcacgaaaaattgatcctcgaggctaacaaa

SEQ ID NO: 59492 - DNA, 889 bp, Oryza sativa
caccggagcgtcgggagagccggaatctaagcgacatacaaagcaaacaatacaaacaggctataagactactgaaacagagaacaaaaccatttttaatggattctttgcatttttcttgatttattgagacttgaatgggcttaaacggagctcggatgaattttctatgaattttagaagattcactgtgtttttactaaaaacatgcgggccccacatggcactggctcgaggtggtggtccgcggtggaccgggtccacggaccggggaggcggcggcgcaccacgtggcgctgacgtggcgccgacacggcggccactcgtcagccacgcgggcggcgagacggacggccccgatctaccgcccggtagatcggacggcggaggcggctcgcggacgggcgggcccgggcagctcaaaccggcccggcggccatggcacgcggcggcgcagcgcgacgcggcggcggcgcaaggcggcgagcgggcgccggcggagagcggcgacgacgcgacgacgacgcgggtggcgctggcggctgaccggctaggcagcgatgcaacggctaagcggcgcgggggagagagagagaaaagggaggggttcctcaccgacgacgatcgacgacgatgagcgacggaaagaagatggcgacgagcggctgagcttcgggatctcctaaggaaccaaaagagggggattagagagagagagagagagagaccatggatggttacgacaccggccgaaggcggcagccatggcgaagctcaccggcgtgcggtgcgaagcgggtgccggcgagggaatgcgacagcgaagggctggacggagcggcctgcacgacggtgaatgcgacggcgtcgacggcacggcggctagcgg

SEQ ID NO: 59493 - DNA, 17056 bp, Oryza sativa
gtgatgtttggaaccagatacttaactttagtctatatatttagacactaatttagagtattaaatatagactacttacaaaactaattacataaatgaaagctaatttgcgagataaattttttaagcctaattaatctataattagagaatttttactgtagcatcatataggcttatcatggattaattaggctcaatagatttgtctcgcgaattagtccgagattatggatgagttttattgatagtctacgtttaatatttataattagtgtccaaacatcccatgtaatagggactaaaagttttagtcccatctaaacagggtctaagtccttctaaatctgttactcatataactgtctaactgagataaagtttaaggttgtcatatcatatcatcgtcacgttatatatatgatccctgcacttctctttttatagaatggacgagactcttttttctgtatatgtagcggtcttgtactcttgttagtaccattttgcgtcccattttgacgagacgactggcgtgccattttgcgtcctggttcattacagtctaatttggtgacaaacaaacaaggaacaaataggtcccatggtctagcggttaggacattggactctgaatccagtaacccgagttcaaatctcggtgggaccttaattttctcggttttattttctgcctgagcttattgtcctcctcctgattttttgttgttgtctattttctctgccggaaaaatgtatcaaactcgtcgattctactcgtttgagagcttagtgtgatattgtccttctcctgaagtttctattttttactctctctgttatgaaaattttcatgctagaatgatttacattgtgaaatggagagagaactcgtttgtgcttatttatccttcccctgatttttttccacaccaaaacatatattgtgataattgagtatgctacgcgtctgacgtactacgagtttactccctccgtcccaaaaaaagacaaaccctgagttttcatgtccaatgtttgatcatattatttgaaaaaattatgaaaaaaattaaaaagacaagttacgtataaagtattaatcatattttatcatataacaacaatgaaaatactaattataaaaatttttcatataagacggacagttaaacgttggacacgaaaatctaggatttatttttttttatagagggagtacgaggtaaaaatcgtcctcagcgccttcagaaaaaaaaaggacaaaaatcctcagcgccaaccgactccgctccacagaccacagccgcccaagtgtgcgaggacaacggcggcggcggcggcggctaggtttttgctgcacccgacgccaccgcccaccagcgagtgtggtgggccgcggcggcccataaaagaaatatctaggcggcccatgtagcgccagaaaatatcttctcccccgcctcgggatccttatcctccgcctcgcgcggggtgccgtccgatcagatcaggacggccgcgtggggctataaaaggagggggggtagggcaagcagtgcctcctcgtgctctctttgaggtgggttggcttctcctccccctctttaccttttcctcctcggttcggttccgtggttcgtctagggtttagtgggttgagatggcggcgccggatgtcgagtaccgctgcttcgtcggcggcctcgcctgggccaccgacgaccgctccctcgaggccgccttctccacctacggcgagatcctcgactccaaggttcgccctcgctctcctacgccgtgtcttgtgatgggttttttttgggtggtttctcgtgttggctggatctgtgttgaatttgtttgggtttttttgttggtttgctcggatctgtgatcctggggggttttgctcgtgctgttctgatctcgttggtgccagatctgtgtggaggggttgatttggtggtttttttgggtggatctgatggggatttgtgtgtttttgttttggttgtttgcagatcatcaacgacagggagacggggaggtcacgtgggtttggcttcgtcaccttctcctccgagcagtcgatgcgcgacgccatcgagggcatgaacggcaaggagctcgacggccgcaacatcaccgtcaatgaggcccagtcccgccgctccggcggcggaggcgggggctacggcggcggcggtggcggctacggcggcggtcgtggaggcggcggctacggaggaggtggcggcggcggctacgggcgccgtgagggcggctacggtggcggcggcggctacggcggcggccgtggcggcggcggcggcggctacggtggcagccgtggcggcggctacggcggcgactccggcgggaactggaggaactgattggtggggcccatcgtggccagttatccttagctatccgtgtcagaatcatcttatcatcgagtcgagtcgttatcgtgtccagtggctctctcgagtcgagaagccctctatccatccatccagtgttaggtgttcttcgtccgtgatgttaccatgaattgagttcgctttggttatggtgtttgaactgcttgttgctatctatcggaatgaaatgaaatagaaaacaaggagaaaaaaaagagttcgaaagttttgttcgcataccatatatttccttccggtgcgcgctgtttattcctcgctcagcagcaagattgtttgatcgatattgcagcaagcaattacacaataaatatattgctacactggtacttcaaactacactggtggtcggtgattttcaatagcatgaaccttaattgaacatctgtgtagcttacatctccttcgaaagctgcaatgcttgagaacttggaaagaaattcttgtgatggcagaagctattcactgtccttcgctgcatttacagtccatacagacacagcatttccattttgcacaagatagagaacaacaatcagccttttaggtcaatcccaagtgtgcatcttactgattgtcgaatatgtgctaagaacctgcaagagagtgaggatttttatcattgattgattgtcgaatatatgctaagaaccttcaagagagtgaggatttttatcattgatggagctttgtttctgtaatccaagatttgggaaacagtttatccatgttagggaaatgatttatgcaaacaatattttggagcaaaagttagatagtagtatatgtctgccgacgacctcaacccaaaatattgttttgaggaactcttggattacagaacaaaatactgattccaaaatgatttatgcaaacaatattttggagcaaaaattttgtttctccaagaattcagagaaacaatcatacttttttaacacaaccatcacattggagatttcaaaacagcagagatgataggatctactctttccatgtcttcatccaaacttaattaagcttataattgtccttttatcaatttgcgaagaaagaatgaatgttgataagcagtcaatgcaaatgtcaattatatgaataatatctaaagtttagcatgccaactaaagcttgtaatatgccagtatgtttaaatgagagattgaaaatgtaggggagtatagtcgatatagactttcagtaaggcaagaagaaatgcaatgtcattatgttccaggataaaagggtcaacagaaagacatcatcatgatctcaagcctttgcccgcttcattaggaaaatactcagcagagtgtagaatcttttgagcttaatgaccaaaaatctgcatgaccacatggtaacgtaagtaaattcttttctactttcagtttggagatttagttgttcacacacctccaaattaagaaccaagatgcattgattcattctgaaggactgaaaaatggaagaaaaggaaatgatggagaagaaagaggagagctcgtgccatttggatctgttcagtttcgcccttagcagtgtcgatccaaattcagagatccaaaaatgatttgtgaaaaaaggtacaactttggtgtgattgaagcagccgatgacagaaccataagagcaagatgtacactaatggtggtatgatcaggattacctttggccaagctgttccaagagttgtaatttaggatacaacagaagtgcttaatgcatttggccagacaaacaactatcagcaaacgacgaaaatcatacagtatcatcactaaacactgaaggcgaatcaggggaaattaggagaatagcatacctctctcttttttacactcgttataatcgttcaaactgctgctggcccttgcttttgtcttggttggcttccaaacctgcagagccaacatgaagttcatcagagattaaccacacatgcatggaactctccaaaaaagtatgatgactgtgaagggggtcgaggagatgagggtcgttaagtgaagattaggacggatggattcgcttgagggaggtggtatactggggaagcagtcggaatcggcgatcctggcgacgctggggtacgggccgggacgtcgccgccggccgccgcagccgccgccgccgaggacactgggtgggcggagtcatggccacattcaccgtcgccaccatgatgtcatcttttttcctcctcttggacgcctggtccagtatcacgaacaggtagatcgagccgtcacaaacccgacgcagacatcgctaactccagacctcctcagtcttcaccctcttccccacctccagccagggttcactttctcgttttcggcctttgtatcgggcaatgccgatatgacgaaataattttggtccgaaatttctaaaatttaaaacaaaatctaatcaaatttgaacaaatgttaccaaaattcatgaaaaattaaaataaattaaaaatttcagctgaaataatatcgtattggaggggtccgaaatgacccgaatttccgaaattttgatcattccgaaatttccaaaataatttaggaaatttcagtccgaaatgtgaaaccctgcctccagcttctcgccgcttgcagccgccctccatcgccaacgggggagagggacgacgcaccacggggccgagccatcctcttcaacacttcaaaccatgaccgggtagaacagccgcagaaactcacaccatggcttaagctctgataaagagagcagatctgaagaaggaattggaggagagtgaaagggatttggacatgatggtcagtgtaagtggtgcacattttctcatgatctttttctcttgatttactctatagttctggcttatggatgatatttataccttatttcatctaccgatcagtcttgcatcatagtaaattatatagcgagtgaattgacagcctgctaatttgttccatgctgcaccctgcattttttttctcagctcatccattgtctgattgtttacatggaaggcttactctgttttggttgaaaaagcttagttgggagaatctgtcttttctttgtatgatataaaagtaacatactctttggacgtgctttttctgcattttttttttgccttacacacgtccagatgcaatctaaccaatagacgaagagagagaaggacggcggccggcgccggtggggagaagggccgcgatggcgaccaacagggatgagggcatgaccagcgggaaggagttaggtgacaaagacctcatgtcccttcgagcggcgacggtggatccgcccatcgcctttctcccctctccctcccggcatccttcctccctccccgagctccctggcttgccggtgagcgcacgtagagagagaaggacggcggccaatgaccggtggggagaagggcggcggacggcggccatgggggagaagagcgacgacgacctcatgttccctctccctccctacatccttctgcctcctcccctttccctcctggcatccttcctccctcctcgagttccctggcctaccggcgagcgcgcgcaagaaagagatggccggtggttggcggccggcggccgacggggagaagggtggcaggaagcggccatcggggagaagggcgacgaccttgtctcccttcaagtaacggcggtggagccgcctgccgctcttttccatctccgccgccgtcgtcaccgctggccgcatctggtgcccatccgcccccctctccggctctctgcgctcccaccgttgatgccctccccttttcccgcgtcgccgccgccaaacctccccgtgacctcatggcacctagagaaaagaagaggggagaggggagaaaggaggggggggggggggggggggtgttgagaatgacatgtggggcccatgtgggccacatcattttaattattttttttaactgacatgtgggatcatagttgtattattttccaaatcaaattaccacgtcaatgccacatcagatgaagaccgagtatatttagccacgtcagctaaaaccgccgtccaaactgccatgggacttatattgcactgattttgacagttgagggacgaaaatcggactcgttcataagttaagggacctcagatgaactttttccattcagtcttggggagtctaggggattatcggagtatatgggcctgtgaggtcacgtgctctggtgggcttttttctttttcaaaatgggcctgcgtaaggtttattgatttcatttcggccttttactaatttatgcccaacccaaaactttgtatgggtttcttttagatataagttcagttcaggtcccttagtttgtctatgaattcgattttcatctttgaacccaaaaaatagatatgatgggcccctcaactattaaaaccggtgcaacattagtctgaaggcactatagatggttgttttgtcctatgtcgcacttggactatggtcagcctacatggagcgccacataagcggtcaactctggtcaaacgcactttagaccaactatggttcactaaaacaagatcatcgatcttaatacgtaattgataagtctacggacctatatgatacatatgctcaagtttaagtatcgaccatgtattttactcttaaaattatttccataatcatgcaccagttaggaaaagcttcaacaagcaagcaagccgaacgtatatgcgccgtattttggacaggggagtcaaatcaaccacatcaccatgcatatttctacatatacactggtcattttttttgggtacatcggaaatcattttcaccggatttagcccagacaaccagtatcccaatgagtgattaattacttgtattatactcattgttgccttgttggctctttgaggtcagaaagggacaattgaaaggcctcgattgaacaaacgttaggacatgatgcgcttctatataaattcaaggaacaaaaaagcaagctaattaaggttttgtgttctgcataattaatccattaagtatagtgagatctgaggtgaggagaggattaattaagacaaaatctagccaaacttgtgtgaatctccctctaatccatatgcatgatcccccccctcttgctttgcaaatactgtgagcttaattaattccatgtctctctctaattctgcttttgatgttgcaagttgcaagaagcttcacctctcctagggtttatacaagcagcggcatggacgactcgagcctcttcttgcattgggcggtgagcacgctgcagcaccagcacccggcggccgtcgcagtcgtggccgacgacgacgccacgttcttctcgttccaggagctctgcgacaccgaggaggtggttgttgtcccggtccaggaagaagtgatcacggaagcgcatggtggtggagccagcagaatcggcctcgccgtggccgtggatgagcacggaggctggtcaaggtccccgaatccgggggccagggccgccgtctggtggatgcggcagcaataatctgcccctgatgagctgggacttcagcgccgcctcggtggcggtgcaggtgcagccgaacggcggcggcggtggcggcgcgccggagatggcgtacgggtcaccgccggcggccgggggatccaccaccaggaagacctcggcgcccacggtggggcggcggcggcgtacgcgcagctggagcacgtcgtcgcggagcggaagcggcgggagaagatcaaccagcggttcatggagctctccgccgtcatccccaagctcaagaaggtataaaaaatctcaccaattcctcaacatgaaatgctccgatcgaatttgctttcgtctcgtgatcgatttgatgatcagatggacaaggcgacgatcctctccgacgcggcgagctacatcagggagctgcaagagaagctcaaggcgctagaggagcaggctgctgccagggtcaccgaggcagcaatggcgacaccgtcgccggcgagggcgatgaaccaccttccagttccgccggagatcgaggtgcggtgctcgccgacgaacaacgttgtgatggtgaggatccattgcgagaacggcgagggggtgatcgtgaggatcctcgccgaggtcgaggagatccacctcagaatcatcaacgccaatgtcatgccatttctggatcagggcgccacgatgatcataacgatcgctgcaaaggcaagttcttcattattatattaattacgagtaattaatatatattacttgtgagtaatattttatgttatctgtacactatctcgtgtgtctttccaaaaacagattagtgaatgctttaatcggtcacatccgtcacgcataacgtcactgctgatgatgctcttatatggtaccatatggtatattatgcatctcatgtgagtcatgttgtttttggcatttgttttgggttttggttaacaacactcaagagatcaatggaatatctagctgttagattcgcaccacggttcatgcatcactagcctctagcatcattaataggtgtacagataatcttatctgtaacataaagtattagtactagctaagtagctatatatatcgatagatctgtaatcatggtgatatttagaaatcaatcggtctgaggttaaagttcaagatttagagcaagatcgattcgagaaggcgccattgcaacaatatggctattagaaatgagagaaatagcgttatccaagatgagagagagggagatagcgctgagctgagcttaattaattaggagaggtggcatggtgacctttttttttttcggacacggatgtgtaattcaatcaatggcaagatgaatttgtgttttttgagatgttggagcacattttagccattatggactccttgtggaatgcaacagtttgccatgaatttcactgaaatttttgcataagtttcacaataaatagtgcattttgctcaggactattttttttttagaaaaaaactcacattctaaagaagccaaaagataggtgcggacttgctgcatcttccatatataacatcttattgaaatgtgtagagctatattacttttttgtaagttaattccttgcggaagaacattgtcaagtgtcaacaactcaacatatactgtttccgtttttcttgaagagacatactgcttgcatttattgtcttatgtgtatattatcatcttaaaagtgtttacaccacttatttggaacaaatggttgataaattaaggaattttgtaggacttttcctatttgatcctatggaacaaagctagtatcagggttagtttttagaatcttatgaaattcccaacccagttatataattgatcaatacgtaggaatcttagagggaagtgtgagatccaacctcatggaatttactttggtctgtattttcctatactttctttttgtctatttctacattttttttctatgctttgcaatccctttttgtgcacatggccacatgtattcatgctaaatcccaacattttccctatatattattgtgttaattcctacattacaaaggagaaatctttgaaagagctggagcaatttcacctaaattcttacattccaaagagttgggtcctagcttttaaggttgagagtaaattaatggagttctaacatttctactcttttatgagtaatttattgatgagttcaatattgtaaatcttatttctatttgacataccactagctataggtaggagaggaaatatctactgtggaaaaatcgtgtgctaaaacaaaaacaatcatacatatatataattcaaaaattaccccttttttaaaaagaaaactttgtacttagttctctgaaatgaaattgctcagaataaatcattcttttcatataatcattctttctcatatataaactccataaatattttaggtagaggaaggcttcacagtcaaggcagaggagattgtaggcaggcttaactcagctttatacaaacaagacgtcagcactgctattgaggaaaacagaaactaaaattcgtactccctccgatttaagatgtaagttgttttagctttctcaacttccccaaaatgcaagtcattttaaacttctttgcatttttcatcttaatttccttttgattattcatccttgtgaaaaaaaatgactattctttcccaataatgcagtatacgtatgaagagcaagaagtcatttgaactatatatcgcacaagtttaaaatgacttgaacttgaaatcagatggagaacgctatatagtacatctacatcaggggttaattaatatatactaccttcgtttcaggttaaaagactttataacactactcacattcatatatatattaatgaatctagtcacacatatatatctaaattcattaacatatatatatgaatgtgggcaatgctagaaaatcttataatatgaaacggaggaagtacgtatgtatagacttcctatacgcggtatacatatgcacgtgaaaatacacatatgcttggatacaatggagcttgtacttggacggtcatggtatatatatttgatgggtcgtctttggaacggatgcatcccagttgcacgtacatatattcataaaagattgcaaatttgcggcatgagaatcggtacgatcggtcgacatgcaaattttaacttggccagcttaattgggcatcatcaactcacatatttggtgtgcaaataatacaattgttagttaattattgcatcttactagtaccatgcaaaaagaaaaatgatgacatattgattgatgtgctacatctcttgcaagttgcaatgtgctcgcatccatcgggatcgacttaatttcctgcaataaataaagatcaaattgtgttaatcaaatccttaatttgctgatgtattgacatgcagatctttactttgattatataatcgacaactccaggtggccggggtactaacgtactataggaaaaaataattttaggaaaaattacaaattaccccgtgaaccattgggtgagtacgaattgttggaaatttggtcataattcggcatattttaatccaaaatattaagacaataaacatgacatttgcaatatgagtagatctagtgatagtgctagatgtatacaacttgagtatgcttaatatgaaataagcatcaacatttacatagtaacgcaatgctgccattgcgaagagtattaacaaagaaacatctaatagaatcgggagaatgaaagtataccccgagaacgtcccaccgctggattttgaggcagtattgcctccgttgatgtcgttcatcttcttctctccaatctccattgacatcttggtgaaggtaccgatgcagtagcagtagccgcgaagaacaagagcagtcgcgtttgaagcgctacccaaaaacttgatcgcccacctacccgtgcaacttctcaagcggacggagttccggagggacctgctcatcccgtacaactgtgcgcgcaggtgaacagaaccggggaaggattctgcagctcaggaacagaggaggaggaactcgaagtgcaagagtcgtgaagaacttcgttcgtccttctggttgctgtggagtatatatatgcgagcgcgagagtaacgttcggagtcatcaaccgcggtgtttaatttcgtaaccgacgtgctcgttaatacggaatcaattcacggcgtttaattccgtatccgacggaatcaattcatgacgtttaattccgtaaccgacgtgtttattgatacgaaatcaattctccgtgtttattaccgtccgttacaaaacgagagagtgcagcagcagctgctgtctgcctcgcctcgcctcgccccgcctggttgtttgcgcaccatctcaaccggtcaacagagactctccactagctccgtatttaagttgagacctcttcacttagatttccaaggtggtattattacccatagcacttaatgtgggccaatggaatttattaggatttaattgggcctagcccattaatctaacaatccccaccaaatttcatggctcacaggaaatgttctcgattctgatcctgtttgttataccagtgtttcggtgaagactgttaagttgaacttccacctaggaaaagagctacaccagatcacaactgaacaatggactatgccttgaattgtcagtcttgtgcgattcaggtttcactcaaacccttaactggtactaggctgccgtttacatcccctctgtttggagcatataagtcatactcctggccttttcatgagtatctagagatcacctagatctcatagactgtgactagcagtcgaactcatataggtgtgttccctctaagatgttctgtaggccaatatctctgctttatgaaaagccactcggatcacattaaggtgtataccatcctaccatacagattagaagagaagtgcatcatgaagataagcccattttagggtctcttctctcagttacacaatagtttgtttcaccatccaaattcatgggatctccgatcacaatggataggtttccaccattgtgcaactctaagtgggtctcaagcccatctcccttgatgcacagtctatcacattacgtggtagccccttggtaaactgatctgccagatttttagccgtctggacatagtccaatgctatcactccggagtttttctgctttctgacagacttcagtcttcttttaacatgcctggatgacttcatgttgtccctcgaactgttcactttaataatcacactgtttgattatcacagttcatcatgattgctggtactggtttttcaaccaccggcaagtccataaggagctcacgaagccattcgtcctcaactgtggcagtatctaaagctgtgagctctgcttccattgttgacctcgttaagatggtctgcttgcaagacttccaggaaacagcgccacctccaagtgtgaacacatatccacttgtggcctttatctcatcagcatcagatatccagtttgaatcactatagccctccagcacttttgggtacccggcgtagtgaattccatagctcattgtcccttttagatagtgcattactctttcaagagcatgccaatgatcatctcccggatttgaaacaaatcggctcaacttgctcatagcaaatgagatgtcaggcctcgttgcactagctaagtacatcaatgaaccaatgatctgggagtatctcaattgatcccttgctattcttcggtttttccttaatagcacactaggatcataaggagtaggagctgccttgcagtcactataacaaaagcgactcaagaccttgttcacatagtgatattgcacaaatgtaatcccaccctcatctcctctcagtagtttaatgttaagaataacatcagccactcccaaatccttcatttcaaagcttttggacagaaagtccttgacctcctcaatcacattgaggctggtcccaaagatcaatatgtcatcgacatataaacacaagatcactccctctcccccaccatagcaatagtacacacatttgtcagcttcgttcacaacaaagccagcagatgtaagtgtattgtcaaacttctcatgccattgcttaggcgcttgtttgagaccatacaaggacttcaacagcttgcacaccattccctcctgaccttctagtacatacccatctggttgatccatatagatctcctcctccaactctccattgaggaaagctgtcttaacatccatctgatggacgagtagaccatgagaggctgccagagcgagtagtactcgaatcgtggtcaagcgtgcaaccgatgaataagtatcgaaaaaatcctcgtcttctttttgggtataacccttggccacaagccttgccttgtacttttcaattgtaccataaggcctaagttttttcttgaaaacccatttgcatcctataggcttgcacccatatcgacgctcgatgacttcccaagtaccattagatgtaattgagtccatctcactgcgtaccgcttccttccaatagtcagcgtcaggagatgaatatgcctcttcaatggtttttagagtatcatccacaagatatacaatgtagtcatctccaaaagactttgcagtcctttgtctcttactctttcgagttgctacaatgttatcctcctcaggattttcctcaagcgtttgatcaatgtgttctatcggcacaaagtgctcaggggataaaataggttcttgactagaagtgctaggtgcatttttcataggaaattcattttcaaaaaatgtggcatctctagactcagtaattgtaccaacacgcatgtcgggtactccagaattaactattaagaacctatatcccatactgtggatagcataaccaaggaacacacaatctacggtctttggtcctagtttacgctttttggctataggtacatttaccttggccaaacagccccatgtgcgcaggtgagagagatttaatttcttcctttcccattcctcgaatggtgttactttcttatgcttagtaggaattatattcaggacatgacacgcagtcaatattgcctcaccccaccattccttggaaagtccagcactgtctaacatggcattcaccatctcagttagagtgcggttctttctttcggctaccccatttgactggggtgaatagggatgcgtcctctcatgaataattccatactcttcgcagaaagaagtaaactcattggaaaaatactctccacccctatcaaaccttaaccgtttgattttcctttccagttggttttctacctcagccttatagatcttaaagtaatgtaatgcttcatcctttgttttcaataggtacacatagcagaatctagtgcaatcatctatcagtgtcatgaaatatttctttccccctttagtcaacacgccgttcatttcgcacagatcggaatgaacaagttctagtggtgccaaattcctcgcctcagatgccttgtgaggcttgcgaggttgtttcgattgaacacaagtatggcacttagagcctttgactaaagtgaattttggaattaaactcatgttggctaagcgtgtcatacaaccaaaattcacatgacaaagtcgcgaatgccacacattggactcatcatcatcatcgcttacatggttcacaactttattacacatatcatccaaggaaaagcgaaacaaacctccactgtcataaccttttccaataaacgttccatatttagatacgacacatttattggattcaaacacaagtctaaaaccatctcacacagtagagagccgctaactagattcttctttattgaagggacatgctgcacgttctttagctgcacgatctttcgtgaagtaaacttcagatcgaccgtaccaacaccatgaacagccgcaagcgatccgtttcccatcaacaaagaggaacctctcccgacttgataagaagaaaatagggaaatgtccacacacacatgaatattagcaccagtatcaactcaccaatcaggtgagtgacagacagagagaactgtaggtaaaaatttaccataccccaatgttcctccaccctcactaataaccatgtttgcagacttcttgtccttgcgctcaggacaatccttggcccaatgcctaggcttgcacacacaaagcaatctcctttttcctttcccttgcttttcttcttaaaattggttgtagcctttgggttttacgtcaggtttgactttcttgttgttgttcttctgcaccaaattggcgctagaacctccctcgatctttttgccccagttgtcctttgccctcgcctctcctcaatacccaaagagccaatgagatcagtaacactgaactcttgcctcttgtgttttagagaagtagcaaagtccgaccaagaaggtggcaatttggcaataatgcctccaaccacaaacttgtccggcaactcgcagttgttgttctcaagttcctttaccagcatctgaatctcatgagcctgttccactatagagcggtcatcgaccatcttgtagtcatagaactgctccatgacatacagctcgctgccggcgtcggaaaccccgaacttggcctcaagagcaccccacatgtccttccctgaaggtatgtgcatatacacatctataatattatcggagagcacactgatcaatgctccacggaacaagcaatccgtagcctcgaacttagcctcctcctcaggagagagaggcggttcactcggtttgccccgtgagacaaagaaataatgcatcaccgtcaaccaaaaaagtgcatgtgctttccatcttttataatttgaaccatcgaaagcatgtggttttagtgatgcaacaaagccaactaccgaaaaagacctatcaagtttttggactgttggaaatttggtcataattcagcatattttaatccaaaatattaagacaataaacatgacatttgcaatatga

SEQ ID NO: 59494 - DNA, 16373 bp, Oryza sativa
  unsure (1)..(16373): unsure at all n locations
ccgctggattttgaggcagtattgcctccgttgatgttgttcatcttcttgtctccaatctccgttgacatcttggtgaaggtgccgatgcagtagcagtagccgcgaagaacaagagcagtcgcgcttgaagcgctacccaaaaacttgatcgcccacctacccgtgcaagttctcaagcggacggagttccggaggcacctgctcatcccgtacatctgtgcgcgcaggtgaacagaaccggggaaggattctgcagctcaggaacagaggaggaggaactcgaagtgcaagagtcgtgaagaacttcgttcgtccttctggtcgctgcggagtatatatatgcgagggcgacagtaacgttcggagtcatcaaccgcggtgtttaatttcgtaaccgacgcgctcgttaatacggaatcaattcacggcgtttaattccgtaaccgacggaatcaattcacgacgtttaattccgtaactgacggaatcaattcacgatgtttaattccgtaaccgacgtgtttattgatacgaaatcaattctccgtgtttattaccgtccgttacaaaacgagagagtacagcagcagctgctgtgtgcctcgcctcgcctcgcccctactggttgtccgcgcaccatctcaaccggtcaacagagactctccactacctcctgatttaatttgagacctcttgacttagattgacaaggtggtattatacccatagcacttaatgtgggcggagctcggggcggcgataggagggggccgtggagggtggagctcggggagcttggggccgagggggctgcagagctcggggcagcggaggacggagctcgaggaggtggagggggcgcccgcagtcgctgacactcgggacgacggcgggcggagcttggggccgagggggtggcacgaggagggggcgccggagctcggggcggcgggaggctgggacggcggagggcagagctcggggaacttggggctgaggggactacggagctcggggcggcggaggacggaactcgaggcggcggagggggcgttcgcagccaccggtgttctggatgaaggcgagcggagcttggggccggggggcggcacgaggagggggtgtcggagctcggggctgtgggaggaggggacggcggagggcggagctcagggcggcggagaggtgcccatagccgtcggcgcgcggctcgtcgaggcagcggacgggacgcccgcagctagcgatgctcggggaggtggaggggcggtagagcgagctgaggatggcggcgggcggagctcgggctatggaggaagcgcccgcagccaccgccgcgcagctcgtcgaggcgatggagggggcgtccgccgcgacgctgccgtgcctcagcgccctagcccgtccccctctcctctgcgctccggagccgacgggcaaggaagccctcccaccgggggcacctccttgccgcttctgcggccacgatggctgctctcatccattgtcgtcgaggacaggaaaaggggaggtggaggaaaagacggcatcagaaaaaggggcagtgccgccgctggggagaggaggaggagaggagtgacagccaggggagaggaaggaggaggaggaggggcggcgctaccggtataggaggaggagggggagtggcggtacgggagagggaggaggaggagggacagcgccgtcgggagagtagtagtgcgtctgcgtgtgagtaagagatgcggaggagagagaggaggagagagagagagaaatgttgtagcgattgtgcgattgaacggtgttgagtggataagagcaggcacaatagcagactataaaccagctacaaacacatatcgagaagataaaaaatgagagagaagagcagtaggctacagatttgtaattagctgcagcacggactccaagacacaatgtgtgtatgacagttgggaccatgtattaatagtgtacatatgtttataggtaactattgtatgaattgggtattaagttgactatagatgatttggagctagtaattggctatactattaaacttgctctaaggatagatgcctgccagccctctctttggccggcttggtttttttatatatgtaccagttttttaaaatattatagatattggtttttaattaactggtacctataatatattatatgtgccggttcttttaaaaacaagtacctattgtattagtaccggttttttctctaaaatcggcaccgatagtgctcaaaggtgttggttctattttttttcatcgcacgaagatgggaaagggtccaatgaattggcatttataaatgagtgtcaaattattatggcaaataaagttcatataattcgattgaacatagagcacgatcgaattattgctatagctacttttctttccaaaaagaagttcatcgaattgtattattgcatactttttcatcacactaaaaggcgctcaatgatctgaatctgaactcgatagtttaattagtttattagtggtgaagagacaagatttatttgactgcgattatttcctaacctctcataatataataagacctgtgagccaaaattgcgttgtcctttgcattggacgcagttgctaacaacagacacccttcttttcagacgttttctgctgacaggaacggctcaaataattgttacctaaagttaataaagataatggggttcgtatatatatggttttgcagatgtgtgccttgcggctacattggattcgtcaagctgtcctttaattttaaaagtacaggggggatcgagttccaaatgacgtattaattaattaaataatgcaatgagtaccatagaattcaacaagctttctaggagtatgtactactagtatgcaatgtatgggatcgatatagtacttctttttatgaaaaaaattgcatccatatatatgtcggcaatctctcctttttaggttaaaatctactgtgctgcacaaagttacctagatttcatgcagacctgccattatatatttttagggccctttgaatcacatgtataaaaaacggaggaatagaaaaaacacagaattttgacaggaattgaagtgtgaaacagaggattgaaaaacacaggaaaaacacaggaatggtcgtttgattggagcgcaggaaaaacgcaggaatcggatgagagagataaactcaaaggaaattttccaagaggttggagctcttgctaaatttcctccaaaatccacatgcaatgtgccattccataggaatttcataggatttgaaaagcttcaatcctttgaattaaatggccaaataggaaaattttttataggatttgaatcctatgaaattgctatataaatcctttgattcaaaggggcccagactctttatctctcctctaattcctgtgtttttcctatggtccaatcaaacggctattcctgtgtttttcctgtgttttgcaattctctgttttacacttgtattcatatcaaaatcctatatttttcctattcctatgttttctcattcctgcgattcaaaggagcctaaaaccggtaaaccggtctgctgcatgttcagttcaaagcatgacagacaatatatgtgtgtgtgcagcgcagatcgggcaccactgtcctagtgtctgatatgtacttgaacgtggaataatgtacagttgttacaacttaattttaacgcatattcaactggcatttgcatgctcggtttgtggaaaagcttaggtaagctagagaagagaccagaggaatcgacatatatatgcatccacgggctaaccgataagaatgttaatttcagtaatagtataatttggaatgaaaaaaaaatcctgaatataggcatgttaataattgataccaaataaacactcaatttcagtagtatagcttagaatatttgatataactgatgcaaggcagcaagctgggttagactacaggaaacaatcgcttcaataaaatatgtcattagttggtgttggttcgtaaaagtgcggttatcgaatcggcaccaatcttgatgaggtgttgttgggggagggggacgtcattagtgccggtttaagaactagcactgatgtgcccacacgagtcaaaaaaataaaaagggatgcttccctcctccaagaatcggctcagccggcctttggaggtccataacggtaatcaatttccatcaccatccaagaacagataaaagaaaatctaataagtcacccgatcaattttcatcccaagaatatatcaagaacacaatattgatcctcattccaagaacaaataacactagaaccaattggattgaacttgatcaaccaataaatatcacaatacacacatcaagaactcttgtagctagtctgttcacaaatcaacagctcatacaaaactcatcgacgcgactatcgttgtcatcaagccacgaccgtcgttgatctggggttgccaaatctagggtcaccagatccacctcctctagcatggtcgtcgtcatcttctgtccgaaggggggggggggggaggctgccgctctttcccttgccattgcccacccaccaaatctcttgcccctcatctccagacgatgagaacacaggagagcgaaggaggagacagaagcgacaccggggcaacgacaatggggcgaagccaggattggacgaagggaaggcgacttggagatgagtgtcgtcagcttctgagctgcaatgagcgtgttgccatccgagctatgaaccgcatgcgcccttactacagccagccgaatccatcagtggtaaggctgggatcggcagatccgacatccttggcctcctcagtagcgaatgcggtagtggcagtggaatgcccggagtaggataagacgaagagcacagttaggagtgcaaagggtgatgccactggtggagaaatgctttttagtcacggttcgcaaccctctgtagtaatccgggactaaagatcgctatctttagtcccggttcaaatacccgggactaaaaatagatctttagtcctggttagtaacaccaaccgggattaaagagagggttgcggcagtgagatgatcccctttttcttttttttttcttttttatttctcccaaatcaagtgggatacatatcccaaatcaaacccccaatccacaaatcgaagtaacatcaaaaatcaaagttacttatacacacaaataaatacatcacaaatcaaatacatcacaatatcctaagaaattactcaaatacatcacagatccaaacaatgaatcacaaatttgtaacttctcagtcaaatacatctcagtgaatcatcacaaattagaaaaaaaaagaatgccgctgccgccgctggtcgccacgaacgacgggcgcggccccactggccgtcgggcacggccccgccgcccgccgccgggcgcggccccgccgcccgccgcccgccaccctccgcggccacagccccgccgcccgccacgcccgccgccgtgcgcggccccgccgcccgccgccctccgccgggcgccaccccgccggccgccgccggccaccgtagtgcgcgtccccgccactggccggcccgctggatgggaaggggaggccggccgggaaggagagagaagggggaggagaggaggaaggggaggagttagagaagagagttagaaaggatagatctgaggagagggggtgagtttcgatctgttaagttgtaactgtggaggagaggataagggatagggattgtggaggagaggataagggatagggattatatactacgtgtttaattttagtcccggttggtactatccaacctggactaaagacccggttggtagtacctggctggtagtacctaccgtgattaaagtggtgatctttagtcccggttattgacaccaaccgggactaaagatccttggccccctgacatacatctgacaggggatgaaccgaccaaccaggactaaagatcaaaatttttataaccgggactaaaaacaatctttactcccggttctttttggatccgggactattgtggattttaccggaccgatcaaagatggtttctccacgagtgtgcggttgagagaactagaggggagggggacaggaaagggcgatgtagtggagcctagcgtgttgaccgtgggatcagctgcaattgagagatttttatttccttcggttcagctcacctcgccttgcctcaaaaccagtttggctcaaccggttttttatgtggttcaactaaaaatccgacaccaatacttatttttctatacaattcatctaaacaaccgatgctaaataatacatcagtattggttcatttaaattaggaaccctacactgatgaccgtcacttgtgcgaggttttccactctcgggatgcgcacaggttcggatggcagaaaatctcatattagtgtcaggttttaactaaccgatacgatgctgatgtggtgttccgtagtagtgaataaaagtagagtaaattgagtagaatacttgatataacagtggcgatgatcactgtatcctcacgctgctatgtagacgaattgaattgaagaagatgtcaagccaaccgattgttacataagaatagtgagtagagatatgtgaagatgacggtgaatgtaactaggatacgggaaattattctaaactcgaggtgacatcccctcgttgtttgcatgtcatttaaatagttacaaaacaattgaaaaaaatcaacaagataaattaatgtgataaatatttaacatctacaagtttcaatgaaaaaacaaatttgaatatacgtcacaaacaaaaatgtgatcgaaaaaataaatagtagttccatgctattcataatattaatattaatatttaacatctatcattgcccacattcatataatattaatgaatctagacacatattatatgaatatgggcaatgctagaaagtcttacattatgaaacggaggaagtatataatatctatattcaagtatgtgcattgaacagcccagctctatctatacgtgccgaaggcccaaatatagcactttgacccaattaacttacaagtcaacaatagtacatgtactgcatgcacctgtaggggcggatccaacgtgggtgcaggggagactcacccacaaaacccatggatacccccagagcaccccttcggtttttcaccatgaatgataaactaaaagtctctaaatggctggaggttgaaaaaactgtgtaattgagccctcccagttttttttcctagatccgcccctgcacctggccgtttctctcatatgggcaaatgagaaaaacgagcgagagagagagagaagagaaaacacaaataaaaaggagactgaacgctccatgcttacgcgaacgaggctctgcatgcagcattaatgcagtcgtctttatattgacatgaatttgatataaaaaggagaccgaattaaccgtgctccatgctagcaacatcaccctctctagatctgattaatttggtaagactcatgggtcatgtcaatgagcatatatcgttccttattaattaatgtgtgaccatcatattgtgaagtagcttatttgaagcatggatttgacatgattttataggaatcatgtactatgttgttttacgaagaaaatctcatgctcaaatgggattatttttcacgaacacgcaaaaagattacataatcaatatgtgctcaaatgggatcatttttcacgcatgcgtaaaaagattacacatacattaatatatattagaagaaggagaattcgattacacactgtagctagccagagagccattgtccggggacagggagaaaaaaaaacaaactaaaagacgtcaatatatggtcaaatgggatcatatatttcttgtctatgaaatgcgtttgacatttcgcctcggtcactagatcatgactaggtgatctgattccagctcagcattagtgtgattcttgaccatcgatgccaactcagttcaatccgtcatagataggccgttaagactggaccgatctggtgttttcgaaattaaaacacccccctgctaactatgatacaacgttgatctttttttttttacatttcttcccaaactgaaaaaatatctgtgcgttgcaatgggtgaaggttattttaatattattatagttatacggtttagttaagatgaaatttactctgagaattcgcttggatatatattttttaaaaaaatcataagctgtaattagtagtccgatcatgttaagttagcatgcgagtatttttaaagaaatatcttatacgactccatctgtatttccaaaagtgaacgaacttaaaaccccgtctcaaatatgaatctgtatttacaaaagcaaataaatttaaaaaccgatttatacacagatgacgtaccaaaatactgataaaaacatcttcgatcaatttttataacagtattgattaataagtccactctttgttatttattgccaacccaaaacttcgttgatctgtattctgacaataattttgctatgacccattccatgcatggtttgggtgggccgtaggtattatattctaatacaaaggctactgcattctagatgtcggaaagtctaatgcgcgatggatcgctaccgagatcgctctcggtagcgatcaccacctctccccctccctccctccacgttttcttttttggcaccgcattacttttctattttagtaaatttatgtacctaaagtttatacacctaaagtttatagatccaaaatttataaatcaaaagtttatatatccgattcaaatttaaatttgaattcaaatattttttatagtatttctatacatctaaaatttatagacctaaagtttataagtcaaaagtttatatacccgtttcaaatttgaattatatccaattcaaatttaaatttgaattcaaatattttctatatatagtatttctatacatctaaagtttatacacctaaagtttatagatccaaaatttataagtcaaaagtttacatacccgatttaaatttgaatttgaattcaaatattttctatatatagtatttctatacatctaaagtttatagacccaaagtttataagtcaaaagtttatataaccgattcaaatttgaatttgaattcaaattttttatatatagtatttctatacataaatttttctaactttttgtttttaaatttttttttgtgtggtttaagaaggggaggagggaagagagggggagtagggggacggacgggcgcccaatatatatatatatatatatatatatatatatatatatatatatatatatatatatatatatatatatatatatatatatatatggccgtgtttagttcaccctcaactacctcaaacttctaactttctatacatcacatcacatttaaaacttttctacatatataaacttccaactttttctaaactttcaacttttttcaggaactaaacacaacctatatatggaactgtcaagaataggcacaacttgtcttgtccttgtccttgtcaatttgtcattaattgagattaatcactccatactgtacgacgataataactcctccatctgttccaataagcatttaattttcttctatcaaaatacttgtcatagatactcatattttattatttttagagagctaactttcccttcctaccatacaaccacaacaatactagttactccctccttccaaaaatctgagacctatttctttttcattaaaactaagaagtaattaactcactcaccatgtggcaaaaccaataaacatacaaccaataagtactagaatactttttggtttctgatcaaccatttaatttagcacatagtgattacaaataggacttagatttttggaaaaaccaaagaatgaaataggtctcagatttttggaaggagggagtacttcacacgaggtttttgtacttgttttaacaagaaaaataattaggacataattaatcaaggtaactgtatatgtaatttgtccttttttgttagaattataagtaaattgaaacagggaagactatgctccatatgtcaatgcaaaagcacagcatgtgccatgagaccatagtacaaaaaaacggtatcgggccggcggttgagctggaaaaaaccggaaccggcgactttggtggcttggttaaaaaaaaagaccgcccctgcaatcaaacaagtaaaaaaccagtgaaccgggcggttttatgggagccggtgaaccggtagttgttttttaataatcgaactggtttaaaatttatcctcgcagtatggcattatgaatttattatgttacaacgctatatttttttatgttgtggcgatataataatagatatactagtttatttatacatattttcactaatttgtgatgattatatatttaaaataatgcaaatcaaatataatattaataaataaaaaaccggtggttcgaccggtgaaccggtgaaccgacgactagagcgggttgacctccggtccggcttttttactatgcatgagactgaataagtacggctcagtgccgcctaccatttcgtcattaatatattttctctcgaatcaaatccatattgtttggccggaagttggcacttctattactaaaaaaagaatagaatccagtatatttttagtacgtatttcattcaagcgtcgccaaacgttggttcagccagccaatcaatcaagattatccattttgaataaattagttcatggcgagattcaccatctagtttagtaaaccaagctgaatgattgtagtggcctctgctctaattggcaggatttgctccgatctgctgactgataagtacgtacgtgctacgactttgcctccagcttttgatcagcttcacactaataatacgtcatcgttccgtttcaaaataaacaaattgatcttattgatatgctccctccgtttctaaatatttgacgccgttgactttttaaaatatatttgaccattcatcttatttaaaagtttaagcaattattaattttttcatatcatttgattcattattagatatacttatatgcatatatatagttttacatatttcacaaaagttttgaataagacgaacggtcaaacatgctaaaaagtcaacggtgttaaatatttagaaacggactagatttatttattttaatatgagggaagtacgaataattcacgataacatgccaagaactcctcaatgcaaaacggcacatacgtacaaattccttgcacacgagaacttgttaggaattttttttatttataattttttttattaaaagttttacaaaaataattttccattttgaaaattgacggaaatagtcgcctaccgccctctgggagggcgattnttcaaatcgccctcccagagggcggcgaaaatgacgtggcagacggccgttcgctctcgggcgacggccgtcaacgaaatttgcaggcggcccccttgccgccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaaaccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatgtacttacagtgaactggagcaaccaagccttgctaggcccgactgtagagtacagaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtcccccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccacatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaat

SEQ ID NO: 59495 - DNA, 14088 bp, Oryza sativa
  unsure (1)..(14088): unsure at all n locations
agcagtgctaatagcctcagcccaaaattttctaggagttttatattcatccaacatcgttctagccatctcaaccaaaacacgagttttcctttcaacaacaccgttttgttgaggaacacgaggagaagaaaattcatgttcaagacctctttcattgcaaaattgttcaaaagaagcatttttaaactcaccaccattatcacttcgaattcttttcaaagaaccaggaaattcaagctccaatcgaagaaacaaaccacaaaagtgttggaaagcttcgtccttagttgccataaagaaaacccaagaatattgagaaaaatcatcaacaataaccaacacataccactttcctccaacagatttcactctagccggaccaacagtgtccatgtgtaatagctgtcccggtgcatccgtcatcacagaaacaataggatcatgtgaagaagcaaccatcttagcatgacgacacggtgtacaaaacaaatcaagatctttcttaagtttaggcaaaccacgaacaagatccaaaccacttaacctagtgagatgatcaaaaccaacatgtccaagtctacgatgccaaaacatcacatctttatcaaacttagcaaccaaacatgttatcacaggtgaaacaggattttcaaaatcagttttaaacactcttccatagtgagaaatattcaacacagcatcaccacaagaatcaaaaactttacttccagttttcttaaagtgaacctcaaatttttttttgactgaagtgaacctcaaaattttcatcaacaatttgtgaaaccgaaagcaaactgtactttaagtcctcaaccaaagctacattcttcaattcaaaattttgaattacctaaaccaaacctgtagcgagaacagcacttgtagaagcatcaccaaaaataattgattcagtcttggatgcctttttgagtgaggagaaccaattttattacctgtcatgtgccgcgaacaaccggaatccacgatccacacgttcttcttccttggcaccaaagcctacacacaagcagaagtcgaagcctcagtactggggttagatgataataaaaatttaggaatccagtactgagacacatgaccagaagatccaataggcatatatccacgtgcaaaaatcaattttagaattttcagaaaaattcctccgaggccggtctgaccgggggccggtctgaccgcctctgtaccgccggtctgaccggtgcccggtctgaccgacgctctgtagccggtctgaccagtcgccggtctgaccgcgggacccactgcggtctgactggtttcctcgaggnnnnnnnnnnnnnnnnnnnnctttgattttgcaaaagcaatctctctctcctttttctgtttatgagctaatctgaaacaaaaactaacaatatgtccatctttgtcacaaaaagaacaagtatatttttcacgatgattagacacattggtagcattagaagatttagcaacacaagcaacaacaggagattttgcatgcacaacattggattttgaagaagatgcactcatagtagacatgataccagcagatttatacacagttttattagtatcaggtttaaccaaaatctcaccacttctagcaccaacacctaacacaacaggaggatgtctagaattatgagcataaggattaaaacctaaaccatggttatgtgtgctaacctttgattgatccaaaatcattttgaggttcttttacgacattttctaaatttgcacaaatttcacaatctaccatgacacctttgcttttacgacatttggggcaagaaagcacttcattgttttccacaacatcttctatgtactcaacatgacctaaagcatctttcaatttcaacttattcaaattacatgttgagcaatccaaaacatcatgaggttgttttaactttttagcagaaatcatgttaaacatcaaactagcatgaaaagcaatttgctatttttgcaacaactttttagttaaaaacaactcatccaaagtgcgtgtgtgcaaagcaaaactacaagcaagagaagatctatttctcaaatcatgtgcagcattaacatctctaatttttgaaatctcattcattaaaacctcataatttgagcaatcatcatcattaggaataagagattttaatctagcaatttcagatttaagagatttaatgataaattcctgttttctatacatcttctcacacttcttattcttttcactcaaaatattattagcttcctcaaaagcacttacctcattatattcatactctgtgtcagattcaccacgcgccatgaagcaaacatcggagatgttctttcccttatcatcatctccactttcaccatctacatcacttagtggctcgaaggcggcgcaaacttcttgaaaagccttcctgagattctccagcttcctcccttgagatgaatccttcggcttgctgttgttggacttctcaccatctttgtctttgcctctcccaagcttaggacaatgcgaacgaagatgatcaattgaaccacattcaaagcaacgatttggaccacctcttttcctgttcctggcattattcatagctcgagcaattctgttagcaaccaaagccaaatcctcctcctcgatctgttcgagttgatcatcggatgtggcattaaaaacagcaagaaaagaaggcttagatgaagaagcatcaacatccaaagaagaagaagaagaaaccaaagcactcgaataagaatcaccttttcgagaaagaacattcatcttatgtgttttcaattttatataaagtgaatccaaagtcaaagtagtcatgttaacagactcctgaatagatgtaactttcatctcccaaatagacatgtcaagaccattcaaaaagtgacgagaaatctcagattgtggatagttagtatcataagaagaatcaacagatctaagatcactcaaaattttaataaacctagaaagatagtcatccaaagcttctccaggtttcatctcaaatttaatatactcctttttgaaaagatctcaatgaagttctttaatgttattagttccttgatgaaaattactcaaagcattccaaatctcatgagcagttcgaagatgagcaacacgatcataatccgaacgagaaatcccactcaaaagaatattgcgaactttgcaattttgttcaaactcagtttttaaagcaacaatattaatctctttaggaatcacataaggatgagaaacttttctccaaatatcatagtcttcagccataatataacattgcatcctactacaccaatgagaaaaatcccttccatcgaaaacatgaggcttagttgaaaacctagcgggagtagccatggcaaaaactctagatcgataaaaatccaaagaagaaaacaaggctctgataccacttgtaggatcgaatcacaagaactaagccaacaagagggggggtgaatggttggtatacccaaaaaccgaaaacttttagcggaaaataaaagttaccatcgaattcgacggaagtcggtctgaccgagattgatctgccggtctgactgaagcgtaaccgccggtctgaccggtgttgatcttccggttggaccgtcctggaatccctgccgtgcctgatgtcgctgccagtctgaccgccgcttgccgtcggtctgaccgccggcgagttgccggttagaccgccgaaaaccggtgaaacacaaatcgaagaacttttaaagtagatgacgactttattgattttatctgtgtttacaaagtgcaccaacaacactcctttcaaaaatttcgactaaactcgaaaccctaactcaaaactcaactcaattgctctctaaagctatacagggaagcctcacgctccccctctatttatacataagggtaggcagcctaaagccacgaaccaaactcatactaagagtcctaaacaccttaggaaaccctctagtacaagaaagaaactttacataaccaatcgaaccaaatttggactccttccaaattcgactacgcatcccatacacacacaatacctccatcgtatgccatatggaatctccatcaaccacgtgcatcaactctagcctaagtatcccgcatgatctctgaccaccacggacgtcgtcttatccccatgtcgactcctggtccatcaccgcaaatactctcctgagacatcgagtcacctacacatgaaataaacaaagaaaccatattccgagaccaagctatctctaacttgactcattagtagcaaataacagtattgcatacgtatagtatccatctagaagccataatcatgaaataatcacggatatccaaacaaacaactcgaaaccgaaaccgacatagcgtcggccggtcagaccgtgggctagccggtctgaccgcgcaatacacgccggtctgaccggctaccagcgcccggtctgaccggtcacatgaaataacaaatcctgcgagcacctgtgaaatccaatcatctccaaaaccgcttcgtgaataaattccaaatatcaaaatcaataatctccaatgcccaattattcatcacagaataataataaaaaacacctttgattttacatgggaaactataatggaggagaaggaggagcacgaccctgcttttaaaatactgtgatattccgacaaaaaaaaaggttgctgacatagtttgatccttttctcacctgtttctgttcctatactccagaggataatataaagtaaatatcacaatatctagcttatgttttcgggtttgtttcaaaaaaaacctatgcattgaagcaatccatttcatacaacatcgctccttgctttccattgcctgacatgggggagagacaggtcagtcactagcgctttgctatgagtaaattctctgtgtaccaatgaaaattcactcgatccctttcgtactcctgaaatttacctgatcccttctatacccctaaaattttaacttgattcctttatgtccctaccgttacattttccttcttttcactgtgacgtttggtggtgaatgtctgttatgctcttgatgattaatttaggtttgaatataagcttgaaaaaggttgaaatttttatttgagtgcacagtatatgcattttatgaaactaatgagagtaaataattagagcagaaaattttgacataaattttgaaaataaaacaaatataataaattaaaaaaaatatttgaaatattaatagggtaatgtttttttatcgggaacattcataaaaagtcatatatttgtatgaatgctactcatttttatgaatttttaaaataaaataaatacatattttttatttcattatctaaaataagttgtgtcatgatcaaggaatatttctccaaactgttttatagaaatttttctggtcgctgcatggctcctttggaagcagagtaatgatttatttttaacaatgtttctccctccctcccaaggtggaaatcaagtctcaagtaggagctaagtctaaatttaactagcagcccgtttggttggagggagtttttaatagggattgggagtttagagggatgagactattaagtgttttgtttggttgggagacatgagaattttggtgggatggggatggggaattgagaaaggaactccctcattttcaatacgtgggtaggggcaggtaattgggagggaattcctcatttactttgtctaagcaaatctcagccattcgtttttattaatgatctaatctccaactaaactccctatcaatttccatcacctctaccaaacaagatattgggattaaaaattaaattcccatcttaatctcatcatcaattcccttgtgtaaactcccaatccccttccctcgagttcccaaacaagccgtaggcttaaaaggcttaaagtacatttcagatcttttcttcaatcatggattgataacttgtaattcttttgtacagttttcctttttttatataaatgaaaattaccgtgggggcttcccccactgtttcctggtaaaaaaagaataagttgtcataaatagtgtatcgcacaacaaactcataattataatagtctaatgcataaacttttacatttttaataatgtaattcataagtttttatgttcatccaaagggtaaaatggacatatttatagaaattagatggtcaactaacggtcaactgacgggaggggcatggaagggttcaaaatcaaattttgtggtatacaaggaactaaacaaaattcagaggtataaaagggattagctaaaatttcaggggtatacaagggattttctctctcccacatacagtactatataaatacattttcatccctcctaggctcccacatataccaatacaaaattaaaataccttcacattattaaaattcaatataattattttttattttattatatttatcctctagctaacaaactccaataaatacgaccaaccggaggagctaaaaaacaaagttgttccaagatgaagggaatagtcgcttgagctacctcagcaccatttctctgaggtccggtttgagatgaagaattatttaatatattagagtaacttatgttttgaaagtttttgcacaaaagacatcatgccccattattttccgattaagacgaagattctaccacagttttagttagtatgctttccaatatgtgaaatgatgtttttcatacgaaagctttatatacagaagctgctctaaaatactaaataaatttactttccatgtttataaaagtcaattaatcgtgcaaagatgattttctcgtttaacatgttcttacttaatcatcatctttattagctgaatcttataaagataaaggttaaatacgggcacgtaacacgagaaagtcattagcatattgttaattaagtttagttattttaaacttaaaatgactttatttgacatttaaagcaacttctggatagtaaattttaacctgaaatacattgtttagtggtttaaaaggcatgctaacaaaaatctaagcaaattttgtatcttaataaaaaaaacaagacatcgttgctcatttcaacaacgacatactcccttcatcccaatagacatatcttagaataagatatgatatgttcttatgacaatacgacaatgaatccttcttgtttatatatcacatcatatcctgattatgtgttttttttaatggacggagtacgttgataatggagacattaatcacaaatcataattgattttttttaataatggaatagaacatctcagcctttgctcagaatagctacaaccaattattacaatcaagcactctagttcaaataaaaattgaaaacaccaaccaaaaataagaaataaccaatgtaagataaggattacacatttattgaagtctatttgtgaatctccatccataattggtaaaaagttacataaccgtcgtcttaagcttacgacatgcaacttttagaaactctccatcttcatcacacctttgtagttatgtccaaaaccgaagccaatatgttaccctgaaaattacctgcatatatgaaatagatggtgatttgtcaaaaaccatatcattcctactcaaccacagagcccagggctctgtatagtagaagctccaataagtataaatttgctctttttcttgtccacaccaaaagccaacgataaaaaaatataagatatgctactagaaaggtataaaccaaaagagtaatgaactgctctccatataaattttgcataatgacaatccataaaaatatattgaatagtcttatttttcatacagaaacaacatcttacactggctttccaattccgtcttgccagattgtctttagttaacacaacccctttaagcaagtaccacataaaaatcttaatcttaagcagcttcttaagcttccaaattatcttatttctctcaatatagccattattaattaaagctaggtacattgacctaaccgagaaccgtccattctgattataattccatctaaaacaattagaagagtgattcaactggatatgtacaatagaagcacacaaatcaagccaaaatataagattctgaccaactaaagctctcctaaaacaaacactaagcggaacagaacccataacattagcaattgaagaactttttcttcggacaatagcatataaagatggatacttatcttggccaagttacctaaccatttatcttccaaaatcttgtttttccccattgctcaaaatccaagaatccatatttaagaaagtactattgactttcatgagacctgcccaaaagtggaaatcaccttcaaccccattgtttggcttttctatggaataagtcaaatggcatatttgcaaacgaaaaatattttgtgacttttatatacgtgtccttagcgatgtaaaagcaaaggctgcaaaataaacttcgacgaaaaaacctcaaaaccagcttcaaatttaaggttgaaaattcaaattttggctgataagtataagcataagagaaaagatgagaccccttgtttcctatcaactttggttataaactgattataaagatattttctcttcaataaatcctgcaaaaacacttactcatttattaacttaaacaaccatttactcaaaagacatttattttgtatttccaaattatgaatcctcaaaccaccctgatctttgggcatgcaaatgatatcccatctagtaagtctgtactttttcttatgatcatccccttgccaaaagaaacgtgatctatataatcaattttttaaagaacccctttcggtatctcaaaaaagatatcataaatatagctaaacttgaaagtacagaattaatcaaaaccaatctacccccaactgacatatacatttatctttccaactattaagtttgttctcaattctttgtttaataaggccatgtttaattcccaaaacaaaaattttcacgctgtcacatcgaatatttagacacatgcttggagtattaaatgtaggaaaaaaatcaattacacagattgcatgtaaattgcgagaagaatcttttaaacctaattgcgccatgatttgataatgtggtgctacaataaacatttgctaatggcggattaattgggcttaataaattcgtttcgcagtttcttggcggaatctgtaattgttttgttattagactacatttaatacttgtgtgtccgtatatccaatatgacaactaaatccaaaaattttccccaactaaacaaggcctaactttccaatctttgttaccagcatagtaactgattatagggcctaagggcatccacaatgtgcatataaagtgggtaataaagaataaatactactactatcaggttgtatacattgtgggagtagtaagcaacaaataccaggtaatatgcttagggcatccataatgtagtacaaaaatagtccatagtgcataaactattccattcagccacctagtaaaattgtgcaactagtccatataaaagaaataacaaaaggtacccatataaaataaataatactccctccgtccaaaaaaaatgaatctaggactggatgtgacacattatagtacaacaaatttgaatagaggtatgttcagatttagggatagcaatggggcaggtcgagggcaggttgggctggaacgtccccgccccgacccccgaactctccacccagcctcggccccgagtggacatgcggggccaaatcagcccgcacccccggcccctccggggccccgctacccaaccgggcccccgcattgagtagcaactcaatccagtcatctgtgcaccgccgttgtccctctgcgcgccactgtactctgtgccatcgccgcgcctgtgtgcagccgctgtgtctgtgtctggaggggagaccgggagaggaggggaggggactatacagtgtctggaggggagaccgggagaggaggggaggggactgtacagaggccgaccgaaggggagggattgggatttggggagagcggcaaccaaagatacgggaatggggtctggggagagcggcaaccaaaggggaggggatggggagagcagcgagccggcgagatccgaactcgagagcgcttctgcttgtgatgttcggcgacttggggtggagagggagcgcgtctacggctgtgcggcggcttggggtggggaggggaggtctggttggggtagggttaaattttttttccttatatatgctgatttccatgggtttcttgggcctatgttcctataatgggccacattttaagaagtaatatacccccctcgggggcctacgggtcacccgcgggtggaatgttctccctgtcccctcacccgcaaaatgcggggccacagtcccgatggacccgcggggcagaaatgtcacccgcccccgtaggggcgggtccccacaggagacacggtcccgcgggggaaattgccatccctatgcagattcatagtactaggatgtgtcacatgcagtactaggttggttttttatgggacggagggagtattatctatctctactgctctctcttctcctaatgctacattgtatccgtatacattgtgaggattgctatagttaaagtttatttatgtggggtctcatctatatagaccacttttgcgatatacattggtgatgcccttactacctaaccataaggaataaacaaataatttctctcattcctctctcatggctagtggttgtgggacccaacttactacccactttttgttcttttaccattgtagctttaacaataactaatacccactgacgcagggcccacccttattcacaaagtaccccctccggtttcattttaattattgttttggacaagattatggtcaaacttttataattttgaccattaataactttaaaaatacttagtttaaagaaactagaacaacatactccatccgtactcgtaaaggaagtcgtttatgacaatatttaagtcaacccttgggaatataaatcatgaataactctcaaggtgttgagtttaaaaatgtaaaaattatatgaatagatttgtcttgaaaaatactttcataaaagtatacatatattatttttcaataaatatttttatagaaataagaagttaaagttgtgttttggagaccgtgtcgctgtccaaaacgacttcctttacgaatacgaagcgacttcctttacgaatatggagggagtatatagatcggtctttcaaaacactataataaaaataaacatgcatttatttattttatatattataatacaaaaataaggtcaaatatatatttttgtagaccgtatcatttttcagaatgttaattaaaatgagaccgtgtctttttccctccattccaaattgatctacatattttattggtacaccaagaccaagaaaagctattaactctctcatactatatttattctagcaacaaactcgatgcatgcatcattcctactatttcttagccaatagtaaatcaaaatattgcatgtgggttataaatacatgtgtgcatgcatgtatcaatatccatttacttcaatgcacaaataacgaatagacctaataaatgaatataaatatatagattatttagaaataaccttaaaatccaaaactacgtgtatatcaatttggaaaggagggagtaaaggagtaggaagtaataataggtgatgtcctcctagccaatgcagacatgatgcagtaaatattgagattcgctcatctgcctgcctgactgcctctgcctgcgtgccctcgcgacgctctcctcgcccgcccagaccccttgattcgctcgaattttctggtctgggaccaacttcacaccagcctttggtgcacgtcgcgcgagtgctcaccccgtgctctgcgtttcgcctcttcgtccccgtgcgtacgtgatcatcggcagcaaaacgtggggcggcggcagcaggcggcctagccgcctaggggcgcgccgagcgctgtcacggacggacgggacggaagacgggacgggctctcagatctcgcgaaccagtgcagtgtactccagtgcttactttttttactccctccgttattaagtataagtatagttttacactgttcatatttaatatatttaacgtttaactatttgtcttatttaaaaaaaatttattagtcatagttttattgttgttaaatgataaaatataaatagtactactttatatgtgacttttttaaaaaaaattataaaatttttaaataaaatagatagttaaatattggacacggatacctatgactgtatttattttaagataataattcgtctcctcgtaagatggctcagggctgcactgcacgagggagagaggacggacggaccgacggacagggcccggccgggattgcgctttgactgcctgccgggcggggctccaagagggagtggaccatctcgccgtcgtctcactttgctgtcactttgcgagggcggcgattccgacgccgatctcccagatccgctcctgtcgggggaaacgcccgcggatcaacgggctacccaccatggtggaaaaaccgaacctgggaggctgggactgatcagtgagctttcaccggttcactgcttggaccgccggttcatcggttggaccacgatttatggctaattattttttatcataattaacgctaaaactgctaaacagaatagttattcagtcctcgccaacaaatttttcttacacagttggttaggtggaaagtacaaggcatgcagctcatcaagtctgaggtttaactccccatttgctcaaggttttttttgcatatttgttttaatagttttaagacaattcaccagaaaaccagctggttcgatggttttttttcatatttgttttaatagttttaagacaattcaccagaaaaacagttgattcgatggttttttttcatatttgttttaatactattaagacaattcaacataaaaccagctggtttgatggtttttttttcatatttgttttaatagtattaaggccttgtttagttcggaaaaaaaattttaggtgtcatattagacgtttgaccggatgtcggaagaagttttcggacacgaatgaaaaaactaattttataactcgcatgtaaaccgcgagataaatttattaagcctaattaatccgtcattagcacatgtgggttactgtagcacttatggctaattatggactaattaggctcaaaggatccatcttgcgatttccatgcaaaccgtgtgattagtttttcattttatctatatttaatactccatgcatgtgtccaaagattcgatgtgatgttttagagaaaaactttttggtaactaaacaaggcctaagacaattcaggtcttttatgcaaaccaaaccgtgacatgcactggttccagttttttcatgtccaattttacaactattactaccataaactgtcagggttacggataagatatactcacccttggatatacgctataaatcgatatggtatatctgagcgtatacagacgttctctgtatgcgctaaggaaattcatcacggagtccacaaatggaaagattcctacctggataggactgggtcgtcactgtatcgtgtagggtccgatcactggtggagaaaccctttgtagtcccggttcgtaacccctctttagtcccggtttctaaaccgggagtaccaatctgggactaaagatcgctatctttagtcccgggtgaaataatcgggagtaaagatcgatctttagtcccggttggtaacaccaaccggtaacaccaaccgggactaaagatcgagctgaccttttttttttgcatggacctgttgctgcatgggttatctatctatatatatatat

SEQ ID NO: 59496 - DNA, 9317 bp, Oryza sativa
gatcgtctttataaaataactttgggcaactaagtgacttttaaatgctgtttactgcaaaacctaacccctattattatccccttgtaccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtagacccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacccaaggacatattttataaataaaaaaattatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacctgtcgctgaacctaagccaccctctagggtagagtcgttagtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaaactcccgagtgaatgaagcaccagacaccagttgtgtggcagtggtccaacacctgattaaccagaacaaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaaaacatcagagaagaaattccttccgaggtgcacaacagttgacagagcatcttttagctaatggaggtagagtgtctgatagtgaagattcagatcaagtctcctcagatgatgaaggtgcgaagcctccccaaggttttaaccagaataaaatagaacttaaggcatgctctcgttgtggagaaatcggtcatgttgccagctcgtgtgcctctatatgcgttcattgtgaggaagaccatccacccgacaggtgtccaacgagcaggatcacttgtttcttttgtgaaggaactgatcatgtaccaaaagattgtcgattcagttttctgctgacgaagaagatggccaaccaacccgccagttccaacggagagaagcatcaaggaaacacaaatcctcgccaagattccagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacgtagctgccagcacgtcagtccacgcaaacccccgcaatcagaagcttgctcctcaacgaattgtcatccatgcatcccgaagcagtccgatagcccgcgttgcaacagctccaactccaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcaatgaagaagggcattactccaaaaactgtccccaaccaaggcaaaatcgacctccacattaccgccaatttacacgaagcagacattccaatcgtattgtggtcactggagcaaacgctgtacccgtgaggcctcgtgttaatcagaacccatagcagaaacaatgcaccagtgctcctcctgctgcacctgactctgcaataaatcatagcaaccattctctgcaccgacagccttagcaaagaattgtcgtcgatggaagaagttgtgtctctcccctacctaccccaggccgagccaagggcaatcaacctccggagggcgataccaagcagaagaccgtcatccgcttcaaccagcaatcagaaggaagcttctcctgtgaatgatagcattatgcagtcctgtcacatcatcacagaaccaatcaaggatgcagtcactggaacaatgccagctatatctctccagaatcaaaatgagcagccatgtttgtggttttcagtccgctacttatcatggtgtaatcgaaagtttgcagcaatcatgtaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccctgaggattcgtttgaaagatgcggatatgtgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagttaaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttcccctgaaggtagtcagtgcagcttttgacgcaccacatcaaggtttcactgaaaggcagcaagccaaaggacctcatcgtccccagaagcatccgcaatccacattaaagaataccacctgttagagataagccgaaagatgattgataaaaagagattggcaaagatgttctctagcatgaaagaagtaggccgaaaggtgattgataaacagaaacatgctctgcatcgctcaaggaagacccctgatagtaattgccccgcaacagtcatcttgtcattaagtaagcgagatgacctaggtaaaaatgtttctatgaaggcaaggagcgaaatcttcaactcggtatcagatgctacacggagtgaaaagtgcaagcaccagttaccaggtaatgccatgtcttgggagatgatccaatgggaaagaacacatcaaggttaaaggtgtaaaggaatacgttgaatgctaactgaggacaacctgaagataataatgggaagtaaactgaatgtaaagaaagtgaatccgagctgcttgttcgtgagagccattcccagttatagaaccagtgatatgttcgaagatagtctacagaggtcagattaaaatcacctctaacaacgaagcttcagatctggcaggatcacgatcagacaataacaagtccagcagccaagtcattcgggaagacgtcaaagcatgtcaagcgggataaattggttctcttgggaagcataacttatagttagagtggttgaccctggcatcgaatagcagaagcacctagcactggagaccaggaaagccaatatgaggcagttaatggcaagttgtcaatcatggtatccttagtaagcgggatatcatagtctaaagcgtatggtggtaagctggaaggaaacgccaagcatggtattctcatgatgacaagcatggtatcctagtaatgacaagcaggttacgacgcatgacatgaagtggtaacttgtgtgaggttgacgccgaagatatgaatcgtgagaagttctggatctgaagccccatcatcaagtgccacaacccagtcgaagtcggctaaaggttcaaccggagataagtcaggtgaagagaagattccagctgcaacaggagatcgagccaagcagtccagagtggagaagttgtgctaggcaagttgttataaaagacggagcggaagaagtcagacaagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattgttaagaaataaacaaagttaaaaaggatttataaaaagaaaaatccctaaaagtcttctttccccccctttcccttcttgggccggctcggcccacttctctccctccctctctctcctctcccccgcggcccatcggcctcccccgcgcgcgcgccgctgacaggcgggcccgcccgccaccctcgctgacgggtggggcccacctgtcatccccgacctcgcgccgcgcccgccgcccgcccgtgccctagcgccgccgccgccgcgaatctcgccgtttcccgccgtccccgcgcgcaataaagagggggaaatcacccccgtgattccctctcccgtttccccctcttttccctctctctctccctcggattcgtccgatttgaatcccgcaatcgtcgccggcgtcttcaatggcggccgagatccccgcgcccgtttcctccctctccggccgcgctctccccctcccggcgctatataatcgtcccccgcgcttcgctcttccgtttccgccgctcgccgctcgctctcgccgtcggattcgtgctcgcgccgtcttcctctctctccgccgtcgccgccgagctccggttcgccgccgccgtcgctccggacttcctccccactcggcgtcacctccatcggcttcgccgcgtcgtcgtcgacctcgtccgctccttcgtttcgcccgccgaccgccggagcaccgtcgccctcgccgtcccgaaccgcgccgccgcgttcctccgctccgttcgtcgtctccgccgtcctcgtgtctcggggtgagccgtggaccgtccctttcgcttccctctcctctccgctctctcgggcgccgctccgccgcgccggtggtcgccggcggtgaccatcggggcgcgggcgcgtccccctcccgtcggccgtgccggcgaggccgccttcgggcgcgccctcgcggctgccaagtgggcccagccgtcagccgcccgcgcccgcgggtgcggctgacgcgtgggacccacggcgccggccgccgccagccgcgtgctcccggtccaccgtggaccgaggggctggcgcgtgggccccactcccgtggacccggtccgcgcgccctctctctcggctgacgcaataaatgggtttttaattaaaatttaaatgaagaaattcgtaaatatccatttaaagagcatataaatttcaaatggccatatcttggccatttgaactcggaattggaccgttcaagtctctaatttttccttaagaagtcaagaacctatttttgtgctttgttcctgcttgttgtatggagtttattagagtaaaagccttttcttttccgttggtcgtgtagacgctgcagcttcggaagatccgctcttcgcggaagttgaagccggcgtttgggaaagcgagcaaggcaagtcacatcatccttgagcatattgaatcccagtttataaaattattttgatttaaattaatgcattaccgctttatttaaattcccgcgttatcactgttttatttagccctgcctatttacctttgttatgacattattattgctattgttattattaccttgttcaccctagaataaacaaaaccccaactagtgggtactctattcctggttccactagtatgaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatattgtgtagctctaggatcgtctttataaaataactttgggcaacaaagtgacttttaaatgctgtttactgcaaaacctaacccctattattatccccttgtacccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtagacccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaatatgggtagttgtggatcgattaaccaaggtagctcgatttattcctgtgaagaccacctatggagggaacaagctagctgaactctacttcgccaggatcgtgagtctccatggcgttcccaagaaaatcgtatctgatcggggaagccaattcacctctcacttttggaagaagctccaagaagagttgggtacccgattaaatttcagcaccgcctatcacccgcagacagatggacagaccgagcgtctaaatcagatcctagaagatatgcttcgcgcatgtgtactagatttcgggaagacctgggataagagtctcccctatgccgagttctcctacaataacagctatcaagccagcatacaaatggcaccatatgaagcgttgtatgggcgcaaatgtcggacaccgctattgtgggaccaagttggagaaagtcaagtgttcgggactgatatcctgagagaagctgaagctaaagtcagaatcattcgggataatctaaaggtggcacagtcccggcagaaaagttatgcagataaccgtcgccgtgacctggaattcgcagtggatgattttgtgtatcttcgagtcacgccattgcgaggtgtacacaggtttcagacgaaagggaagcttgcacctcggtatgtgggtcctttccgtatcgttgctcgacgcggagaagtcgcttaccagttggagctacccgcctccttgggcaacgtgcatgatgtgttccatgtgtcgcaactcaagaaatgccttcgagtgccatccgagcaggccgactcagagcaaattgaagttcgtgaagatttgacctacgtggagaggccagtgaaaatcctggacatcatggagcgcaggaccaggaaccgggtaatccgtttttgcaaggtccagtggagtaatcacgccgaagaagaagctacttgggagcgtgaagacgagctgaaggcagcccatcccggtctcttcgccagttcttccgaatctcggggtcgagattccgtttaaggggggtaggtttgtcacgtcccaaatcgactctaaaatacatcctcgaaattgtgcaaagaataattaaaattcatgtgaaagcctccaacaattaaaatgtgcaaagataaaagtcaaataaggcttggaggatttttgtatatttcctaaaagcctaaaatgcgtaaataaattttagtggaattttcagagcacaaataataattgagaagaaataaacaaagttgaaaaggtttataaaaagaaaaaaccctaaaagaag

SEQ ID NO: 59497 - DNA, 19782 bp, Oryza sativa
tttctccatggtgatttacatgaggaggtctacatggagatccctccaggatttgggaatagccagacagttggaaaagtatgtaaactcaagaaatccttgtatgggttgaagcagtctccacgtgcatggtttgataggttcaggcatgcagtgtgtgatatggggtattctcagtgtaatggagatcacactgtcttttacaaacatagggggacacacatcaccatcttggctgtgtatgttgatgatatagtgatcactggtgatgatgtagaagaaatcaggtgtctaaaggaaaggctgggaaaggcatttgaggtgaaggatcttggtcctcttcgctacttccttggaattgaaattgctcgttcatcaaaggggattgttctctctcagaggaagtatgttttggatctgttgacagatacaggaatgcttgggtgtcgtgcaagtactacgcctattgataggaatcaccaattgtgtgctcaatcaggtgatcccgttgataaggaagcataccaaagactggtgggacgcttgatctatctttgccatacaagacctgatatttcctatgcggttagtgttgtgagtaggtatatgcatgatcctcgaactggtcacttggatgttgttcataagattctcagatatctgaaagggactcctggaaagggattgtggtttaggaagaatgggcatctaaatgtggaaggatattgtgatgctgattgggcgagtagtatggatgatagaagatctacatcaggttattgtgtgtttgttggtggtaatcttgtttcttggcgaagtaagaagcaggcagtggtggctcggtctaccgcagaagcagaatacagagctatggctttgagcttcagtgagatgttgtggatgaggagcttgttgactgaattgcgagtgctaagaagtgacactgtgatgcttcattgtgacaataaatcagccatcagcattgcaaacaaccctgttcagcatgatcgcactaaacatgtggagattgataggttcttcattaaggagaagattgatagcggggtgcttaggttggagtatattaagtcatgtgaacaactagctgattgtctaacaaaggggttaggtcctagtgagattcaatcagtatgtaacaagatgggtatgattgatatcttttgctcatcttgagggggagtgttggtgtaaatatgtattgtaccaaggacctatctgtaaagtgttatgctaatagaatagatgaggaaggggtgagctgagtaggcaaaccctagaaaaattccccaaattgaacaatagaaataaaacatattcaacctgctccttgcaacacatgagtaagctagtatttcaaataaaataatttcactacaacggctcacaaatgagagagagctataagggtagaatatgaaaaattgtttttaatggggatacataagacatattaagacaaatttcacacagaaatttacaagtcctatgtaattttatacctcaatcatagaaacaaagttgtggatcaaatctttgagctataagtggaagtacctctaaaatgaaatcatgatctcacgatgtatggaaaagcatggctctgacatgcatttgattcaagtatgattcaaacctaaatgtcacagaaaacattaccttcttccgaacactgcagtatccactgaactggagtgtggcacccaacactgaatcaatcagactgccaagcaaaccagcagtagcagagatgggtattactagaagctgtcgaagagccacgtcaaatgagcactccacagtcaacagtccaacaaaaacaaaagtcagacctatgattaggccacctgctgtggcagcaagaaggccttgtaaggtcactccaccgtttgtacctttcctgacaggcttaaaaatgatgttgaattatcagatcacacagacagacatgttcgcacgatattaccatgcacatttcaaaaaacaggagcagtaaaatgacgcaatgcagtaggaaataacatcacgcctacaaaaggaacatttcccttataccaaactaccttggttctagtttccaattatgcctattgaatttatgggaattgggcattaacctcaacccattgaatatgttgttaatattccaaacttgcttgcctaatgtgatcaatatgtgatccataagttgcatgaacaacatgaaagcatttctagagcagtaagtgttagttgtacacttgtgtgatccaaaaaattggcaaagcaatttgttcaatactccctccatctacttttgatagtcatatttcatcttggcacatagaccaaggataagtaattctacttatcatctatttaaacatgctactagttattcctcgtaagcaagcgattcattaataatgttgttggattgaaatatgcctattaaaaataaaattttcagatttgaaaatatgactatcaaaagtagatggaggaagtacaaaatatgttatgtgacaagattttttgccacttcagataacctgattggtactcacaggccatggtgtgttgtatagtcaaatttgaggagaacaaatcatatgctgtgggttcctctccaagaaaataataataataataaacccattgtgcgtttggcttagaaaaagtttagaccagtggctaaaacctgaaagacaccaaatgtggtaggctggtggccaagcataaccttactacttctgcatgaagattgcagaaactagaaagataatcatgactgaaaggaacatctgacccaaaaaaggaacacataccttcagagtagtaataagacgtggctgttcatcactaagcacaccaagttcggatgaccaagtatctccattgcagcagcaatagtgaccaatgatgccaccaataataccagttataacctttgactcatgggagtccaggcattgatcttgtcctccggtcattgttgccaatatgatgaccaatatagtagctattaagctatttgctaggacttggatcctttaatgtaaaacgtgatggtaagatacaaaagtaaaatcaagttgacaaatcagcagctgttgtgttatatccaactataaatgttatgctgtccatacaataaatcactaatttaaatatttgataaggtccacacaattcactaacatcttcagagtataagttttgctcaaataaggtgatggttccaagaaagaatagaaccagttcaagaatagttctgaggaaagaaaataactaatcataatgtattttcatcaaatcaattaactgtaaggggggttattctttgatttatataatagctttacacttttcctatggcatgctgatgacagtattgaagtgtactcctaatttttaacactgacatcatatgatcgaaacttaatgaagctccattgagttctcaatcttataaactgtcttccaaacaggcattgacttgaacgttgatgcgcataatatataacaatcttttgcaactgtactaatagtctgtgggcaatgggcttattgaaaccaccacatagcaaaacattgcacaccaataccatttgcggcagtagctttatatttctatctagaataacgactacatgattatcagacactcagcagtcagcatcattagctgccaatttagacatactaattaatttagttggagatggcagattccgtggcttaccagttgcgctggccgccctccttgaagtcgtcctcgatgcggcgcttcctgtccgcgccgatcttggtcgccttggacgaggtgaagaagaaggccagcacgagcgcgccgtacctgtacccgcaggcgaggtggatcgccatgacgacgaacccggctgccccgccggagccgtccagcgagcggcggcggacggcgcgcgcggcgatgacggcggccagcgccgcgccgacggctgtccgggccgcgactgaggcggcggggatccccatcggctgcgctgcgcccgcccgcggcgggagtcaaaggcgccagcgattggggggtgaatcgaatttgtggtaggggcgccggattctgggagaccgggatgcgactgtaccagtagtagtccaagtgacgactagtaagtatgcagttcagcaaatctgaaccgtcggttatttcctccgctgatgacattgagcaacgttgacgtcttcttccctgccctgtctgtcgaattttttttatttttttagaatctttatgttttaattttattaatagaccattctaaaaatatcggtccttttagcgccagagtcgctggcgtggtctctctgatgctgccccctgccaccacggagatactaacatgcccacccccctatcccccgctcccgcgcccctcgggggctccctccactctccttaaattcacttgttgtgtgtttttgtttttgtttctgttgttttttgtttttcctgtagtaaaaaaatagtacattttttctcttattaaaaaattagggttccttgagtttgttttttacattcgagtgtccttccttcaaacagacataattttctcatatggactcggaattaagcaaattatatatatatatatatatatatggatatgtatagaaaaagttacattcgattctcaaccgccttaccagattaagcgaaattagaatctccaaattccacttgcaagattgtgttttcgaggcgagaagcttttctgtagaactttagaaaattctacctgtcacatatttcatccatttgagtttactttttacatggttggtttatgtgtgctcctaagtgtaaaaaaatatcaaaaaataaaaaaattgcacatctctcgtctacactagagaggagaggaaaaatggcgtggggggtgtggcgccagcctcattggcgcgctccccctgccacgtcagcaccgagccaccacagtggcaggaggacggcgccaaagtcgcaccccagaaaggctatttcttggataagtttttctaggggtatattgtgaaataaatttttcaaaaggaccaaattatgaaaaatccatagcagctagcgtggcaggccagcattgccacggcagctgcatgtgacatgacagagttatttggccacgccaggcgggttggcatagccaaaaggttcatttcttagaaatacttttagggatggtctattaataaaattagaacactaaaaggtaaatgagcttttcttaagtgcggttagcataaacatgcataaaggtacgcgcgaccaatcaaggagcgccacctggtagctgagtaaattatggggttaaattacctgaggggtattaaggccattaggagaccggcgtaaactctaatcgttagtttactctagtcgtgattccacaccggaggaacgtacgcgatgttagagttcgctggagaagacaaagataacctcgccagtgcttaagctaggtttacgcacgattccacattggttacgtcacaactaaaatatcgataaattgcctgcagactctccatgaagtgacatgcacgttatggaatggcattccagtcaccggaaaactaagaagcgagtggaaacttgaattacgtgctagttcttatggtttactctctatattgcgccgctactgtagatcacgtttaaagaaagccattgcatcggcacacgtacgtaaatagtggtacagatgatctgatgtagaagatcctagctaaaagcaagcgatcgtggttacatcctatttacgttggtctacaaatacaaaatacaaagtacatagccacataagatcgctagcactcctctttacgctgtgagaaagaaaaatttttacggtgggccaggcccacctacatttagcaggtaatcctctcaaccgtgtactgaataacgataggagtaaatcccaacgtcagtccattacgaagcccattttggcaataactgttttatataatagtcctttctgattccactattatgagccaaacgcagcatcggttttattgttagccccttattattatccaaaatattgaaaatgtgatatataatttataattttgtcaaggtcttgtcctcggttcaccaccaccctcggattgcggacgtaagcacatcgattctactcatatgttcgatgtgcttgtttatgtgcgcaatccatcgtgtgcgtaaaccatcatgtatgccttgaacgccaagcgtacagtgctttgcgagttgcgttaaagcctttaaaggtcctcattcttcggcagtcgtatgttgttgacaatgcactgaaaaaaaataatctagcgtaccaacggagatgtttgtgacgacaaataaaatcaagcaaataagatggacttacctcatctttgtatgcaatttagaatattagtattccctccatttcatattataactcgttttgattttttttcctagtcaaactttagtaagtttgatcaagtttataaaaaattatagtatttttaacacaaaacaaacacactttcaaaatttattaaatgctggatctcacgaaactaatttatatatgagcctcacggcccatgagtgactgcagcgcgtgccccatggcacttgtaccctcgagacatgttccacgaacaacttgaatccatctacatggtctacgcgtcgagtaggataagagattaggggattggtagtaatactcatttcgtttttacacacctcgtgaattaaaccactaatttccctacgtgcgaaaccttcgtagcttcgcagctttattgctagcccattcgacaggtccacatacacataacggattaggcttttccctaaaacaattatcacatctggattaaccattttacactagagtgatactatgtaaacgccaacctagagtagaccattcacaccttcatgcacgtcgcgaccatgcccctgtacgcataaacctttcgagcgtaggctcgatgtgtttacgtccagagatacccatgtaggcctataccatataggcacctaacctatcgaatttgaaccacagtccaaaatggacgtgtttacgtccgaaagacacaacgatatgtaggctctatctgtttagtattctttttataaacaaaagagaggaagtcaatttccaacgcatttgcgtgggtttcttacatactctctccatttcaggtcataagatattttgacttttatcaaagtcaaactgtttcaagtttaactaagtttatagacaaatatagttttatttataatattaaattagttttatcaaatcaataattgaatatatttttataataaatttgtcttgggttgaaaatgttgctatttttttctacaaacttggtcaaacttagtcaaaaacgtcttataacctgaaacagagggagtaatagtaaaagatgacatggcgcgacgatcggcacatccaacatccaaactacttaaccctcgaaatataactactagttcaactatactgtataaactacaatctacttgcattatttctgcttcttccttggtggcaggtatccagatgaaccgtcgtcatcatcgttccagtaggcattcttgtcgggtgatgcaagcggaggggccttctcgtcggtgttccagtcatcgtctttgtcttcctcatcaccggggtcgggcaaagagtaatcgtctacaactaaccccattaattccaaatttggggaatacccagcgttggtgttgaaatcaatggggactctgttgaaatcagcgacgatgcctcgatatgaaacatgggtaccattcctcctcgctagaagatgaatcagaggatgaggatgaagaactagacaaagaacacatggtggcggttgtggtttcttgtttggttgtagagtaaatgaatggaagatctaagtacatggtgacaacccccaggaaccgccgaagaagaagcgcccctcccaggcggaggcccaagccgacgagatcaagaggctgcagaatgagttgcgtgacgccacagatcgtgtggagattcgtgacggagccttacgccggatgatggaggaatccatccaaaaggccaggcaggtggtcctacggcttggcctcgacatcccgctcatacccaatgccgcaacgagcttcgcggatactgtcgggcactacgtgctcaaattttcacatctcgccgacgtgctgagtagattgccaccgtcgaagaggcgagagcggaagagggcgcagttcgtggccaagcgcatgttggtagcaagccgtgctcaccgctgctcgccgccaccgccatcgccactcctagaagaaagcgatgccacggcatgcggagaggtcgccgaagccgactgagttcgtagggtgtcagtacgtaggggttatgtggggacacccgataaagtcatggtgtcccacgaatacgtaactgcccaggatgttcagttactcatgaaatgatataaaagcataaacttcgattatacaatacttaagtcacttagttcacaacacaacataaatacaaaccattacatatatggcctataaagccttatttctaaaaacagataaactgctagactccacccacaggaactgccttagcgtaggatgacctagaaaccgtaatcgtcccactctaatgggtcaacaggatctccataagcatcttcctcctcatgatctgaacccatttatgagtacaaaaggtactcaacaagatatgcttatgataataaatacaataattgcaatataaaacatgcagtattgagagccggaaggtttaaaccctaaccttaacagttatttcatagagcctaccttaataaacatttgatataaacatcactattgaaaatttaatttaaacaataataacgagcataacatataaatgttacttataaataaattgaatagaacatcaagtaataaataagttaaccatattaatggccttttagtttaacttgtgcccataatctggaatcacccatagacacatatccattaaccgggagcacagcgtattcgaatactcaacgactctgcagcgtctgcccagctttacccacacgatacccacagctggccgggctgaaaagtaacaaggtgtaatattgctccttatatctctcccttctgcctagtaagttaaaagatgctcgggatgttgctcggagtgatccggtccgaggtgtgtaccaacctacctccgcatccacttaccattgttcgttactcgatgggcagcccagaacttcatggacccatagggtagttctgaactctcggggcccatcgagtccacatatataaatcatataaacatgaaccatgtccctttgcttcacacacttgaaagctaatggccagtacaccgaaaagcctgcagaagtttaatcaattggagcaatatacggccaggttcgacagatcgatcgtgtggatgggcgaaactatgtcattcttattgacacaagggggttgattattatatcaatttaaaataagaaataactatacatatatccatcacgaccataaacaggtccataaaaccaaacacataaactctatcatgtgtaccacccgctcacaagcggtgttaacaattttcagcatgtagccataaatagttccataagcatgctttcagatgcaataataataatatccatattaaatcaatagcatgtaaaataattaacagctcatttaggtgttcctcaaattttatcctaaacttgttagactctagggctcattaaggtgtccataatagcaacagaaagtataatgcaataatagcaatctaattaatttaaaagaattcgtgcagtttatcgtactccaaaggacgagtacgctaccaaaataactctctaactactgggattaaattgttcaagggagggtgcatgtcttacaaccttcgggctcgatgtagtcgtacaaaccgtctcctcctagcgcggagatttcactcgctccgtctaccggaccaacgtcaacgttttctatttacgcaacaatcatcaccacaataaataacagaaaaacaaagataaccaaaagaaaatagtatcacaaagtgcaacaatgggtgaaaaggatttaaagaaataattttagcgatttttggaatttcggtgaacggcgaaccctagggctaaaattagggcctcgacaacgggtgctcggattgcaatgaaactgatacggatggattcggaataattctaggagggtctcggattttgttttcgaggtcaaaaggatggtcaacttaataggaagagaaaaaggatttttccgatttatttttcaacaggaaaatcggatttttcttctcttctctcgctctgcacaggaaccggccggcaactccctagcgccggcggtggagatgaccggttttgggcaagggggcgccggtttcacgatctaggggtcgaggcgactccgttcccatggttggcaacggcgcaggcagcggcggcgaggctggcgacggcggccaggagctggaggcggcggcggccatggtggcggcgactccggcgatctccggtgcgggcgactggcctggtgagaatcagggaaggaagtggagcgcggtggtggcggcggctcggcctgtggcggccgggagcggcggcgcgccgtgcagccggcggcggccgaacagagcggcgacgccgggaggcggcgccggcggcactccggcgtcggatgggatggggaaagagagggtaaagggagtactatgcatggataatccgtttttaccttcaatttcagaggatttgcgatgtatgcgatggcgcaaatttagggtttcggggatttttcctccggtaatggcgatttgattcagcgggagtaggggcagatttaaggaggtgaaagaggttgaaattgcgcttcttttgcctccggtcttgagccttctagttgagagacgaaggagatacggaggcgagtagctggaggtgtcgcggcggcattcgttcgtcgttcgtcctcgtgcgagcgtgtgcgggcgtgtggcgcgcgcggggcggcacgagctcagcgcgaacatgcgcaagcgcggcgtgggattggcgcgaggcggcacaggctctggctcggcctggcttggcctagccgagtagagaagaagaaagaaaagaaaacgagagaaagggaaggagagggaagaagaacagagaaaggaaaaaaatatggaaaaagaaaattaaggtggaaatagagaaaaggaaaattttggggaaaattaaaatagataatatttgaattgatgtggaatttagatggtccgacattcaggatagatttaaatcggattcaaaggaattatttgagggatgatatgcactttgcaacaaaattaaacgagaaaagaacatcgaaaataaacatggaaaataatattttaaataaactattaactcgacggttatatttttagagaatcaaagcaaactaaatcggttttaaaaagttatcaaattttagggctgttacaggttaattatatttgcgatcgtaagatgcgatcgagtggataacgtcatctaggccagacggttcctctgcagtggtagcctctgggtctacggacgggcgagagattagagtgggtggtcaccgcatctcaatttaccgagcacgtacgtcttgcctctcacgcgtacaacgacactgtgagctagcgtaggatggatgtggcatcatcctcgatccgcgggcagcgatgggggtgaaccttgtaggcacttagcgatccccatgtatgcgtagagcgggcacgactcgcgaactagcatatcggccatcacgtatgtgtaaaccgtgttgtaggtagtacgctctatgtttttacgtccgaaatcccgatgtaggtgtaatgcacacacctcgggcatagtgctgttgtacgcgcgagaagtgcgtgaaggtttacgcgtacgcgcgtgaggatcgtgagttgcctacacatgtggttcacgcctgccagtggatcgtggacgtaaactaatctttcgtgcgcgtaaattaacctttcgagcgtagcatgaatgtcaggatgtgtttacacccgagatccacacgtgggcgtgtaccatatagggcaccttgagatggccgcgtaggcgtataagccttggaatttgaccttttgcagcgtaaactatcatcttgatagcgtagacagcaactggtagtgtatgggttgattccctgcttggcgtaacccttgtcgtcctcgacatataatccatattttttggtgtatgggttgattccctatttggcgtaatccaatttttcaatgttccaaggaggatgaatagtagttgtgatcctacgagagtaaccacatgatgatttacacaattacctttgagagattcaaacgtaattacctatcaatctatggggtatcaaataaagtatctaactatagttaataaatttgaaaaatgttaaggtgctatatggaatacaagtgtaagaacttgagcataattatgaaaacgtaagggttttagtagtaaaatagtatagctcagattggctattttcatatacttctgttgggccatccgctatgaattgcagtgaggcttttcagtcttttatttttaaaaaatacgatgtttacgaaccttggttgtggggatagcccataacataacattattttttaacagaacgtaatccatttatttagaccgggtctgctgtggctatgtactcgcaataagttgttgcgtaaacatgtaggaatttatgtaaacgaataaccatacacttatccggatcttctacgacgggtcatctaaactagcatattgaggtgtgtacaaaaaaactacatatataacttaacttgtattctacttctacaaacgctaaataaagcagcggcttggtaagaattaataaattctgtccatggcaggttcttctccattagcataaaccataactatattaacgtaaaccatgcgcaacgtctatcttttctggcgtgtcctacttctagcctggtaagaactaataaattccggccatggcaggtccttctccattagcgtaaaccataactgtattaacataaaccatgcgcaacatctatcttgtccggcgatggttgtgtttttgcggtgaccatatcgtccggcaggatatcctggtgtggtgctggttggagttgtttgcgtaaaccatcaggacatcatcgtaaaccatgcgcatgactgttaaaatgacgtggatacccttctgtagtgtttatgcacaatgcataaagcctttatgcggtgggaggggaaacaccctcacaggcgtcggatgtggacacgtggcgcaatgtccttagttgaccgcattgaagaatgtacgatgttaattatatattattattagaatttaaaacaattttaaaacttgcatatgttaattatatatgattttaagaatttaaaacaattttaaatctagcatatgttaattatatatcatccacataatttatttaaaattttaatctgttttaaatgttttgtcattaattttgtgattttatttcattttagtgcatcatttactattttattaaacctatatttaatgaaattaaatagacccggtgtaatgcattattatatctttagtcccggttgttaaccctagccagttcaaaaaagaatttggaaatagcgagacatttagtcccggttggtgagaacaacctggactaaatatcaaggggtatatataggcccgaggcggcggcgtcttctccaccaatacttagacgattttctgcttcgatctcggcctcatcggcttcatctctagggcatcctcgcatcgtcgccgccgacaccgccaccgccgccgtcgctacctccacctccggcggcactgccgcacgccgccgccgcttccacctccggcagtgccgccgccgccctcgccggtggcgccacgcaccactcccgctgccagtgccatcgccactgccgtcgccgccgcccatgccacctcgaacgaacgagaacgaacgtgttaacaaacaagaacgagaacgagaacgagaacgagaacgtttcgctaatgtgaatatacgttaacgaacgaacgagaacgatagaaaatgagtggaacgaacggtagaaacgatagaacgaacgaaaccaaacgagaacgatagaaaacgagtggaacgaacgtgaacaaacgatagaagcgatagaacgaacgttaacgaacaaacgagaacgatagaaaacgagtggaacgaatgtgaatgaacaatagaaacgatagaacgaacgttagcgaacgaacgagaccaaacaagaacgagaaaacgagtgaaacgaacgtgaacaaacgatagaaacgatagaacatacgttaatgaatgaacgagaacgatagaaaacgagtagaacgaacgtgaacgaacgatagaaacgatagaacgaacgagaccgaacgagaacgagaaaacgagtggaacgaacgatagaaacgataagacgtacgttaacgaacgaacgagaacaatagaaaacgagtagaacgaacgtgaatgaacgatataaacgataaaacgaacgttaacgaacgccaaaacgagacacctcgttaacgaacatagaaattacatttgtattaggataattgagactaatacatttgtttgcatttaagaaaatacgtggtccagcaccgaccgtcgtcatcgctcaagcttaagtggtagtaagccctcgaaggaaatactcaggcaagttatattaacagatttaatattgctttcaattgtaataatcatttatgtctggatacttaaggaaacgtaatacccaaatcttaatccattacatattctaaatatataaaccatcccctgtaaccagacgataaactagcgatgtgagtatatgtatatggtacccatagtatcacctgctatactcttttttactattctgtttgctatactcttttttactattctgtttgccgaacatgaatggtctggatcgtcgacatcacagcctttagctcccgaagtacgaaggtccattgcaatctgtcccggatcattttttgaagtttcgacacagctcggaaataatttaattttgaatgctttcagacaaattcaaaaattcaaatgttatgcaataaatttggtcaaaattcagtcagaatttgtcgaaaagcagttaaattttgtcaaaaaccatgataccgatggggttcaaaatttattggtcaaccataaacactggtgagaagccttgttgttaagcgtattatcaaatatattctcaaatatagtacccacagtagacgccagtgctttcacctctgcaaaaggtacgccaccaattctatctttctataaagttaaggcccactgcattctaaagcttaacatgtaaagatggcacatcatccactaacatttattagtacgtctcaaatctcatgcaagcatgctaatttattaagttttagagctttaaaatgtaagcatgttaattaaattatcatcccacataattcacgtttgtaaggcccactacattctaaagcttaacttgcaaatataccacatcattcactaacatttactacatctcaaatctcatgcaagcatgctaatttattaagttttagagctttaaaatgcaagcatgttaattaaattatcatcccacataatttacataatatttcaatatatatcttcgtcactttttataatatcctatatgcctatatagttcattctcacttaaattttagagctttaaaaaatccaagcatgttaaatcattattccacataattctcaaaatatttcaatatatctctccatcattttatataatatctatatacctatacaattcattctcacatagttaatgctatttctttcttctctcattaagccatatcacctcaattgtttttagccctcaaataattaatcaatggttggaattatctccctcattttcttctctcataaagtcacatcatattacttttaaatttggatcatcattctatatactatttaaattatggtaaaccatatcagcttatacaaacttctatcgtctagatattttacatattatttctatttcttattttcatacgaaactctcgcgacaacgcgcgggtttcacctagttttaaaactactactaccacatttttctctagttgtatgcttaggcaaaaatgcatctattatatagtaaaagtctattaaatatcctataaatgctctcaagccatcacatagcactcctccaatcgcccctacgcggctacgccgccacatggtatttaatcatctagccgtcgtttttcactaatatactgtggacccattattttctaccattagatttattcatccaaataaaaagggataaaaaagaagggcccgcatatcccacccatcccatccagtaagtatgcttgcgtacgtatgtgcacccctcatatttcctttctcttctattttcctttttagttagatggaaaaaaatattccccgcctgtccaataagtatgcatgtgtgtacttacccacatatttcttctcttgttttcctcttttagttacatagaaaaaatattttatgataacaaattttaaacaattatattatctaaatcatatagataatttttatttgcacacactattagattatttactataaaatttaaaatgaagatccaaattaactatattattgaagaaattccttattttagtcatatattctacgaactatagctcgctattgttcactaatccatgcattttaagaaaaaaatcataatatattttaaaccttccaattaataacataggtaggcaagtttcacaataacaaacctaaccaattaaaatacgctcacttcattatgttagatatagaaacaaccataatgtttaagctactttttttttaaatatttctatgccttttaaaccggtataaccattatttctaacagttaaatctatctttattaaaaaagtgtttattcatggtacatgacatttcaaaaatattattgtcctatgatacttcatagttatcgtatttctactaggttgcgtggagtctctcatccacactatataaaatgttcatagatagatcacctctcaaaatatatcaattatattaggctatataaacccatgtatttagtggagcttcatgtaccacccaatttatcttttaagagattatgataatatattatacaattaaaaacaccttatttttattttacacttaatttactttcgttgacattttttctaaagaaaataaatctatttctaaagaaaataaatctactttcttttcaaatgacaaagaagattataaataattgcttatagatattacttatatatatatatatatatgatataacataaagctaatgggataaaatattattaaacaattaattaatgctgacaaaggcaatttatgaagaaatcatgaacaatattctctggttaatacctcgcttttatcaatacgtacgcatgatggacgagctcctttctagttatattaatgtatccaaaaatgcattatattattatttggattttcttccagagattgatttcaagttttcggtaaataaaataaacaagtttggctactttttttatgtttactcccatgtttaagcacctaagaccgtcagataaccatttgtaataatatatgccgatggtagtaacgtttggtgaaacggcaagaatcgtaatgacaatgtttttacaccactcgagtttcaggcttaaatttgttttttttattaaaccaagccaggcatggtcatcggtcacatggaagtacagttcgtcaaacctatcaaagtttacagcaaatagtccaaaagacaggttagatgtcggtatgacaacaacccatcaagatcaatcagcacaatcagacaggtaacgaagaaatttggccatggcatcaagtccctattccgagcggaaagtacagattacattacacaaggatccattagacaagtggcatggctataaagtggaaaaataacacacaaaattgaggaaataaaacaaacaccttcaagccccaacagtcaaaacacaaactactccgtatgtagaatgtgcatgaaagcacaaattgacttaagcaggctattttttttctgaatgaaagcttcaagcgtaaagctagttccacacttgagttagctgcaataggaatcagttggttgtggtcatctgaaaaggatatacacaggttcatcagtgcatcactaagcaaactatcaagacttcaagagcaaacaaggattgaactccagcaatttcagagaacagcaaactagattcatcggcgaagtgataaatcgctttaaatacgcaaaggctacccatagaacaaactaataaagatatatacttgcagatgatgaaatagggagaactaggttgaacgtttcagccctaaaagcctcctaagttctgaagcatccagcattatcagattccagtagagcaggaaaccaaaagatctagagctgctgtgcaaagaagagccgaaagaggaaggataagcatggcgatagaagcaacttttttcccaacaaggaaaagggcactagatactggtgaccaagtatgtactgctaccacctaaattcctagtaccctccaccacacctgcaacaatattaatactactgctatctggcaacatacatcatcaccaccatgctcatacgcatggagcacaatcctgaaaaaaaagttattttttcttttaaaaaaagaaaaaaaaagcgctaagtcaagaagactcaagaggagaacgatggaaatccagaacagtaaagctgctcgagggtgacaaaagatgcagagctcccttcaatccaaagagggtccatgtagggttgatgcagctcctggggcatgcaagccataagcctatcccaacaacgagtactccatcattttcctatctacacacatactattagtataaattggagtagtttctttcagatctcgagctgaatgatgaacatggagtaggctaacgggatccatgacccagcagctcaatcgacccacagcaacacccctttttggaccgaaaggagctcaacgtccacaacactttccagcaacgacaagaacagctcaacataaccaaacgaataagaacaagaagccatggaagaaaaaacaagcttagcacaataggctaaccctaacgaaaagcatggaatctgcacacagatgattctgcgagaaaacgagagagaagaaagaagaagaagaaaaaccctcctacttcccccctcccatggcaccggctgcctactgccgtggatggagatgctactaggcgctggtccatgctttaaagaagaggagaagcgagagaaaaagagagagaagaggaagggggaaggggttggctcgaatcttcacaaggggttctctcgggaagcgagcagacgccagcccagccctggtctctctgactccgagcgcttcacatgcctttggctcggacgaggcggccatgcccaatgagtccatgaccaccaccaccacagcaccactccctcgacagatg

SEQ ID NO: 59498 - DNA, 1376 bp, Oryza sativa
ttttaagcaacaatgagtttttcatctaactttagtcgtccattttatttaaaaatatttataattagtatttttattattatgagatgatgaaatatgaatagtacctgtgacttatgtttttaatcttttttttaatttttttaattaagacagatgatcaaaattaagcacggaaaatcatggtagaagcactcgatattcgattccttgggacttcatattggagaacacggacacaagggcagtttccgccagcaatagattacctggatatcaaagttgactttgctgacagagagcctcatcgagttagcttatcacaaaagtccctttcgtcgggtaaccacagttcgcatccacttgtatctatcctgacgtccttcagttcgcaggataccaatatcgtcaattatttgcgtctgcgatgtaaacacgaaaaaggctgtagatttagccgatttgtttggacgaagtcttgaaggaagtgttctctgcggctatatttatgcaactcgttcacagtttagtggtcatgttttcgtttgggctactatactttgtgctctagtcaagttaataaacttatccactactcatctactggctagttgaccaccttcacgtagggtttcgtcaaaccattatacttggtcagaatcagaaactgtagtactcggtatgtactatcaatctgtactactcaagtatttaagaaagcatccgtacttcacattgtaagaagaaaaatactatgatcttcagcagaagaacatacaagaggataagactaaattccctttcaataggctaaattcctaattaaaatggctgcatatatccggttggatataaaggccaggtaaaaaatatccttctctaaaaaaacacatatgagaggatgaactcctactatacttacaaggaggcaacagatgatcaaaaacgtttttcgttattccttagaaaaagaaaaaaaagaaaaaacgatttgaaatggctcaatgctaattgagtacttgtctaatctctagagagtactccgtatataggtttacaagagtagtcatcaccagaaaataacttttggagggaaactctattgtactaaccagttcgcgttcacactgcacgctactcaaaccattcaatccgaccatctctgctccatggttaccccgggaagctctcgttgcggctccgccttcttgccgatgatcggcttggccgtggttccgtccgccacgtcccgtagcacgattgcaccggctccgatctccgctccgtcgccaatgtgcacattgccgagcacgctcgccccggcgccgatcagcacaccgtccccgaccttggggtgccggtcgccggactccttc

SEQ ID NO: 59499 - DNA, 15968 bp, Oryza sativa
  unsure (1)..(15968): unsure at all n locations
ttatttatggctctttgaaacgtaggaatcttacaggagaagtcctctaaaactcctccattccgaatgcgacctgaacttaaacttccactggataccttttgattgactataagactattttctgtgcattttgcagtgcatgagatgcaactttgcttgttacttttgataaccacaaaaggatttttgacaacaaacagtaggggtcatttttaaaataaattgatcaaacgaattcatgtgcagattaattggaaaggaaaagagggaatattggttatgttcttccctcttctttcgcaacttacctccattgttttccgtgcatgttttttaaaatgttaaatgtatgtcttttcaaaaaaaatattacagaaaaattgctttaaaaatcatattaatctatttttcaagtttttttagtttaataattaattaatctcgctctgatcacttgctttgttttccatgtaacttgcctcccgaactcagcccggtaaagagagctaacttggtgtatgcatggttgtcgttggcagtggatgacggcggggcgcggcgtggtgcacgcggagatgcccggcggccatggcgtccagaggggcatcaacctctggatcaacctctcctccaaggacaaaatgtactcttcttcctgtgcctctctcatcagccgcagcaatggcggctactacgtaacagttgctgaccactcgctgtgccgtgccgtgccgtggccatgatgcgtgcgtgcgtgcagggtggagccgaggtaccaggagctggcgagccacgacatccccgccgcggagcgcgacggcgtgtccgtcaaggtgatcgccggcgaggccctgggcgcgcgctcgccgctccagacgcgcaccccggcgctctgcctcgacgtcgccatgcggcccggcgcgcgcctgcgagcgcccgtcccgcccgggtggagcgcgtgctcgtacgtcatcgacggcgaggccgtcttcggggacgaggccgcggcggcgggcgcgcacacctgcgtcgtgttcggcggcggcggcgacggcgtggccgcgcgggcgacggagcgctccgcggcgaggttcctgctggtggcggcgcggccgcacggcgaggccgtggtgaaggacgggccgttcgtgatgaacacccgggaggaggtggagcaggccagggaagactaccggaaccgccgcaacggcttcgagatggccgccggctggagctccgaccacgttgccaccgccgccgcggcgcatgatggtcaccggcgacggcgaggccggtgcaccatggtnngtcatcagnnctcatccaggtcgcaggtcaacgctgcgtttgcgcgggaggataggaattttgggaatttcgttgcaaagttgatgtaagataaaatggaggattaggtgtgccgtgtgaaactcctgtaaaataaccttatgcgaatattgaatttcgttcaatttttgtgtttgaaacgatgttaaaacttactgatcaaatttatgggtggtcatcttgtgtgagaataacatgtatgccattgaatcatcttgcagaatatctacttgagctgctacattgctaatatgaatttcattgtttaaaatacaaatggagaactaagtgttcattatttctttttgttgttctgggtggtcatcttgtttatgtttccatggaacgtcaaacatgcctttgtgccaaaatgccattttagaaaacagagctagtttgttctctccatggtatatcctttgtagtgtcttgttaaatgcagaacataatgtatatcagtttgatgaaaaactaggcgataaacctgccgattgtgaataggattaaacaaacaatttaaggtgcaacacagctgcatggtcaaactatttttcacctgtttcagtgatatcctctctacagctccccataaattttgatacaaaatttgaacttgaatattaaaatcagttaaagcagaaaaaaataacaggccaaaaatatttggattcgtcatacttgagaagttctggagatgggcaccaacatttcaagaaactggtggtaccagccgttacactggtttcctgaactctgcttctgaatttgtaagataaggtcataagggaatttcacgatcaactgaactttggaacaataacttactgtttacttccagtcgaatgtcagttcgtttcagttttttccacctgttacatctgttgtttcgttctttgattgcctgcctccagatttttctttttttttttgcaactaggaaggtagcccgtgcgatgcgcgggcatgtatattaattcgttaaaatcatgcttgacaagttaaattaatatgttttttcctttctttttaattgaatgttcatcgtctcgctcttttcttatgaaatattaagaatttattaattaatgaatatattttatgtgtatccagctatccttacctctaattcatatgcatgcaagtatattcttgcacaagatctatctatctatgatatgtggcacccatatgatatttttctaaaaatacctagtcaacaggagtaataaaatgtaaatttaatatgaaaaatataacttttaaatatgaaaggccatcaattatgtaatgctattagtggcttatatacacgcaagagtaaaaaacccatgacacattggaatttaggatagcacatatttatcattggcttttgtgtctttatatgtgtgaaagcaaatatgactcgtttgaaatatatataaaaaagtaaataaaaaaatattgttgggacataaaatgagatattttgtatagttaagggagtacactgattcaaactcggtgtaagtgatctatataattgtatgagtaaaagcactgcgatgaatataattgtttaaacgattaaaaaagttggataagagacttaaaattatttgtgccaatattcgatagttcgtatgtgaaataacattagcaatgcatgctagatattataactcattcattgtgtcctgctctgatactgttaattttctatttcttttctcaaagtattggattttttccattgctaaaataaaaagtttcgtgaggtccaatttaattgtgcgatgtggaatacaacccatatgccatttcataaagattgtgcgaggctccacgtagttcgatggaaatatgatttgatgtctaaacataaccgctcacgtgtcattgcttttacaatgtgaaatttttgttgatatcatagattgaatatttttctgtaaaattatattagagttataatttatttactacaaattgacattttttttaattttttagctagcttgtagtgggcataaattagtgcctatcatctttccacttctaaatttttgttacatagttaggctttttttttatgttcgtgccaatttattatatctgctacaatcatatatataattatacatttaactctcactaagtatagttaatgttatttttctaatctctatatttctagcacctcgatgatttgtctggtcgaaaactctctcttttgtttcttctttcataaagccataccaccttagttttgtcttatgatgttgaatctatatttgatctaaattttcaaagcacataatcttaactgtgtttatagcttttttggatgattaactaaagatgcaaactgtacaaagtaacatataagattacgttgtttagctacgaaataaatttattttgtactatgtttctgtcattatcattcatcatttctgcagcaacgtttccttatacagggttttatctaattaggttagttgtgacttatttttcttgattgtcatctcatgctatgttaagccatacttcctccatgcatgatacgatcaaatttcctgttctgttcatttaggtcacgtcaaactttgtttgtgcttattctttgatgtttcgtatcttaatttatatgcagtgaacatatacaaaaattaatttttggactgcaacactgcattacgattaggctggaagattttatcatatgaatgatgcctctctctctctctcgttaacggaacatatgcgcggagtatgtgtggttgactcatggatagcgtcatcaagcgacagaacacgcgtgccatcttgaattttttaagtaggttaagattaagattagatctagtgattgaaaatatttgccctaccaatttaaagaaaaaaatcaatggtgagatgtttttcttttttttcttataatttctgtgtttttttcataatttattagagtatcatatggtggtttaggagcatttgtaggattgccacgtggtgacttaggagcgtttatcgaatctaaatttaatatttgtgtaatatggtgcttaaaaatttgctcttaaaacatttatattagaaatctaagctatttatatgtatatggattcatcaattaaagttgaatagttaagttagagaaagaaatgaaggaaagtgggagggatgaatgtacgtagtcaccgtgaggggaggaggtccaggagaaaagggcggtggagatgatttttgatgggttttgggatttttttaaaagatagatctgacggtgtaaaatattgggtccaccgtattaacttaaaattgatggctatatgtatttcttttttcttataatttcttcgatttctctgatttattgagtgctggttgttgtaaataatggacacatacaaggccagccacgtggcatattgatggtccataattggcacctataagtcggtataggtgtcgattattggtacaaaacaggcacctacacacattataggtgccgattctaccaccaacaccgatgactaaagtcatccgtgctattatctgggtatcggttagaaaaaccggcatgtaaaagggtttcttgttacctatggtgtagttgaatgtgctcccagtaaaattattgatttaaccccagtccacctggtccatcttgtatgagcacagctactaattaaaatttttgtgattagctggctggtttgcaagctcattggatgattttctagcaacagtgtagaagaaaaaaaaaatatcggtgttgtttttttttcaaaactccgtaataaaaaagagagttctcaaactactggattgacgtacgaaaaccatgcagttttcatggttttatttatcggtaatattggttcacagtgatgaccccacgtccttttttggttggctccaccgctgatggcaggtatagatctaatctaacgatacagaataatgggtccaccaatttaaatgaaaatcgatggtaagattagactctgccatgtggcggcctaggaacgcttgtaggagcaccacgtgacggcttgggagcgtttataggaagtttaatggacttttagtatataatagataatagaagataatagatagatagatagataagcttttcagcactttttttcttccctctatgttttccatttcctctttccgccggcgacaacttgtttttcttttcggaactggaagagtcacttaagcatcacattttactcgagattccgagagcgtctcaactgctgcgccagcttaccgtccccagagctcttttgtttttacaatgaaaatactgtcatggaacgtaagaggtctcggagacaaagaaaagagggatttagttcagtcaaccctgtttgagcacaagccggatattgtttgcatccaagaatctaagttaagcaatatagacagcttcacagccccagcttcttaagaaacttccactaccagtcttccaccggttcttcaggaggactgatcacagcctggagaaatgcaaagttcaaagctgccctcacctgctccttccattccaccatcgatcaaacatccttcctaatcacaaacatctatgctccccatgccaactccgagagacaagaagtgtttgatctgctcactgccttgaggaccacacgccttgagccctggatgcgcatcggcgatttcaacatatacagattcccacatgagaagaacaatgacagcataaatacaagaggaatggaagagttcaacagttggattaatggtgaggggttgtttgacatagacatccctagtagaaagttcacttggtcaaacaagagaagatgcccgacttcggtaaaacttgacagagttctgatcgacaccgcctggaaccaaactttcgccaacgcctccgccaaagcactaatagcaacaacttcagaccacatccccatcctcgctgagttctcggacaactgttcaaaatcagacatttttcgtttagaaaattactggttgcagatgcctgatttcatcgcgatgacagaaacaaactggagcagaggaaccagacccctgacagcaatctccaagctcaaccacaaactcagacggcttcgagccagcacgaaagcctggaacagaaataagcgcagcattccaaccctcctgtcagccaacaaagacacattggaatacctagacaaaattgaggagtggcgtcaactgactgatttggaatactacctgagacagaggattcaaaaacactgcaatgagctaaatgatttcatcacgcaaaaatggaagagaagagctcgtatcagattctgcacactaggtgatgaaaacacaagattttatcacactctggcttcagtaagtagacaaaaaaattcaatcagactttttattgaagatggtgttaaattttatgacgatagcaaaaagctagatattgtaacctccttcttcaggcagctgttcagtgaaacttccccttcggacccaacattcacactacctctgctctaccctcaacaagaatgtcttcagagcctgtgtacacccttcaccaaggaagaaattgtaaaagtcatccatagtgcgccaaataacaagagtcccggacccgatggattcacgaatgagttttacaagcgattcatcaacaatatttaaccggatctgcaagcagtctttcaagacctctttgacaacaacatagatctttcaggtgtcaaccaatcctacattaccctgattccaaaggtcacagcagcagctcacatcaaagacttcagacctatatccctactgcacagtgtcccaaaactgctcagcaaaaccttaaccaacaggctgcaaaaggaaatattaaagttgatcgaccctatgcagtcaggcttcatccgtggccggtcgatcacagagaacttcattctcgcctcagaactggtacagtcagctttgaagggcaagaaaccaatgatagtcctcaagctagattttcacaaggcctttgataccgtcagttgggacgcactgttccgaatcatggaagcaagaggtttcccggacaaaaggattggttggatcaaagcactattatgcacaggcaaagctcagatcaccaacaatggacaaaagggagaacagatacagtacaaaagaggggtacggcaaggagaccctctatcaccctatctattcattttagtagctgatgtgctccaaaaaatgattcagcaagcattcagcacaggaatcctaaagcacccacttgacattgaaggagcaccgcccaatttgcaaatacgcagatgataccctgatcctactaaaaggagaagctgaccaagcaacagcaattaaagaaattttggattcctttgcaaatttctcaggtctgcaaataaattaccataagagcactctagtacccatacacctgaatgaggcaacaaaaactatggtgacgcaaattctacattgccctgctagttcactcccttgcagctaccttgggttacctctttcaaccacaaaaatctcgcataacatgctgctgccagtcatctcaaaagttgacagatatctagccggatggttgcctctatcaaagggaggaaggctaactatgatcaacgcagtcatgtcagctatcccgacatactacatgtcatgttgtatctggccggaaaaatctatcgaagcaccggacaagataaggcgtgctttcttttggaaaggggaaaaatccataaaaggaggtcactgcttggtggcatggcaaacagttctactacaaaaacagcaaggtggtcaaagatctcagggcacataacacagctttaattttaaagctaggacataaggtactcttttgcccaaacaatccaatgactaacttggtttagaaggcgatatctgaagcatactgtacagttactccccagatccagtgatacccccacttggaagctcattatatctcagtttaacaccttaagtgctgcaactcaggtaacccttggtaacggcaaaactactctgttttggaaggataattggctgcaccaacggttacaattcacacacccaattctattctcctttgctctggatcaggactgcacggtagattcacagtttacacaaaactcctggcatgtcaaattgcatcctaacctctcctaccaagcagaattagagctgcactcgcttatgcaaattctgcacaggcttagccccatccctgagattcctgacacaagagttcttttgcattctgtacccaagttctcaacctcaaatgcctaccaacttctgacttaccatggagccctttggaaaccggcagaatatgtctggatacacaccatcccacaaaactgtaagatcttcctttggttggctttcaaagacaggcttaacaccaaggcgaatatggtcagcaaatgctggagcgaagatccgcactgcccgctttgcccggcattagaatcagctgaccacatcatcctgagatgcaagaatgctaatagcctatgggaaaaaatgaacctactgcacctggcaaaccattctgaatcatcctcagctttccttcaagcagtcgttgacagaaatcattcaaatagaggaattgaacctatctggtttgcagcttgcgcatacacgctgtggaaagcacgcaacaacatgatttttgagagacaaattgacaacatgcaatcatcattcaacaaatctcagacacactaaagctccggagcatgagagccaatgaagcaaccaaagaacgaattctctcctggtgtgcagggctgtagttgtgacattactttgtatatacccttgtaattccagccccctgttttgtttcttttcttttcttttcttttgtctattttatttttcccgtttcccctttcttaataccccctctgctataacctgtaacttgtaaacctcatttctcttaatgaaatgactataaggtagagcacgctctaccttcttgcttcaaaaaaaaaaacatcgcttattttccatttagattgaacatggaaatgcacatatgtgaaggactagatcattggcatttgaactgtgaaacacggtgtatagccataaaatttaaatggtgctaaacaattaaaactgtccaatgaattgtacatcatcgctcaatcagtatatcagaaaggagatattgacttattgcaataccattgacaagaacatactgtattcatgtttgtgtcttggaagtaccataaacctaactcactcttctagcttgagattttctaacatggaaatgattaaccattacagctgtatcttgatgaaggagagctaagctatcccataagtaatagaaaacacctctaaaaaagacgaaaataggtatggcactgtcatgaagagaacaagtcatcctataaaaaccacatgagtaacttagagaacaacagggcacatgaacacatctaagattctaagtaaaagtgtaactgtaatgtgagtgcaggtaccatgctacaataacaatactacctcttcaatttcctgtgggatatgattatgaaaatcttgaagcatccgatgcctatccaaacaaaagaacaaaactggatttatgatggaaagattgtagttcagacttcagacagtagagtccttaggagaagaaaccaagcttttgcttctcctcatctaactcagctgtatcattatcagcattcccttgcttagctacagcctcacgcggcagtggagaattccattttgttgtaactgattgctgatagagtaccccgccagccagagtgaagagcaagcaaaccaaaccaattgaactcgcatgtttatcccagatcataacattgattgcaaccgtgagaaacttgttgacaacacgcctgttactgtgaaagccgtggcagagattgttttccttgctgcgaaaccaaagaagctaatgagcagcccaaacacaggacaaggaaactgtcacaaaggcatcaagttcaaaccaactctggccccttgattcaatggctgatctgaagactgataagtgctctccagtcaaaaaccaaaatacaggagcgattaccagctagagaagattgttgtagagtacgaagccccatgtgttcagcccagtttatgagaacttaagattctgagaagtagctggtgagaagctagctggtaagaatctgtagaagctgagaaacccagcttctagcttctaatttatttttggatttcataactatagattcttataatctgagtgaaaatctggactatttggtggagcttctagcagtaatagcttctaaaaaaatcttcagctcctagaagctcctccaagcaggcccatagttactagataagcaactgcccatgggtaggctgtgaggctgaaccccgaatatgtcatcacgtaaccaacagcacctcctaaaatagtcacaagggacaaaattgtaagcttggaaggacatggctgcttcctgaatcctgaaggcagtatcatcagcgatggcaaccaaaagcggggtcaacgatctgaacactataaaggtatccacattagcacgcttcaggagatgtgtaggtgttggtgaagatggcaaggtagaacacaagcgccgccggcgcaaacttctttgcggtctggaagttgaagggatcatggtagagtagtccaagctttgcgagggtccagacaccagccactgatgtcaagtactgaagtgcagtcaggaggccagggtagctgaacttggtcatggcatacttgttgatgatcgccagcaagctcgagcacagagaggcagccgaaccacggagccctagcagctacaaacgcctctcaccaatcggccgagatgcagatcccgcaggtgagattcggattccgatcgcattcgtgaggaaaggggaaatgcagagcagtcaccgctccgacgaggggtcttaccaagaaagctcaagacagtatatatctcgggtggacggattcccgcgggagggggagggagagctccgccgctggcggccggccggcagctgccgcgacccgcgcgtgggcgaggttgagcggatcgggagaagagggaggggcatgtttgtggtgtaatttggcttctattatttaatcttggtaggccaaattatttagtttagctttcattatttattgaatgtttggagacgtatacgcgtcggacgtacggcgcgagccgaaaaatcggacgcctcgcacgaccgtccgatgcagcacgcgcgcgccagccgtccgattggagaaacaactgtcacccgacgcccgcgccgttgcaacacccaaacacattaatctgtttcattcaatgtgtcccgccgttgaccactagcacgaggggagatcttcgcggagcgactggcgctgcgctgccaccggcgattctctccagcgccggcgaccctatccctcgcgcccctatcctcctcgcgccggcgaagcctgcaacaacgccgacgtgccgccacaccacacgcagtcaccgccctgcaacttcgccaccgacgccatggctcatctgatacaccaagttgagagggatttttcgccgagctcatctagtgcaaacagaggaacaaccccaatgcataatgcaacgaatttggtgagtaaaaaatttctagggttttacttgtttcactttttttttgaaaaagtttcaataaaaaattgaagtatagatctatgaaacaatgtcttccctcatgcaacatttatattcatgtcttatttttaattgtaacttctgtataaatttggactggaatttgacttgaacaataatccttaacttgctaaaacataattgtacaagttaatgaaacaagataaaatgttacagattgatgtccaagcaccaagctcatctggtggcttccttgatgtgctattatccaaatcctctgggcatgaaactgacttggtgagttgtccttggatttgaaatatcacaaatgtaggggggatattttgctttgaaaacacagtatgtaacttagtgaaacttttttgtgtactaggttgtggatgtggaaagtgttgacaacacagatgtggctgctgtgactgttgaaattgatgaacaattggatgaagatgcatctgaaaatgatgaaaaagaaaaggatgttgtttgttccccaccaattgttccatacattggaatggagttcgatatagtggaagaggcaagaaatgtttacaacgcttatgcttataagctaggatttggaacaagaattgcatcatctagaaacagccaggcatcatcaggggaaaaaaagcatcgaagaaatgtaaagtatctgaaaatggagacaatcatgatgatgaaccgaagttgataaggagagaatttgagtgtgttcatgcacgtaagccagaaaataccacaaaagatagtgctggtggcagtagcttcatttctgaagagaacaaggaaaatccgcccctgcttgaaggtaacaaaaagaaggctcccttgctggtggaagggaagaggaaacgaccaaaggttgcaaagtatgattgcaaagctcatatggctgtagggcttagggacaacaagtggagagtcattgctttccaaccaaaacacacgcatccgatggtgaagcgccttggaagaaggagatattacagatctcataggcacatctcaaatgaagactatgaatttctaaagactttgcattatcgaaacattgcaacatcgcagattttggcgttgttaggagatttgcacggtggtgtaaggaatctaactttcattgctaaagatgtctcaaatttgaggacaaaactgagacaacaagtttcactcaaagatgttgcaatgactattgattatttccagtaaactcaagcagatagcccctccttcttctatgctgcaagatatgatgaagacaacgtgttgaaggcgttgttttgggtggatggcagaacacggaaactgtatcaaagctataaagactgtgtcttctttgacacaacctttatgactaaccgttacaacatgccatttgcacctattgttggaattaataaccacctgcaaacaatattgcttggatgtgctttgatttgtgatgaaacaactgaaacattcatatgggtctttgaaacatggatgcaagcaatgaatggacagaaggtaggttcagtgatgacagtccgagataaagcaatgagagcagcgattaaaaaggtgttccccggtacaattcatagatgttgcttatggcacgtgacaacaaaagcagatcagcaactcctgcccgtgtatacttcaaagaaaggcttccgtgaagctctgtatagatgcatatatgactctgaaacaatagatcagtttctatcagattggcaaaaaatggtagatgaatatgacctccatggaaaccaaactttgaataacttgtgggaaacaaaagaaatgtgggctccggtatactttaacacaagttttttcccttttactgggacgacagggagatcagaaggtctaaatggactattcaaattatttgtacacccacaagattcagtgtggatctttgtcaaacaatatgagcatataattgagacaaggcttgacagagaggacagggagggctacagagtagagacaacagaacctagaatgtattcaaggtaatgtgatatgcctgtcttgaaacaatttgaaaaagatgtgctttctgtttttaattagaaaaattgatgaaacaaataatatctgtactgtgtaacataaactgtgcaagtgtggaacaattgacattaatgggttgaaacattgaattatgcaggtcactgattgagaaacaagcatcgcagttttacactacaagtgtgtttgcagacaaattctagtatgaaatatatgaagcaacagggctggatgcagaaaaaacacaagaagtccccgacataatatataatgttatgccaagtgacatagaaagaacaggtaaaaaatatagggtcacagttgatgcagcacactcaacctactcctgctcgtgccacaaatttgaaagagatggacttctttgctcacacatcttgagggtgatggctgtccttaacatccatgagattccaagtaagtacttgctgaaatggtggtcagagcaagcgacattgcaaatacgtgatgagtacaatggtccagcaccatcaattggagtcccggcaacaagcaagctgagattcaacgcattatgcagggcaatgacaagccttgcttcagatgcatgtgttaatgaggaaaagtacttgattgtttcagctgggattcagaacctacacgcaatggttgcaacaccacacactgttgagacacaacatcagtaaggtatttttcctagtcaacaagacccatcaagttcagctaagaatccagcaaccaagaaaaggacagggaggctggtagaaaaaactcataggatgaagccaataggggaacaaataactgaaagcagcaagaagaggaggacaaaaaagaagagctcatgctcatattgcttcaacgagacacacaatgtttcaacatggccgtatctcaagatagcgaacatgcgagacgctctactaaaccaaaaatggtgcaagagacggagttgacactctgagaaaaaagagtttcaagagctataaatttagatgcgatgcactatactgttagaaaatatagtggtaattgccatattacaatataaaactatcttcttgtgttaggtgaaacaaattatgttgtgagatgcaacagacatattttttttaattcacatatgggcagaatgttggatgattatgtgaaatgagtctttcttatgatttatgtgaatgattgttaagtggaaagaagggaatgccaaaaaaaaaattacatctctgcactaatgattacagtggaaaaagaatatgtagagctggtgaaacattcattaagtgtagggtgagacaactgtataacagtaggtgaaacatttgcttcttatggaacagaacatgtggagctgtgaaacaatcattaagaacaggctgtaactattatgtaacagtaagtgaaacattgcttcttatggaacagatcatctggaactatggaacaatcattgataacaagctgaaacatataagtactagaaggtgaaacattgtttcactctaaaaagaacatcttgaactatgaaaacaatcattcatgactgccccctagtagatgcaacattatataaagagtagcagttcaacttgatagcacaacttcagtgcacaaacaaaaaacagaaaacacaacacacttcagtgcacaaattcagaccacacatagctacccagagcatccactttgcactattttttctaccatttttacaacttcagtgacacgactgccccctacactaatttgcttgaagttgatcatggttaacgaatttccggtagttcggcatgtccccttcattgaatgcttgcaggtttttcccatcccaattctcaatgtatctcaagctggggctgcaggaat

SEQ ID NO: 59500 - DNA, 3007 bp, Oryza sativa
  unsure (1)..(3007): unsure at all n locations
cggcatgccaaatccattgttcttaagcccgggagcttgtatagtttttatttttggggtgatgtctcttgtcataagaacagaaagaacagaaaaaagttaaagttctactaaggttgctccaaaacagcgtaatgtgatgaacctagtctctaacgcctttcttccattttccttttatacagaggtctctgatcagaattttgctgatgatgaggcggaggttgatgcagaatcaagcaaagcatgcaagagaaggaagttaagaagtgctcttacacggaattaccaagtaatttctcaggattttaattagcttattctgttgcaaatattgagatgaagacagcacactaaaaaaaaaatcagagtatcagtagcactgacatggtttgttctatatatgcaggttgttccatctgacaaactgtttgcttccacaaaagctgatggaaggaaagatgctccaaagtaaggcatgcaagagtggatctggttgaatatgcagtcaatgagaactggatgagttagtattggcgatttagtagtatagttcttgaactctgtagagtctgtcttggtagaagaataataggatcgatcactcacaacatggtagatttattgtttgatcatattgttgtaatggttttttttgtgtgtgttgctgtgttctggcaactgtttgtttgccatgtgagtaatatgtttatgtttgccacaagatgagaatgatgcaaagcccatcattccttttgccataattccattggacatacatgtactcccatcatgatattgagaatgaaagatcaccaattttgcagaatgatatccaacatctgtaaaatgaccatatataattgtgttcatggtgtgtaaagtgcaaattttgagaagtactgaattactgatgatacatgttcttacttccctgtgcaaaccaacattcagcgctgtgtacaggtatgatggtacgcatatttgccactcctggccaccgtcctcgcaagagtttaccaaagaccccgatgaggggaaaccaaagaggcaaagaggaggaaaaccggagaaagaaaacgagagttgagtggaggttcgctatgaagaggggggaaatcgccggtggcggcgagctcgtggtgctattcgtcacttgtagaagaggaggggaaggaactgctgcccgggaaggaagttagaggagaggaagacgaagaagaatggatgctgatatgtgggtctcgtatgaaacgagttacttcctccgtttcacaatgtaggtcattctagcatttttcacattcatatttatgtgaatgaatctagatagatatatatatctagactcattgatatcaatatgaatatggaaaatgctagaatgacttacattgtgaaacggagagagtatgttaggaaaccacatttaaaaatcgctagggagttgaattataatggttttacaggttgagatgttaaaatatgagctggttataagtggtattgttgttgaggaatatgaattagattgagcctataataaagggagtcaaatcggacttattcctttgtagaaagcccttgattgggctgatcccctgggtcggcccagcatggcgccttgaactagcaccttctttgtctttacgggcataagcttctagcagctacagtttctcacataatctccaactctcttaagggtgtgttcgctgctgatggataggaacatatcacctaagcacgaaaaatgaagcagtccattaccgcgtgattaattagatactccctccgtataggaaaaaaacgtcgttctagccataacctcgtttgcgattttaacgacattctgaaccgcagcaggctatgtggacggaataacccttgtctgttcgatagccgctcccgcaattaatccgcagcacgcccgcgcttgcctcgtttaattccttaagcgtagcatgcaggcatgcagcacgccgctgaaacctggctgtcacgctcgccgccgccgcatgcgtcgcgctcgccgggcctgctcttgtcgctctcgccgctgccgccgccgcttgcgtcccgctcgccggccgcgctcttgtcacgctcgccgccgtagctctcgtcgcaatcgccaccgccgcngcatgcattgtgctcgccggccccgatctcgtcgcttgcgtcgcgctcaccggccgtgctctctcacgctcgacgccgccgccgccgctcgcattgtgctcaagatgcttgacgagaagcgcgaacgtgagctcactcccaggaaggatgatgccaaagaaatggtaagataacacaacttaataatcgcattacaaggatgtctctattaattgagtgcggaacctaactagcttcattctaaatgttcaatgcagcaagagtagccttggttcatctaggaaagatggttgacaaactgatctgcaacaactcttgtatctttcttgcctagtttcccattcttgcttctagccaacaaagcttgataaacttgttttctcacttcttcggtcatgtctttccttccttcgatggtttacttcaacgagagccatgacatgttctagcaaaaggaagaaaatcaagttcattgatagtacaaatagccatggcatgttctagcaaaatctaattgtatcaaaaagaagttggcttaccagcaaggtgttgtacataatcgaaatcgactgcaccaaattcatttagtggcaagttcaaatcaaaaccagttaaaaaaaatggaaaacaatgatatgagaaacgatatagagaagaagagatagcacagttgccgtacaaacatgcccaagagaagaaaaatcctgtcaaacagagaagaaaagtaccattgccgtgctccaacggaggctcgttcagatcaaaggcaaactcgccatcgccatcttcggccatgtgtactgcaatagtgagaggaagctagctagaagcctagaactagaagatgagatggctcagtact

SEQ ID NO: 59501 - DNA, 11906 bp, Oryza sativa
tctaccttatttttaaataactaggaagaccgtaaataattagttgtatagatgaattaagtactattatatagtataaagctaacagatagcttagaaaatttatttgagcaataccgatacgataaagaaatttgtgaggaaaacgaacttacgaagcatggtatgtgccatctgtttgatattccaccgatataaattcatcaaaacgtaactatgatacatgcccgcgtgtatgtacgggctaccttcctagtttctctaaaatctcttatattatgaaacggggggagcataattttttcctatgtgtcatttggaacaaaggatttgatcatgtcaaattctctattgtatgcaccgaaaaattaccatgagctaaaattctcattttatttttcttttaagaagtccaatacagaactctttgtatttcctctcttaatccatcaaattcctatagttatattgaaccatccaaaaacaacatacctcaaattcttgtgttttgaattcctatgggacttatacatcccaacattctaactatatttttttctgtttctagtattcttgtgggatttatacatacgtgacattctaatcctatttattgtgttcctgcgtttctcaaatcagatcctgcattttacagaaaccctactaggaagcttgtttatgatggagctataagtagatatcatgcttataccattcgacatgtacttgtcattgatccattcatttccacaggctattgacattttcctgatacttggcataattaatactctgaaaatttttattgtaaattgtatttgaacaacaactattgaatgattttcttttaaacatatgtttatgggcatataaatgttctttttacagttaatagtctaacattttatcaaaaaaatacataatttaatttttcaatgttcttgaaatgatagttttattaattagttcaaaataaagttaataatcccttctttctataaaggtaatgcccactaaacacctaaagctcaacatgcaagcacaatatttattagcactcctaaaatctatatgtaagtacgtcacatcaacttattaagcacacaaaactcaacatgcaagcatatactgtagtaattatatctataattttttttcattctaaaactaaacatatacatgctaaatcatcactctcaaatcattttcaaaatatttcaatccaaattatttcatctagttacataatgcatttaattatagagttcatctaaacgtcgctgtttcggattggattcttgttttttcccttatatttacgtatttgtttggcatagctatctgtgcgcattgaatttgaaatttgtaagttaaaatataaaaatttgaaaatttatatttcattaaagtaggaagaaatataatttttcctcctactttaatgaaatataaatttccaaaatttttggatagctctcacttataaacaagtatacacataataatagtatggtatcaccgtataagaataaatggatgacttgcaacggatgatatgcaattaatgttatattagttattcaaagctatttgtttaagtatgcaaaatatgcaaaaccactatccaaaatcatcttaaagggtaatatggatggtattataaagttcagggggttagatatccggttttaaagtttagggtgctaggtggacttacatccaatgtttataggggtatttagattttttttatgatttattaactagtagtagatttgaagttcttaagtttaataagtttattagtggagtcatatctccacccacataagcaaaaaaaaaaaaatccaacctagcttttagcttaagggcatcaataatgtatatagaccaagtggtctttattattcccatttccacgatgtatatataaatagtaattgacattaagaatgggacccacactctaaaaaactttatatccaaatgctatagttctcttgtagaaaaagcaaaaggagggagatattatattttaatttatatggatgatccttatagctatgggtagctgatcatatgactctttctaatatcatctctcacaatggcaaaggtacctatataaagttataaggatggccttttgtcacattgtgaatgccctaatcgtgtaaaagagagtggcttattgctttaaaagaccaaacaaaaaaaactgtttgtttgtttagatttaaaatattcagctcataagctagcttataaaactaaacaaagaaggccagttaaacaaagcagagttactgcgagaaccaaattctatttcttataaaactttggttacctatgtttgggaaacttctgacaactacagtctttttttagagttcagctatcaaagtccctgaatagtttagatttacattcaaattctgagaaacgttattatagttataaaattcagaagatgaaatccaatttcctcatattctcaccgtgcctgcgtgccaagcaaacagggtgtagaaaactagaaaccctcgcaaaccccagacgcgttgggcgtcgtctccctgcgccgcctcccctcccttctctccccattccgcatcctccctcctgcgcgcaatcgcttccaggagcccctcccgccgcagccgcagatggattcctccgcctccgcctccgcctcccccacggcggcggcggcggctgacgcggaccggtacacgtacagcccgaggctgcggtggcagccggaggtcgaggagtacttcgccgccgcgtacggccgcgaccgcttcgcccgcatctccgaagccctcgcgtgagccgccccttccccctctcttgcttcattcctattctattcattgatgaatgggtgtgccttaacttttaggtcatctagtgtcttggtgttgtagtttgttgctttcctcgatttagacaagctggagcaaattctgttgcgtgcagctccaaaattttgcgcgcgcttggtcctgggcagagcggccattgcttgttttatactttgttttttctcagtttagggaacttggagcaaattctatccgaacagatgctctgattaacatgaaaaggattggctgttatgttatcctgtaactggtttagtaaaatgattgctcgagcggagttcgatcaagctaaaccatgctagattctggagctagccaaaccaagtatgattcgaattgatgtggcaaagcgattacaattagcaaaaggagcaaattccagcttccctccaaaaaatgaacactgcttaactgtaaatgctgtctcacgattatttatactcgttttaactttccaaaaaagttcttttcatttggcatttttcaaatagttgtcatgcaaaaaagcttgaactagtgcttgagaatcttctggctatcaggctatatagtgctaatagcacagaatattgatttgttagccgtaattattacatatatgacccatcatttgataaacatatcttatcacttttaaacaaaaggggaaaaccacccgttgctactaccattggattagcgaaggatatagatttagcttttgcgaagtttgcacccatttgctggattgtttttacttctccattctttttctccaaatttcatgctaatcaacacatccatcagagaccatttctagatttgctggattatgccatctaatcaaatgtaccatgtttcaatcagttctggtacttgcagttgctattttcttgttctgaactttcagcttttaaggacaatgtcttaatactcaggcaaatgatttgtgtacgaacaaaactgcatggatgtacttgattggatttacttagtgataaattctctgtggttccaaggtggtgaacaattcaaatgtttaggctggagaaaatgattcaaggaataatatcttggagcagcaatgcgtcaatctactagtgtttttttcgtagaaattgataagactcttagctaaagactgttactggttgttgacttatctggttccatgattttcatttagcttcctttttcaatgtaactaaagaacatggttttccagggaagagatgaaaatgaagaggcttctgtgatattggaaacgacaatctttatctatgctcacctttttattggattctctgttcttgcatgtctactataaagattcttttgctatgctcacctactcagtagttactaactacagatcagtgaaagactgaagttcttgatgacttgaccaaaacggtcaaataaaagattgagccagttctacagtttcatgctagtttccattataagtaaatagtgttaattttgtactaactattactttcttgattaggcatccttcttgttactcttgtattcgtgtcaatactctgaagtcttccactgatgctgtcatgcataaactgatgaatttggtagatcagaacggactctgtggtggaattaatggtttggagattggtcagcagaatggtggagagcaagcacatgaagggaattctgtggtgcataagtgcccatattctggccttgacaacgttttgtttgtacaaggttcaggaccacatgcactgcactacaatagccaacctgaccaatctattaaggaagtgattgtaagtcgaaaatgtgcagagtcggttcttagaggagcccaggtatgttttcttatgtttgtgtgtttgtgtgcttttgtatgtgcattatgttgagatgtaccgaaaaatggctagtcctagcataggagaataagttgtttcaaactttccgttgatcattctgtaattctttttttttttgctgcatcacctcaatcctatgtggagcatggggagtgctatataagtgtatgaattcactgtagtacttgctgttggactggatggtgactagtagccttcaatacctatcttgtttttttaaataatgcttttccgctcatgttgctgattgtcttttactttttccttttggatttggaaaattcaacatttcagttcgaggttgtatctttgcatgcttgttgccagttcatgctactagaaagtccacactcccaaatattttaactttccttttcattttctttatattcaggtgtacatcccaggagttttagcttgcagctcacatgttgaaaagggtgacaaagttgcagtgtcggttgctattgaacaacctgctgaggatggtggttggaccgttggtataacacgaggaactgttttacagggattgcagtcaggcaagcttttcaactgaaaaatttaaatcctttttgatagcttattgataaactgcaaatactctttttttttttctgtacttcatgtatgttagtcactgttacagttttaagtgtgaggttgttttccccagctaaaagtcatacacataacgctatgaaattcaattctttgcagatgcacatcatgaagaaagaaagggtttgtacattggtcaagggatcactgcaatgtcaaggtccggaatatttcgtgttcctcatggagttgcagtggagatgactgagagggtgtacaagctcccatctttcaatggtacatttacttctttgctgcatttcttggctatttgtatgtaacacgggtacaaatacactattgtatttcattcttttaatataaggatagaactggcaatttgataggtgaattattttcccccatatagtatgttgtgtgccaattcatgcaactaactttgaaagatgtgagatctccagtttggcgatcacattcatagctgacttctttagaaggagcattcattataagtagtcatgcatgggtttgacagccaccacgaaccaaacaatgaaggatatgaattagttcacgaacaaagtaattcctttatcttgtcatttgaattagactatttcttgaagatacagagttcagtgttaccgggacccgcgtgtccaaaaaagttttgccgcgtcgacacacatctctatgtcgacgcaggatgacatgcatcggacactgctagcgcgagtccaagtccaaaaggagagttgcaatcgctactgctgtgctgcagcctgcagggtgaagaaataaagctctagcagcagtcttgtagtgtggagtagtactactctactccgtagggataaagcatgtggggggagagagagcaggtggggggagagcagtgttactgggacttggactcgggtgtacgacttggcgagctctagaaaataagattcggtgactcgtctaatatatagaagttctaataaaaaatattatataaaataagataccaacacataaaatagttggttagacacaatactactgcacagaagatgccatttatatgaaacaaggaagtcaaaagtgcatgctctctgagaacagcatcctgccatctctcgtgaggcaaaagcctgtaaaactgcaaaaaggaacattatctctcctctctcccctagtgttaccgggactcccgtgtctaagaaaaatttgccgcgtcgacacgcatccccgtgtcgatgtgtatcagacgcgggacgacgcgcatcggacactgctagcgcgagtccaagtccaaaaggagagttgcaatccctgctgctgtgctgcaaggtgaagtaataaagctctagcagcagtcctgtagtgtgtagggataaagcatgtgggagagagagagcagtgagggagagaggagagagaatgtcctttttgcagttttgcaggcttttgcctcacacgagagatggcaaaatgcagcatgcacttttgacttccttgtttcatataaatgggatcttctgagcactagtattgtgtctaactaactatcttatgtgtaggtatcttattttatataatattttttattagaacttatatatattagaccagtctccgaatcctattttctagagtttgccaagtcggacacacgagtctgagtcggactccaactatcgagtctgagtcggattccgactcttgagcctgagtcacggtaacactgacagagtttgtatgcatgaaaaaaaacatctgagcttaattgttattaggactgtcagtgagttctgactgcaggcttgatcttggttcggattcggaggaaacttggtcaggcttgagcttggcttgtgtaagctcgtgaacagtatagcatatgtttcaagaacaatctcttgataaagacaataaatttattgttaatcacattggcaacaggacgaggactaagagaaatatgtgatgctaagctgctgtgtatgcatactaatttatacttgatctactagtttatcaaatacaaaaaaattgtgcgcacagccaggttggcgatctattcaagctcggttcaacaaagcctgagagcctaggctttggcttcggctaagctcatttaattttcatttcacttctgattgtagattatgcctactattgtggcctactgatcacatgaccacgcaaatcctcatattagagtttgggctttgcatattcttggtttgatgcatggtaaaaatattgcgatctctgcatagagccaaatggtatagggttgttgatgggcatccctacttttgaaggttgatcggttgacctcttctttgattcgaatttcttaactgaatacccttgttaatgcctctatgaatacttacatttttcatttcatatttgcattttatttatttagtattgactgatcttcaaatgcatgatcctaaattttgtttctttatgtcgtctagatgtgctcgaaggggagatatttcttcagaatcttccaagtgttgtggctgctcgtgtccttggtatgaatataatttttaagttagcaaaattttcaaatttatggcaatatggctgttttctgaaagtcttaagtcatcttttatctgatattatgtcctttgctgtgtgatgtatcgtatatttatgtggtagaaatgctgaaaatcttaggtttgaatatagttattgaagcaacaaataaataagcaaatgttactgctaaaagattgaactagcaaatgttacagtaattgaatagttgtcacttgtcagtttgtacatagcatatagtttgctgacttttctttctatgcagaatatgataaatatttttctttttagttctgaatagcttaggtcaaaattttacagcctaatttgttatgtacagtacataattttctatttatttgtagatccccagcctggagagcggattctggacatgtgtgctgccccaggtgggaaaacaacagcaattgctatcctgatgaaagaccaaggagaaattattgcccttgatagatctcacaataaggttaattcttatgtcagattgattatatgatgtcaaatggagttattctaaacagataaaatgaatatgagggaacttacctggttacgtttttccctgcatgtcgtgtctgggtcatggcttcatgaacagtctacaaaaggttatatactcagataaagacaacaaattgaagtgttaatagacttacaacggctataaaaatgaatataaaaatttattattcagccaaaacacaaagtttgttttagcatatgtaaagaacagtaaataatgtccctatgttttgcaatgcaatatggcatcttgtgaaattataatgtgctaaaagatatactacattttatcaccatcttttggctaatttttgttggttggaagctaaaatccataacatgcaagatggagcagcagcaacacttcttccagtttcttggccaatttgtttattatgtcttcttccagtttcttggccaatttgtttattaggtcatttagtgtagcatacttataaactattgttttgcatatcttatctcctacccttattgattactctctccatcccaacaaaaactcaacctaggataggatgtgacctatccttgtccagattccttgtcctagtataggccccatgctatcctaggttgagtttttttgggatggagggagtagatatgattttaggctaggtggtccagcttcatgcaagggcattttttttgtggggcacttaagggcatttgtctatgtaatttatgaaggaaatagaaagataaccccaagtctcctattcctaattacttttttctggaacatgcagaggaactggcatgtcattattttaagatgaaagacaaggccttggacaaggtcatggccctataacccaaactcaaacactaagtatgaagggaaacctacaagaaatacaaaaccaaccaaacaatcatgaaacagagctatctatctaataataatgcatcaatacaaatagctccaagccacaagagcatccttgaagttcttctagtctttcacttaaccagctattttggttatattccttcctcaatcagtcccccgtccttcacaaagtgccattttattaaagtaatcatcccccagacagatttttaccccttttttatgtactatcctgcatgccagcattcttctagaaaacccccaaaatatatttccacattttttagctgtatggaaacagaaactagttattatgcaacataagggtctttgaaggtcattttcatgtcacggtgtaggttgtttgaaggccattttcaaatcgacacattaggaaattttgtgtggcatcaagaactgagtaacacatgtactccctctggttccataattcttgacgttttggacaatgacacggtctccaaaatatatgttttgactttatttttctattataatatatgcaataaataaatgcatgtttacttttttcatagtactttgaaggacaaatttatatatgttgttctagttcctttaaactaaatacttttaaagttattgataatcaaagttacaaaagtttgacctcaaccttatccaaaacgtcaagaattatggaaccggagggagtaatgtgcaatgacgatacctataaaactaacccttttttcaatcatgtgctcccactttacatagggtgtatttttcatcttagaagtcatattactttgcactttcataatattgaagtagattacaggtgatggatattttgaagttggccgctgagatggacctaaattgcataaaagcttataagcttgatgcactcaaatctgtacggaagaccaatgaagcaaaatatattggcgaagcaggcagccgcactgatgcaattgtgacactggcagaggactctgagccttgtattaataaagtcgatgctgggactactaatgccagtgaagacagttctactacatcagttgttcagactggtaagggacatgcaaatttgtacccatttctcttcattttttattatttaattttataatggtgggtgaatgcgcatgacacaccctgggatcacttatatttaattttattatttattatttaaatctaacctttttttattactgaagttacagctattttatatggttacactttgcactttgcggagaccaactaaacactcagaacataattttccctaatagatatatgcacctgtgccttaagtatatgtcgttcttaagctgaattcagaaatttgataattttgttttgttagataacaaaaaaacagatgataaaagatatgtgagcaaggcagacctcaggaagaacttaaggcgaatgaggaatggaccaggaagaaataactgctcaggtggtagagttgaaaattctaaaggatttttgcccaatagctttgatcgtgtcctccttgatgctccatgttctgcacttggcttaaggcctcgcctctttgctggtgaggtaagggtattgctagtttgcctcaccatatttagagatgcggttggtcataaattgagaatgccttttagaattgcccttttactttgtctgtatgtactcgttccaattctaaatgtagattgttttagccttcttaactctttcctaatataggtcattttaaaacttgtatgcaccttgttcacattttcttgttttgccttgccaaataaatggtactactcccgcaaataaatgactcatcttttccaacgtaatataagtgatggacaacaaaatcttttcagttactttcttaatcctcgtgcacaagtaaaaagacttacaattggaacaagatggaggaccacttttctttcatttgtagaaaaggtgcaatgcaaatgataaacctatctttagcaagtaaacctacatgttcaggatctgtttctactctgacaatgggtatttatgtttagtgtccatactcttagctatgcatcagcacgcacacctacaatggtacattgggaaatgagttattttatcatgtgtaattcttttaacaaaaaatggatgtttttagtaaattaaaatattggacatccaggccaattatgttcattcataatttgtaatcaatattgaaaatgttaaccaaagattcgagtttaccatattttaaaataaaagaatggtatgtgtggcattatatgtatttgaggtattttaaagagtaaattgcattggtggtacacgaacttattaggtgggtgcaatttagtacatgaatttgtaaaatgcacgttttggcacacggacttatctaatccgtgcgaactaggtccaaaatggtttagcaaggttaattttacctagctgatgttaattaggatgtggcatgcatacgtatagtgagtatcataaaacatgctatatttataaatttattctctactttatcttgaattttgtatgtttctaacccatgcatcattgctcatttgcccggtattttatatctttctctac
